United States Patent 11,401,555 (GENETIC POLYMORPHISMS ASSOCIATED WITH STROKE, METHODS OF DETECTION AND USES THEREOF) - sequence listing, part 6

SEQ ID NO: 379 - DNA, 316748 bp, Homo sapiens
ggccttcttctgtttgctccttttcttcctggagttggtgctcagcagctagttctgccagccggctaggctgctgggacagcaggagccattcaaagacatggatgtgatttttctgactcccagcttttttaatgatccattagcagcatgcatacaacagcacctcagttaatctaaggccaggcaccatctcttttcagtctctctcttaactgagtataggccttggaaggagaagtcctaggaaggaaagcacttttctaataatacaagcctagggtcatccgaaaaatagcgcacatgagttttcctctccatccagatagtgccataggcccctcttctgttttgctctgtccctgcgtgtgcccaggtctagccactgtggccagatgacctctatgaaagatggaggattagctgtggggagtggctcattgagctgttttgtaggataaaaatattttgtttagaatttagttttgagtcaagttctgtcctgatgtagtcacctttcttctgtcagatacctccatggcccacatctagtcatccattacccaggatgactgattccaagcttgtggaggttgtttggtgggaggaaatgtgtttgtgtgtgaggggggtgttttcttacattaaaatactaagttttataaacataattttattggcccttctcagtgcctagcaaggaaggtaggttaggtatatgctccttttttcgttgaggaaactgagctcaatgtttttgtgtgtgtttttttatttgtttgtttgtttgttttgagatgggcagcctttgctgcccaggctggagtgcagtggtacaatctcggctcactgcaacctccacctcccggggtcaagcagttctcctgcctcagcctctagagtagctgggattacaggggcctgctaccacacccagctaatttttgtatttttatttttattttatttattatgattattttttgacatggactcttgctctgttgccaggctggagtgcagtggcgccatcttggctcactgcaacctacacctcccgggttcaagtgattctcctgcctcagcctcccgagtagctaggactacaggcacgtgccaccacgtccagctaatttttgtatttttagtagagacggggtttcaccatgttagccaggatggtcttgatctcttgacctcatgttccacctgcctcagtctcccaaagtgctgggattataggcgtgagccaccacgtttggcaatttttgtatttttagtagagacggggtttcaccatgttggccaggctggtcttgaactcctgacctcaagtgatccgcctgcctcagcctcccaaagtgctcggattacaggcgtgagccactgtgcccagccaagtgtggttttttaaaaagcatgtttttagatgatggtggaatatgttcacatgagagatactttccaagctctgtgagacaagtcccctaccactccaaaaaagaaaaagtctaccactacattcaaggaaaaaaacaacaaccctgcagggcttttcagaattgttctcagaaatcagagctctttcacagttcttagttttctcatgctaaggccttacatccatactaccgagtccaaggtacctcctatcctctctgttagctttgcttgggaggtgataatgacttttttttttttttttttttgagatggagttttgctctgttgcccagggtagagtgcagtagcatgatctcggctctctgcaaacttcacctcccgggttcaagtgattctcctgcctcagcctcctgagtatctgggactacaggtgtccaccaccacgcctggctaatttttgtatttttattagagatgggatttcaccatgttggccaggctggtctcaaactcctgacctcgggtgatctgccctccttggcctcccaaagtgctgagattacaggtgttagccactgagtctggccttattagagatacgacttcttaggggggaaaaacacttctattttagccatgactggatttggagttggaaagctggagacctcaaatctcaagatataataaacagacaacttatgctcaaaatgttaacaagaactacacttcctaggagacagagtcctcctgactgaataagcagagtgaataattttacttttcttttgttcaggggagatctggtctattttcacaagcaaaggagaaggaaaaaaagccaaggggtactttcatggttgccaaagggtcacagataataaacagaggtgacaaagctagggtgtgagaattaggagactactgggaagtctctaaggtttttttcccctggaagggcaggaacacaagatgcttctggaatctctggattatgggaagccaccagccaaaatttcttttcatgcatggctgcatggctgtcaagtctctccttcctgtccttcagccaagcacattttctttgataccgtcagttcagaaagggccagcctgttcgaatcctgtaagtgctctagctctgtgtgtccctttccctggtggctgtgttggtgtgggaagcctagcccaccccaccagcagcctgacccggatccttcccgcagaaggcccagaacagtgaatgcctgaggcagtttgttggaggcaatgcagcctgcctgctataagctgtgagacttagatatattctaccaattagggcacatctgttcaaaacgctgaaaggcgggcactgtctctttaagaggcatcccactcctctccttgagtaatgagggctgggagcacaagggagtcagatgctgattaaacagtcctactgccgagctctgttagaaaattactgtaattatgatctggtcccagcagagggatgagttccaatcctgctaataacccttccaggtgcctcagattcagggcccatgggaggcagcgtcgacagggctctggctggcaccaggaccagtgatggccctcctgtctggcctgtgctggcagagacaacaatgacactggacctcacttcctattttggcctcctgagaaggcagtggtttttggttgcgtttttgttttatttattttttggttctggacagagctcctgggagtcattttgtatgagaaaactttccagtaaatgaacacggaggaccaggaaaatcacagccgagagatggcaatctgtcctgaatctccccacttctgcctggggactgtagtcaacatacgaaaagcatgttgcccggccccagtcccaccagtgcactgaggagggaaccagagccgaaccctttcatctgcagctgccttctgcgtggtgtttcttgatctgaagtacacagcatttgacttggtcctaagtgggagtttcaagcactcctcttttagatttctgtcacagaaaagggaaacaagggatagtaatcacagggctcaagacacgagagagactgtaatgcgtctctgaaccggcgaatatggtcttgctcattccaacacatcgtagtgcaaatctgcagcagtgcaggtgagcaaatcttaaaggtagagcaaagggtttttaagccctgcgggatttgtggcatttaaatgctgtatcttctcaacctagctgtaatctctatcacataatccagcggctcaagcacaaacttctagaatgaggggtggtttctctgctttgtgctaaacacaccccaaatgccctgagacagcaattctcaaccaggggagattttgcccccaggggatattaggcactgcctagaaatatttttggtggtcagagctcaggggtagggtagggggaggccactggcatttagtgggtagaggccaggggtgtggccggacatcctacaatgctcccaacaacatggaattatctggcctaaaatatgaataatgctgaggttgagaagccctgcactaacagagtgaagtaatctgctccaagttctggtaccctaaatgtggagatgttgaagaaatgaacttcaatctccagatgctgcgtgcttctctggaggtggaacagttcatgacacgtccagagggctggtggtgtgcatatgccaccttggtgactcacagcacagcaatgcgggcatgtctgatggtgtggaaaagggaaatgtctgtagcctgcttcctgttccatgatgggatgtggaggataaaaggtgaccagctgctcaccatcaggctgcaagtgtctacagtggaaccagatgtcctctttgaggaccagcactagaagcctcttggaacacttctgttacgggaggcagggaagtggcatactattgcccggtgccacaaaaatgcttccttcagtggcgctttgccagttggaggggtggtggactgtgatgggaacccacgagggaactgaatgcacacagccgccgacagctggccagccccacaggcagcttgatgccaaagacaccaggcccctcagaatgcctgggcatcaggaaaagaaagcccagttggcagggtctgcctagaaactaggcctgcaggggagaggacttcattagaagggacattgccaagcctcataccaggaaagccaggtcatctttctctaccatccactccccaggtgactgggcacctcattttgccttatttttagcatgaccacacttcccagtttacacctgcggtcttggcatcatcattaactcccctttcactctcaaaaatgtcttcctttggagaataaattatacgatcactctgttaattgtacttcagtttcctctgacacggaagtatttttgggggccattatatttataaaagatttttgtacagcatgggctaaatcttaaaatatatcattaatggaatccgaaagaatggtcatcaattcatatagaggagaaaaacagcatgtttcctgaatagttagttttttatagggaaaaagggagactaattcaaatcccttgaaaaagaagaatctttagttataaatttcaaagtccctacccaatctcggcaagttctaatgggaaatgaaatagctgggcagtagggaagggaagaagcaagggactatggtaatccacaaactagaaaatgagctggagtcactgggctgtgtcgcagagataatcctctgtgtagaggtctgcttttttaaaactcagccctgcagattttgccggtgctctgggagttaacaaatcaacgccattcaagatttatccttccagagccactcctggtgggagacctgcggggaggggtttttgtttttatttttgtttttgttttgccaaagatgaaagcaccactgtccctggcatctgagagttttgttaagacataaaaaaaaaaaaacaaaacacaactttgtttcttttttttttcatcttgcttctcttcaactccatctttctcagactggtttttaaaggcaggggtcttcctccccagccacgtgcattatcttgcgctttgcattgacaccactgctttattgtgatgccagggactggcatgaaatgtggattttgaagatgtctcactggagatgtctgactgcaacagaactcgagtaagtcaataagcaaagcagctgacagataatttcaaggggctttcattttatttcctcttccacagcagagtttgtgattttgaaccagtggtcacaacctttaagatcctcagtttcatcatttgcaaatactagctggttataaataaggtggtgcaactagggaagctaaaattcttaaaaaggttaatggcaacttgagatcaatgctaattccttacataattctgtttagataaaaaaatctgtctcagctgggcgcagtggctcatgcctgtaatcccagcactttgggaggctgaggcaggtggatcacgaggttaggagttcaagaccagcctggccaagatggtgaaacgctgtctctgctaaaaatacaaaaattagccgggcatggtggtgggcacctgtaatcccagctactcaggaggctgaggcagagatcgcatcactgcactccagcctgggtgacagaggggagagtaggtctcaaaaaaaaaaaaaatcaaacaggagggagggcaccttgtcaaccccacctttgacactactctagttgaaaacaaaatcaacccgggtttagggaatgagacttaataggaattctcacctctttcccattttttattcaccatcaagaaagatatagttggctttgaattaaatacagatttctaagagatataccaggccatcatatggaaaaatttaatattgaggtaattgcaaaacaatatctatgctattttgctatgtggatgacagggaaaacacactagaaaaacgtatttttaatgaaatgtagctgaaatgttgctttcggagcatttagtattcttggataccagcttggacaattcaggccaaactgtaccagccccaggttagattatcgactgggagtcagtactttctgtgtcaatgattatacatttacttcttaaatttaggattttagcttttaaattttctttttacataaaatcaaggaaaaaagcctttcatctccactgctctcctatttcacttgccagaacaattggtagtgattaagaagccgtcctacatataatgtggttagttaagcggtctaatgccccagttatccagttagtggcaggcagtgaggtggggatttggttagtagagccaaacagaggagcggtaatctaattagcctgttgccatctgaggccgttggctaagatgggggctaactgggtgtggagcagttttgctgggtgaggtttagtttccaacgctgtaggaatctgctgcttccaaaaagtctcctttagaactatcccctagcagagaatgtccatcagcctgtagattgtctcatcaacacatcaaacatgctctacccaacccctgccgcgcttttttttttttttttttgcatataacaatgtcagagacagccagaactacagaccagatttccaatgaggtaatttgtttatatactttaggaccaacctaatttctttttctgctgagtttcacagctagaagggccagagatctgagtgtggtccctacggtggggtgtgtggcggtacccaaagacctttgcagtttggcaagtggttgtttcctcttggaaaacaggtatagaagggacattttattttaaatgctggaagccaatggccatatgatttagagagcattgaactctgtagggagtgaagaagttacctttttcttttcttttttttctttttttcctgctctgtcgccaggctggtgtgcagtggtgtgatcttggctcactgcaacctccgcctcccaggttcaagcgattctcgtgcctcagcctccttagtagctggaattacaagcatgcgccaccacacctggccaatttttgtatttttagtagagacagggtttcatcatgttggccaggatggtcttgatttcttgacctcgtgatccacccaccttggcctcccaaagtgctgggattacaggcgtgagccaccacacccagctgaccttttcctttttcagcctcatcctgtcccagatcccggccctttctcttctggtatccccttttctgatgtctttcagccacagagtggtggcacgatgatattctggcctcttagccacccagcttttcagatttgggtccctgggtctccagggaaggatgggcgggggatggaggagtgggggagaggtgggtggcagaggaggagtatagaagggtttgtgtttgctccctctgttaaacactttagaatattgcccattgtcctttcctgtgggatgggattggtgcaaaggctcctaaaactggaggcagttggttctctttggttcacctgctcatatgctgccacctagtggttccttctcctttagcactctgtgtgaagggtagggggacgttaaggacactactatattgcctttatctcacttgggtttttttttcctcctaaacctaaaatttccccttttcattccatgcagttatccatcatacacaaaactgttttcttctttttactcttggatcagataatctggaaatgaatagttggtataagatctatgtttttttgagtaagttagagcccactaacatccctgtttgccccctggtttctcttttgtgatgtgagatgggcgtcttactccagtgctgcaacatgttcattacagaggagaggcaggctaccaccaagccagggcttctctgaacagggatttcttttttctttctttttttttttttttgagacggagtctcactctgtcgcccagactggaatgcagtggcgcgaactcggctcaccgcaacctccgcctcccgggttcaagcgattctcctgtctcagcctcccgagtagctgggattacaggtgcatgccaccatgcccggctaatttttgtatttttagtagagatgaggtttcaccatgttggccaggctggtctcaaactcctgacctcgtgatctgcccgtctcggcctcccaaagtgctgggattacaggcgtgagtcactgcacccggccagttgcctgtctttcaaaatttctcctgtagagaaatcaggcaataatagcagctacccttattgaacagttattatgtgccaggcattgttccaagtaccattacacatgttaaatcatttaatcttcctaatcacctaatgatacagtgaatagagtatatcccttctaaggtgaggaaactgaggcataaatggtcaaataacttgctccagagagcacagtagacagggaactgagatttattcccaggctgtctggttgcagatgttatgctgttaatcactatgttttgctgcctcttaatatgcaggtaacctgagtgctaggtacagacaacaggaaagggaaacagggagccctgtatccatacttgagccctcctcagagcatttcctcagcccctacctgggaggtgttgtagtggaggacacatgggttgttaactaacccgaggcctgaagaggaactcttcaatgtgctgactccaaggccttgcttctggttctgtctcattttggagattcagcacataggaaaaaaaccaagtagctgggtgggagtggtggctcatgtctgtaatcccagcactttcggaggctgaggcgggtggatcacttgagctaaggagtttgagagtagccgggccaacatggtgaaaccccgtctctataaaaatacaaaaattggctgggtgcagtggctcagccaccctgtaatcccagcactttgggaggccgtggtgggtggatcacttgaggtcaggagttcaagaccagcctgaccaacatggtgaaaccccgtctctactaaaaatacaaaaattagctgggtgtggtgatgcacgcctgtaatcccagctactcgggcggctgaggcaggagaataacttgaaccggggacggggaggttgcagtgagccaagattgcgccactgcactccagcctgggaaacagagtcgagactccatctcaaaaacaaacaaacaaacaaaaaaccaaaaatcagccaggtgtagtggtgggcgcctgtaatcccagttactcgggagtcttaagcagaattgtttgaactcaggaggtggaggttgcagtgagccaagattatgccactgcactccagcctgggcaacagagcaagactctgtctcagaaaaaaaaaaaaagacaaaaaataaacaatagacgtggattccagagaagattctgctctgaaagacaattccaagtctccttttttctctgggcttttgttttctctcatgctatctccactttattgggaggtggtaaaaatgcccagagctgacatattgatatcatcttacaaaaaggagctcaacatcatcacacatggcaaggaaccacatcccaagtttatttgtgcttttcaaaccagccagaacaaccagtaatgtcctcctcccaaggtttccttctctctcaccttctttgtgaaaagcttgtggaaaaggcagatgtggttgtgtggacacatttagagatggggatgagctatgactaggctggtttagtaacaggtttgatgaacgtgcctcttcccacttgtcttactggtagcttacagtcactctgaggtgtcaagagacttgggtctcttcagcaaagagaggagtccaaggcgttggtggggtggcagaagtagggagtgggaacttttgatgatcagtttcctcataaaggcaggagagagggaagaatatatttcctaaaggaggaaaaatacataaatttgcttttgtgattcaaaatatagatgtattaaagggcacagagtataatgttttcccccttaccctgtctcacagtttctctgtccttggaggcaaccatgttatcatttcatgtctccctccagaaatatcccatacaaatataaacaaataggtatatatagtctccagtccttttttatacaaatggggcaaatttggctcccattctttgctgttttattttttttaaacttaccaacatatttcagaatgtattccacacagtttccctttcttttttactgttgcataatattcacttctatgaatgtactatagttatttgactagttctctgttaaacatttaggtcatttccaagtgtttgctattacaatgaaccgtatgtgcctgtcattttgcatatgtgcaagtatagctgtaggataatttctatttttttttctttttttacccaaaccaaaaatggtcaataggataaattcttttttttagatggagtcttgctctgttgcccaggctggagtacagtggcttgatctcagctcactgcaacctccgcctcgtggattcaagcaattctcctgcctcagcctcctgagtagccgggttacaggcgcccgccaccacgcctggctaatttttgtatttttagtagagatgaggttccaccatgttggtcaggctggtctcgaactcctgacctcgttatctgctccccttggcctcccaaagtgctgggattacaggcgtgagccactgcgcctggccagataaattcttagaaatagatttgttgggccaaagacaatgaagagataaacaaataaatgacagagtgaaaagggtgaatttgttttttatttttatttattttttttgagatggagtctctgtcacccaggctagagtacaatggcgcgatctcggctcactgcaacctccgcctcccaggttcaagtgattctcctgcctcagcttcccaagtagctgggattacaggtgcccgccaccatgcctggctaatttttgtatttttagtagagatggggtttcaccatgttggtgaggccggtcccgaactcctgacctcaagtgatccacctgccttggccttgaaagtgctgggactacaggtgtaagccaccatgcccggctggctggatttgtttagatttgacagaaaaattccaaccctctatacttgtggccatgaaacagtcttcatcaggaaaatcataaagtcaaaccttgagtgacaggcctgagctggtgttgtatggttgtacaagggcattggagaataagatctatccttatgtattttcctaaatgagttcactcagctgctgcagcacactagagtgggctctggtctggactccaaggaatgtttgtatcactgtcacactgatgccattctttacccccagcagtgaagactgctcctatttcaggccagaagatggagctagtgacaacatgctggtcttgggggccctccatcagaatcttaattctaaccaaaacccactctgcaccaaagtggctcccactattactccacccaaaccaggcacccacccccactattttgaaacacaatgtggttcttgctaatacaacacaaacctattctttttctttttttgagacaggatcttgctctttcacccaggctggcgtgcagtggtgcagtcatggctcactgtaatctcaacctcctgggctcaagcattcctcccaccttagcctcccaagtagctgggcctacagacgtgcaccaccacacgtggctaattttttaaaaaaaattttgtagagaccttctgcccaggctggtctcaaactcctgatctcaagtgatcctcctgccttggcctcctgaagtgttgggattacaggtgtgagccactgtgcctggccctgcaaaccatattctctattacttaaaagttaatttgattatgttccatagttccaatatttcatatgttccaatataaggaatcctcatattggattcctaatcttggtcagtcatattgcaatatgtggggattttggggaaatggtgccctgggtttgagagctggggataaacctagatccatccctgtggcaaaaattgctagttttatcccaatatccattcttccctttgtatttaatcatgaatctcccaattctaagctggacacagggctataagctttctttacagcttgctgtgtccatatattccaacttctgaccaatggaatgtgaaaggaagtgtgtgcgcaacatctgtgaagtacccttaaaggaagagggtatgcttttctctctcttttttttttttctcaagacagtcttgctctgttgcccaggctggagtgcaatggcgtgatcttggctcactgcaacctatgcctcccgggttcaagcgattctcctgcctcagcctcctgagtagctaggattataggtgcacaccaccatgcctggctaattttttgtatttttaatagagatgggatttcaccatgttggccaggctggtcttgaactcctgacctcatgatccgcccgcctcggactcccaaagtgctgggattacaggcgtgagcccctgcgcccggcctgaccttctccttttatctttcctgctgtgctgtgtaggttgcagacaggatggctggagattgagcatctgtcttggccttgaggtaaccttgagaatgttgggcacacagagaagaacaaaaagaaaaggtacctgggactggataccttggaccacttacctctagatttttgcagaagagaaaaatacatttctgtgttaatttttttttttttttttgagacggagtctcactctgttgcccaggctggagtccagtggtgtgatctcggctcactgcaacctccgcttcccgggttcaagcgattctccccagtagctgggattacaggcgcccaccaccacacctgactaattttttttttttgtatatttagtagagatgaggtttcactatgttggtaaagctggtctcgaactcctgacctcaggtgatctgcccacctcggcctcctaaagtgctgggattacaggtgtgagccactgtgcctggctttctgtgttaattaagtcatttttagtttagattttatgttgctattagttgaaccttatcctaagtgacactgtccccaaatttaagaaaaaaacaattccagaggcattttctttccatcagtggtgaatcactagcattagtatgagaaatgaagaaaagctacttcactggcaactctcatctttcagagaaacaaagtagtggcccacaagttccactcaactattaggcagttcattggccatggttctgatacctgggtttcatctttcttccacttcaaaggcagtggtgagatactcctttggaacaatcccaacgaggctgttcagttctcccacccaccagccatacatgttatactcctgaaaagtgaaaagaggatagcgtcagttagaatttgttcatgcttctgctcatttattctagtgattgcatgggagattctgtttggtggtttcattgttgccattatcactgtgaactgttaacttccctgatgggattattaaatttaaaaaaatcatctagaggaagagagcaagcactttccttttgccatcttcctgtctacattgtaaaattagcacatttgatgcccttgctgaacctgaagagcatttttttttaaaccaagccgaatggtatggcttcttagagaaagttgggcacacattaaattgccagaacactacagatattcaaggggtcaagtcatagttcaaatcaataatatttatcaagcatcttctatgtgcaaagtgctgtttgagttcccatgaggtatgtaatgatgaatcagaagattgcttgctccttgggagcttacagcagagtaatgggctttggagtcagacagactgagatctaatcctcgcttggtcatttagtagtcacatgaccttaggttctcctagctttagcttctttgtgagagtagggataatatctcccttctatcttgtggggatgtaaattgtatcactgaagtaaaaacaactgaaagtgtttgatacatagtagatgctctaaacattagattctttccctagaacaggtgagaggtgacaggtacattaataatgacaggctagtcacagagaggaacaaacaagaaagaggatgagagggttttaaagagagtttaaggggtagtcacagagtgaggatgcagctccttgaatacagaaaagcttctcaaaagcacagcagatgttgaagagtatggggctatttctttttttttttttgagacggagtctcgcactgtcgcccaggctggagtgcagtggcaagatctcagctcactgcaacctccggctcccacgttcaagcaattctcctgtctcaacctcctgagtagctgggattacaggtgcgtgccatcacacccggctattttttttttttttttttagacagagtctggctctgtctcccaggctggagtgcagtggcgcaatctcggctcactgcaacctccacctcccaggttcaagcgattctcctgcctcagcctcccgattagctgggattacaggcgcgcaccaccacgcccggctaatttttctatttttagtagagatggggtttcaccatgttggccttgatggtcttgaacttctgaccccagatgatccacccgcctcagcctcccaaagtgctgggattacaagcgtgagccactgcgcctggccacaactggctaattttttatattgttggtagagatggggtttcatcatgttggccaggctggtctcaaactcctgacctcaagtgatccaccagcctcggccttgctaagtgctgggattacaggcgtgagccactgtgcccactctgagtatggggctatttctgatagcaccagaaaatgttttctttcttttgaaagaagtaaaattagaatgaaaaaaaaattttttttttttgagacagagtctcactctgttgcccaggctggaatgcagtggcacaatcttgggtcactgcaacctccaccacctgggttcaaatgattttcctgcctcagcctcctgagtagctgggactacaggcttgcgcccagctaatttttgtatttttagtaaagacggtgtttcaccctgttggccagggtggtctcgaattcccgacttcgtgatctgctcacctcggcctctcagagtgctgggattacaggtgtgagccactgtgcctggccaaaataaatttttttttttttgagatggagtctcgctcttttgcccggtctggagtgcagtggtgagatctcagctcactgcaacttctgcctcctgggttcaagcgattcttctgcttcagcctcctgagtagctgggactacaggtgtgcaccaccacgcccagctaattttttgtatttttagtagagacggggtttcaccatgttggccaggctggtcttgagctcctgacctcgtcatccacccgccgcagcctcccaaagtactgggattacaggtatgagccaccgtgcctggccccgaatgaaattttaagtatgggaaatatcacatattccagttcaattggatttggggtaccaaagagctaactgcttctttgtacacttggttgctgagtactattaggaaaaacaaaacaaaagaagtaaaaccagattggtgatatgtaaaattcagagtccctagcattatctggtgatctttttatctctggatgcatataattatcatagaattatgatatctaatatctcccctcctcaaactcatgttgcttctgacaacctcttctccaccttcaaagggaaaagagaagccatcagatttgtcagccaccagccaccaaagcaggaacttacctgtattgacaaccatctttctttcccattaaagtcggggaagcacccctcccctggtttaagactacccctcacaacacgcacttgcaaccctcctccttcctttccgagagatgaggttctgtggagactgaccattgcctgtaaagtaaatggctccttccaccagcactgaaaggtgttcaagtttctctcattttttaaaacaaccattaaatagctgccactgatgtctacttcccatttcttctagtctatgccacacttgttgggaaagtttactcactcactgctccaacttccttcctgttcactgttgaagccgctctcatcaggcttggttgccgtcctctacttaggctctctctccatggtctcctgtaacctctgcattgctcaaattccctgagcacttctcagtccttaacttacttgatctctcagcagtgctggcactattggtcctccttgaggccttttattctcttagtttctatgataattatactctcctggtttctctccttctacttctacttcttctcattctcctttgcaggctcatcttgctcaattctgctttttaatgtggttgttttccagggttctgtcctggccttctcttctgtcttgatgcgctttactagagcaatcccatatatctctgtagagtatccaccatgtctgtgtttatcactcatgaccacagctccaccccaggtctgtactggaccccaatagccaagtgcattccaccaagctgttcaaactcagtatgtcctaaatttaacatgtaatcctgccttcacctccatcctgactccaaagctatctttgcttccttggttctctatctcagtgagttgtactacaatgcactgttacccaggctggaatctcaggagtcattcccaatttcactttcaccttcttcttctttcttcttcttcttcttcttttttttttttttttaagatggagtcttgctctctgttacccaggctgcagtgcagtggtgtgatctcatgatctcggctgaccacgacctatacctcccaggttcaagcaattctcctgcctcagcctcccgagtagctaggactacaggcacgtgccaccatggccagctaatttttgtatttttagtagagacgaggtttcaccatattggccaggctagtctcgaactcctgacctcaggtgagccacccgcctcggcctcccaaagtactgggattacaggtgtgagccacttcgcccagccccatccccctcttctaatcaatccttgagtcctgtcgattctccctctaaaatattactaaaatcctccatcttctttccgttcccagttgccaatgccttagggtcatgtagctatcgtctcacgtgagaactacagaaacagtctccaagttaatctctgtatcagcattcttcttctccactctattcattgtgcagccagactcgctccctacagtacacattgataatgtcactgctctgcttggaaactttcggtgggttcccaatgccccttgttaactggtttttgtttttgtttttgttttttttgagccatagcccctgttgcccagtctggagtgcactgacacgatctcagctcactgcaacctctgcctcctgggttcaaatgattctcctgggttcaatctgagtagctgggattacaggtgcctgccaccacacctcgctgatttttgtatttttagtagagatggggtttcaccatattggccagtctggtcttgaactcctgacctcaggtgatctgcctgcctcggtctcccaaagtactgggaatacaggcatgagccactgtgcctggccaccccttaacttcttaacaaagtagacaaggccctgcatgacccagtcccactcactgttcagcattgttactcacctcctagatttagtgttccttagtaaaatagaacttgtctcagctgctcccatgggccacaggctccctcaccttggaacctttcctctgcctgtttagcctctacttcccttctcatttcatggggcttactcctaagcagccttcagatctcagttcctgagttactcactccctagaagcctctccttgacactctctgactgtgtggggtcccggttacacggtccacagtgctgtgccctgtgctttcctggaaaagagcttgtgattacactgccttctatctgcctgtctttgtctcagtgtcaatcactagttggaaagttctgaggactggaccttgttggttttgtttgcttttgtgttctcagcattcagcactatatccagcacagagtggggccaaataaatacttgttaaatgaggccgggcgcggtggctcacacctgtaatccagcactttgggaggccgaggtgggtggatcacctgaggtcaggagttcgacaccagcctgaccaacatggtgaaaccctgtctctattaaaaatacaaaaattagctgggcgtggttgaggatgcctgtaatcccagctactcgggaagctgaggcaggagaattgcttgaacccgggaggcggaggttgcggtgagccaagatcatgccattgcactccagcctgggcaacaagagcgaaactccatctcaaataaaaacaaaacaaaacaaaacaaacaaaaaaacttgttaaatgagattatgatgaaatgaagggggcagtgggaatttgtattcttagttgagcagatttagttacaactaactccaagatattcccctggtgattgaactagttgtggcagaaagagatcaactacctttggagacagtctcctcaaatggctccttatacaacaataagagtctgaaatgccacaagaagtgagactactgagttgatccttttaggaccagggaagtgccttgtgaaaatcagccttaaataactaaatgtgtctgtctgccacctcttcctacaccacaccttcttttcttgttttgttttttgagacagggtttcgctctgttgcccaggatggagtgcagtggtgcaagtatagctcactgcaaccactcctgggcttaagtgatcctcccgcttcagcctcctaagtaactaggactacaggtgcatttcaccatgcctggctagttaaaaaaaaaacttttttttttttttttgtagagatggggtctccctatgttgcccaggctggtcctgaactcctgggttcaagcaatcctcctgcttgttgggattattggagtgagccactgtgcctgacccaccacacctcatttcctccctctcccaggccagcttctccctacagttcgcaacgtcttatgggaaattacctataattctttagcttttttttttttttttttttgggagacaggatttcactcccttcacctaggctgaagtgcagtggcatgatctcggctcactgcaacctctgcctcctgggctcgagattctcctgcctcagcctccagagtagctgggaccacaggtgcatgccactgcctaattattttttatttgctaattattttgtattttttttttgtagagataagagttttgcaatgttgcctaggctagccttgaactcctgagctcaagtgatcccccagcttcaggctcccaaagtgctgggattataccctgcccagcctgtcagggcatttttaagctcctcttggtacaagatatgttactgtccattttccgacactgaaattagggcagtttctgacttaagttttcttgtagtgttgccttgctgtgaaggggaaatacatactctgtctacctctcacattgtaactcgtaaaaactagctttagctcttctgctatctcacaggcagagagtgggcagtgttgtctgagagtcttttgatccaagtcaacttgctgaaatgtgtgaaatgtggtcttccacctgccagatgctgtcatctgcatcacctgcaggggacagtaaggcatttgctccccgggggttgttcaacgctcctaactttgactaacactttgtagcacccctctttagtcgtaatgccaggagtagggatgaagccttgggaaggtgctctctgccaactcgaagagggtgcgaacaggaagcagatgagtctcagcagggtacctgcaaaagccaggctcccagtctgtctgctcttgctccaggggaacactgaccctgccgactgcagatgtagaagcctcgccacagtgatgagaactgaaatgagtgaaatcaactctctgcccttcaaaacaaaagagcaggcagaagtgtaaggaggatggcacagtcccagagaccatatgcatcctgctgtgggagcctgggagcttaatcaaagcacctacaggtcccgggatctgactgtcttttccagatttcatcccttggctgtatacccgaaaagggctgcagggctgagatgtttaaagcatgaatggaaaatttctaaccttctctcccactaccacccccatgcgttgctccagcccagtctgaacaccacgaggtattttaaaataatttctactttgatgaattgctggggagtccacaattgctcataatcaaagggagaaaaatgcaaatgagatccggccgagaactatcaccaccaaacgtttatttcactgcacagtgccaaaaagaattaaaacaacattaaactcacagcaatcatgtttaagccctcgtttccaagtgccaaattgcaccactctggatcatacagatgttcgttaattatgctaatttttattaaactattaaaatggagagagtactggctcagtcaggcagaccccagctctgaatgaaccctgctcctgtctaaaggtgctaatttactgcatttttattaagttgctgattcttgagttttagttttaggatggcaaagagaactgaatttctgggatcaatgttttctataaagtctgatttctctttgcccagatgtttggaaagattggaaaaatgctgagaggctcccaggagacctgaaatcctcaatttggaagtgtttctgtcttcaaggtagggatgcacatctacaagtgactgtgttagggcttcagaattatacatgctcactattccataactctacatatattctcaatggtagggctaagatttaaattatacaaaattgttcaatgaagatgttttagataagaatataaaaagttattaaaaaaaaacccacaaacctttccatcagggcttgcttcttgccacaaagtctttttagaaactttcatctaaaataagcacagtgtatggtttgttctcctcataaatatttctaggtttgactaaacatctgcttctctcaataccaaccttgccccacctccttgaacaacccacatgaagaagtcttaaaaataaaagttggctatttgcactccattatatggctgtagaaactattggtctggatgaatgaagcattgagtgaacctgaaatagacgcagcgctcaccatcagcaacaatcaaagtgtttatggcagatttcacactgccataaaaggatttatgctaatctccatcaacaaggaaaaaaaaaaaccctaccaaacctgccataaaaagaacagcaaattctataaacaaaaagcagtatggccaccaacaatgggcatgttgcacagcttgactctgcctccagtggtttcctattgctgtttatggtttcaggactatcatggacctcctcagagctcctcctgtcacagggccctgagtccctgtgtggtgctgcaaataccctgtcagtaggtgtcaggggatattgggggaaaaccagcaggcgcctatcataaggcttaaaagagattaaatacccctactccatgattgctacattttaatttctctcctccctgctggttcctatttgtataagctcttccatggctcccctggagtagcacagacatgacctggaatgaccatcctgtcttgggatgagaattcaatttctaggctcagtgaatcctaggctgttccaacaaaaggaactcaccatcctccagggcacagattcttaaaccagagtctgtgaacccctggcctctctgtggatggatgtgaaggaatctttgaactccctgaaactggtgtaaaattttgtgtgcatgtgtacgtaggcctcgtctctggggtgaggcccagaactttcatcagattctcaaagggtttatgaaccctttgcagtttaccagccggcactctatgggaaaaaaatacaatggtctttatgggctggatctgtactttggcccagggtgggtatcctcgcgctccccacacacaggcccctgcttttaaaaaatacaatgaaggagaggccggagacggtggctcacgcctgtaatcccagcactttgggaggctaaggcgggtggatcacaaggtcaggagttcgagaccagcctggccaatatggtgaaactcaatctctactaaaaatacaaaaaaattagctgggcatggtggcgcacacctgtaatcccggctactcgggaggctaaggcaggataatcgcttgaacctaggaggcagaggttgcagtgagccgagattgcaccactgcactccagcctgggcaacagagcgagactccatttaaaaaaaaaaaaaacaatgaaggggaatcaagaatcctaactgcttccatgctggatttcatgggcttcagccctccagctgaagaggctgttcctcctcaaaggtcgactgctcttgtgtacctcttttaaggaatcatctcttttttttttgagatggagttttgctctttgtcacccaggctggagtgcaatggcacgatctcggctcactgcaacctctgcctcccgggttcaagcgattctcctgcctcagcttcctgagtagttgagattacaggcacccgccaccacgcccagctaatttttgtattttagtagagacggggtttcaccatgttggccaggctggtctcgaactcctgacctcaagagatcctgcccacctccacctcccaaagtgctgggattacaggcgtgagccactgcgcctggccaaggcatcatctgtttaactgtgacttcagagttgtggtgtcttctcacagtttccattcaaatggcttggagcaagctgcttgacactgtcagttccctggataaagctcctaacagaaacattctcttttcacattgaattgggttccaagtctccgtggaacaagattcccagaaaatatctcatacttttttgttctttttaccataaaagttccctatatcagtgcttataaacaagaggatgcatcttcaagagaacagtctatcagcccctaacccgaaagattagtaaatgcttgatatatgtatggaaaggtcaatcaatcacagaaatattggtttatgattgcttatttctcttattagtgtttgtgcatcatacattgctattagttaagatgggaaatttgaattcctaagcagagtaacttgtactattccagggtcagtcccagacatcgtatttttactctggatttccccacaaattctctactcctaaaatccagctttggatatataatgctttcttagaatatcataccctatgaaataaattaagggctccaaatcagcatccttctaactgccgagaaaaacaaggctgggaacaagaattgttcaccaaagacaaagtgcccatttttcagcacagatagttttatgaagagattttccagaaggagaaaggaaatggtcagttgggtggccggtgggttagtgatgttggaacttgtgaaaggatcgaagctcagcacttggctgaaaccttgggtagcgtggcagcctctccaggctgttttacaatctgttttaagttcttggcaatcactttctctttttccattattcagagttttggtctataaatcataataaaaatgaatcattaaatttgcctcaattgagctagttttatttactgttacatttcagggaacttgctaatctggagattgatgggcctggatacaggggaaagtatgcaagtgtgagaagggggacatgggaaggctgggtagtcagcaacagcagttgggaggggggtgggtcatggtgacaactccacaaagcgcaccctgagctaagtgttctgagaagaggaatgtgttctctagatggagggtctcagagcacttgagtgcgagagaacattcagccttaaaggtgaagcttatgtcctgaacagggtgggagtggataatgatcaagctgaggccacggaggtgtggagggcctgtgcacacactgcatgttgtgggtgaaatgtgtgcaaaacacagagtgggtgtgtgcaagtgtatgtgacagaacaatcaagctgtgaaggtaagagcaaaggtgaaatagggctgtaaagaaagagaaatgaaaagaagcacacaactttacctaaagaagaaagaagggatagagggaaggtaaacactttgcagatgggagaaaacaaggtgccaagtgcagaagtcaggaacaataaagacagcaccatttcggagctgatagaattgtgataccatgtgagacgggcgtattaatatgtattccataaactgcgcagctctgcaccgctctgttttgctctgaccgcagtaccagcctcaggcaccacaacacaatttggaaacaatgtgacggaaatgtttaatctgctcggcccatctgtgctgcgtatttctccagatctccctgagagaggcgccttgaatctccacattgcctttaatattctcctaaatcacctccctactgcacttcaagggccattgctacaatatcacaggttcatctaaagtgcaatggggagggggtgttgggggaggcgcaggccgggagattttttattttaaaataatttccagagatcgtcttttctgcttcctttaaaaaaaaagaagaaaagttattctactgttgccttaaggttattgaggttgtttggtgcaaaacagggtaggatagagtggaatcattctccaaagaattatttttattaatctcgattctctcaaatggacatgggagggtgagcagatgctcgttctctcttatctcttttccttgcaccttgctagaaagcacacatagggtatgctagggtgatgtgttcatttggggttggagcctctctcctttccactcttggcatcaggtaccagcttgttagttcccagggccaaccctgtctctgctccactctaaacaaagccatctcattcaggacaagtatacatttagtctctggtcaacatgccctcattaggagaggactctgtctatatttttaattttagcttaaaaccttagattttctctccttaagtagagatgttgggtgtcagatttccactgcctttccccacttgattgcgccagattcagcaatttgggtctagctggggtgggttttggagaaagagggatgacaagtcaccatgttccagaccctagacaaatggaagagagttgcacatcaccaagaaaattaggattccttttgctttgtgaattaaagaaatgaataatttaatcctcaagattgttccggcgagggaaaagcaacgtcccagttgcggagccctacagcctgtcggtgtgttacatcatctgcacacataggcgtttccatgacaaccgcttatagcttcatttcctggatccctctagggggtgtcacagccagatccacctgcttttcaccctaccctcggtggggtcatggtaaggtcgccagaataaatgaacgcgggtactaatgatctgtttactgctgtttatgctctgtgtgtgtcaggggcacgcacatttagagagctcattatggttgcaattagaatgcaccatcgctagatatttaactcctttttcttttaaattagcattttaataacattctttgagcagagaaacaaaatgaccatttttcacggacaaacttctagctgtaggtgcaactttaatggcaaagttgtgaaggggaaagaaggggaaaaaaggccatttttactactttcaccctcctccttaccaaaaggatatttttatttgctttctaacacactcaatttcctaaatttgttttgaatccaattattttgggtggtttaaagtactgcactcttgttggacggaaattagcagcgattgaaattaactttttatgtgacctgtgaaaggggctaaaataattacaagtgtgtagaagaaactctccaaaagacccttgctgtaggatcaggctgtgatccgatgatgccattatccaaatatctttatacagcaaatacaagggcttttttctttaaaaaggtgattgcaattattgtttctgttttgtaattctgaggattatcttgtagaggataagtgatgacaaaaacttgtcattatagacaggataaataagcagaaagaatgaaaataataacacagcattgtttaccatttaaaaatggtgagcatcaaaaagcaggagaggaggaacaggaaaggtgtagagacccccttggttacaatgtttcaaaaggcattgctttgtagggatcagccaacaccctttctaggtgtttatagatgctctgtttgtgtaaagtacagtgaaaaataacaatttgaatgtttcgattatctttcccagtccgttccattttcattatttatttcctataaatcgggaccttgctgaacataattctgcagacaaggaggtggatgggacagccaatgtgaacaaggagatagatggtgggtgcgtataagatagatgctatgcgcttatgaaaaagagcagtatgtctgcatgtgaacatccacaaagtagagcgagcaagcgtgtacacgacaacgggtatttataggtggaaaaaggtgcaaggaagattatgtgggaacaggcacagagagtctgaaacggtttgctcttttccctaccctcctggaatccacgtccaagttctgcctaagatgtcccacacttgctgtggctcctgtgaacctcgcaagcctttccatgacaacagacggggatttcacagccagaagacttaggaggtcaacagttgaaaagcaagatttagagagatctttaaacaatcacactaacctccctccccttccaaagacagaaggaggaaaacatttaaagacgcagcaggaaaaaaaaaaaaaaaaagagcctttctaaaaatgcaagtttaaaatgttcatgcttttgtatcagcctagttgcaccttagaatctgccatttcataaataaaataccgatggcatagagtataatttggtgacagctaccccaggacatatctagatgcacttctgttattttaattaaatactgcattatggtttgtgacaactacatagctatagcgtaaatgaattcagaattaaagtgttacttaggcatccagtaatttttgtttcattccttagttttacaaagcaaatagctataaaatcaagatgtttgttcatttacagatggagcaggattgtcgtcgctgtttttttcctccttaatcctcatccacaaaaagaagacacagttcagagtctggctcccaacactcttagcttatgagccacatcacaaagaaaaacacatcctcttgactataatgtgaaatgctgaatattaattgctggtattatgcctatctttctagctgggttctgtcttttaacaattattcggatgggctacagccttgcactgccaggagattcttctcctttgtttaatagttagaaaccaattttattaaaaaacggtaaagttcacaatgctccatgtaagttcttagtatttggaactctccccaaatacagaatattatcaggaacagagaaactgcagactctctttgctaaatatgatgaacatttctgcatttaaaagaaaaaaatatttttcattttagcaatattaatgtttccttaatgaaactggagagggtgttacaatttgatatacttggttagtttcattgtcacttcactagcaaatcatgagaaaggttcagaatattctcatctatcaggtacagattttcactcaaaattaatatgtagagtaaaaggatttttgttcaaatctgaggatttaactgtatctttaacgtttcatatgtcaagatgaaagtttttaaataactagttttctgaaaccatttctattatttctaatttgagaatcaatatgatctttttattagccttaaataccatacatctgggaatgtctgcaaatttaagcttttctgtgttctaatcaattaccttcagtcttgcataactaatcctataatctccatagaagttactgccctgtatgttagcaatgaggttatactttgtttcaatattttgctagtttggttggagagctgaatcacgcaataccaagaaatggtggcagaagaggtttggggaggctgagtttcttttgagaaaataattatactgaaacaaagcttttgtgactccttttaaatagggcatctcaccaaaatgtcatccagcctctttggcagattagtggggagtttattactaaatctctgtctaataaatgtgcagttgactctggaggagctgcttgttataatactggcggtgggaaatggagggaatgtcacagttaaagacacaaattttccccataatatattcaaatggaaacctctgaatccaatactacatgggcatatctaataaattcacaatatttcagtttccgcagccttcaccggttagttttaaagatttatgtggtaaaaaattactcagtgatgaatatggtttattctgtgcagtattggaggtataaggaattaaactaccatctttaacagtgaatttattattacctctgtcaaaagacgaagacgttaacagcatttgttataaattcactgcaaaataaatggctggaattttttacactggagtttgtaaagcatcgggcaattctgagcattaacctaacccggccgtggcttatatggttctaggtaaacgtttctgtctgggcttcgtagttaattatctggtctggaattttccccaactgaaaactgtgtgcacatggacacacacacacacacacacacacatacatacacagagagagagaaaagtgaaaggtcttgtccaggacaactgtttaggaataaatagattagactatttatagatagatagaataaaataaaatgccaattttattctctttttaaaaaatgggttttagaataaatggtcagggtttgcaggatgggttgatgagcaactgggcctcttgttagcaggtttacatgcatgcatatgcacacacacataaacaccctctcccttttgtcctctcttggaatgggtgtcccctcatttataaaaattacctggaaggaatgaggctgccagggtttgttctagacgattggttcctgtctgggggaaaggaatggcctctactgaatttgaccggtatatgaccgttgccttccagctgaccccaaatcccattcccatcctcctaactccgttgcctcccataggggttattaatgagagaaaacaccatcatcatcatcttcgtcatcacagcacagtgttgacctgcttgttaacatgaaatggggtggtggggacagcttctgcttctcttgcataccatcataaataagaaaagatactttgccataggatcccctcacccacccctttgattaggtcagaggtgcataatagctctttgacaggcattgatcagtttcatcacactgtttgggcagcctgtgccccaggcctatattctccccacttactacccctaaattacctcccagataaccccccacccatcccccactcagccaaccagagggtatggtgcctgaggaagtcctaaatggacactagatgtcaccaaacacctcctttccctcagagccctgaaattaaaaaaaaaaaaaaaaagaaaaaaaaatccttcatttaaggcaattgaaggaattaacttatctgtttttatgagggttgttgtcacattcaactaagcacacttaaaagaggaagtattgctgcattaagataatttttacaacatacaaatctcttttggaaagaacggggtcaagggaggggaaaggtctccattcttttaagtagcccattgaggaagtaggtggagaaaaccgggttaaaactcccattataattgacatagtgttgtgttaacatagtccaggtgtgctggcgcaggcctgccgcattcagatgactagactggctgtggagccaggatctcatctgagtttaagtagctgcagtccagggtgacaaagtccattcttctccacataagacccatgaccatctgacagcatcacgtgttccacgctaaacttgactttgtctgtatggctccctgtttccacatcaattccatcagcaaggaagatgacccagaccctggtgtgtctgggccatgagaataccttcccaccccagctaagccaccgtgtaagtataaatcttatgcgtacccaacttgttgctccaaggctgctttccatggaaataaggcactggacaattccttggaagagcctcagaccaatttatgaggcacacaacccaagcccaagagatgtacactggctcagtttaccttaaatggaagatctcacccagtggcctcttctccttcctagtcaattgaaaaagagcttctctttccctctttaatttgtccttatcttctgaacagctcatgttaccaccataaataacttatggaacaggatgcttttaaaaaaaatgggcgtttaagtcttatcttggctgggcgtggtggctcacacctgtaatcccagcactttgggaggccaaggcaggcagatcactcgaggccaggagttcaagaccagcctggccaacatggtgaaaccccatctctactaaaaatacaaaaaattagccaggtgtggtggcttgagcctgtaatcccagctactagggaggttgaggcaggagaaccgctcgaactcaggaggcagaggttgcagtgagccaagattgtgccactgtactccagtctcgcagtctgggtgacagagcaagactctgtctcaaaaaaaaaaaaaagttatcttgaatagtggaacaagcatgatgatgatgatgatgatgatgatttttattttttcttgagatggagtctcgctctgtcatccagactggagtgcaatggcatgatcttggctcactgcaaccactgcctcccgggttcaagcgagtctcctgcctcagcttccctagtagctgggactacaggcacgcgccaccatgcctggctaatttttgtatttttagtagagatggggttttgccatgttggccaggctggtctcgaactcctgacctcaggcaatccacctgcctcggcctcccaaagtgctgggtgagccaccacgccctgccaacaagcattattattatttggaaagaatgttccctagtgagagacactggagccaagaagacagggtcacttttctgaaagctaggacttgtgacttgtcttatccaaatagaggcttcttacctctttttctcccacttataacaagtgaccataggccaagcacagtggctcacacctgtaattccagcactttggaaggccgaggcagatggatcacctgaggccaggagttcgagaccagcctggccaatatggcaaaatcccgtctctactaaaaatacaaaaattagctgggtgccgtggcacttgcctgtagtcccagttactcaggaggctgaggcaggagaatcgcttgaacccgggaggcagaggttgcagtgagccgagaccgcgccgctgcattccagggcaacagagagagactccgtctcaagaaaaacagaaacaaaaacaagtgaccacagtggtgctggtccacaaaagggtcttgcaatctgcagataaaaggaactaagccagggcaccacactatcacacggagggtgattcggcacctgccctgtcatgcctggtgcccaggccgaatggatttttggagtacacctgttgttgaacccctgccaagtactgatggccactaacccccaaatcacttttccccactgttgatgtttggaatgtcagacaggactgagcagcagccggcgtgtatttcaaacacagcagatggatttttatattagctcctatttcatgttcaggcagagcgaccgccacgctaaaaccacagcctcaatgctgccgagtttgcttctgtgagattaattctgtgaaattaattgggacaagattgaaaaggaaattaaaatgcagctgagtgaacaggcctttcaaacaccttttccctgctctattcaaacttgaattctgcggtggtcgccggcatcgtgggaagtaatttacgagtcgcaggctctcaggagccattggttacgtatgaggagacctgcaccagcgccacaatctggagccactgaagagcgctaaacaccctgctgtggcttgagctgcatcctggctccggggaggaagggaagtttagtccctcaccagaaaaagctgttcagaaatatctgagtccaaaaggaacacaggaacatccgctggatgcacagatctgcttcgttattaaaatctccctttaatatattttgagacccaaattggaactcagtgaattaagtgggcatgacactgcatggggccaaggaatgcatggatgtgatgcagggaggtcagtgggagtcctcctgctgactgtgccactggttactgtttcagagtttggatgtgtggctctggtctctccacaaaatgaagtttgaataatctgtcagggacgaaagctctcagaccaggaaaggcatggtggattttcatgtaggcctcttcactgggtatttttttttgtatccaagtgagcgacttttgtgctgtagatcatctctttttcaataatttattgaactcctagtatgtgcccaacactgatccaaaagtttattattagtaaaagggaaggaaatattcctacttcctacatgccaggcacttccttacacaaattctctaatgtaaacatcacaacaaatgtataaatataaaatttcccaatttttacaggtgaggaaactgaagattatcaggattaggagatttttgcccagggtcataaataacccgtctgttacaggcacttacttgcttccctgagaacaggacaggtgatgggcacttggttatctctggggagcatctttttttttttttttgagacggagtctcgctctgttgcccaagctggagcgcagtggcgtaatctcggctcactgcaacctctgccttccagggtcaagagattctcctgcctcagcctcctgagtagctgggattacaggtacctgccaccacacccagctaatttttgtattttagtagagacggggtttcaccatgttggccaggctggtcttgaactcctgacctcaggtgatctgcccgcctcggcctcccaaagtgctggggttacaggtgtaagccaccgtgcccggcctctttttttttttgagacagggtctcactctgttgcccaggctggagtgcagtggcactatctcagctcactgcaacctccgtctcccggttcaagcaattctcctgcctcagcctcccaagtagctgggactacaggcatgcaccagcatgcccagctagcttttgtatttttagtggagactgggtttcaccatgttggccaggctggtctcgaactcctgacctcgggtgatctgccagcctcggcctcccaaagtgttgggattacaggcatgagccaccacacctagccactggggagcatctttcttgcccagtcaatcatcttctctggataatttttttttttgaaaagggatagccggacatggtggctcacacctgtaatcccaacactttaggaggccgaggtgggtggatcacctgaggtcaggagttcgagaacagcctgaccaacatggcaaaaccttgactctaataaaaatacaaaattagctgggcatgggggtgcaagcctgtaatctcagctacttgggaggctgaggcaggagaattgcttgaacccgggaggtggaggttgcagtgagccaagatcatgctatcgcactccagcctgggcaacgagagcaaaactctgtctcaaaaaaaaaaaaaaaaaaaaatgcgataaatagctctctttctgtgatcattcttgcccaaaggcaagactaaaagattctcctctgggccggttgcgctggctcacgcctgtaatcctaacactttgggaggccgaggcgggcggatcacgaggtcaggagatccagaccattctggctaacacagtgaaaccccgtctctattaaaaatacaaaaagaaaaaaaaaaaaagaaaagaaattagccaggcatggtggcgggtgcctgtagtcccagctactcgggaggctgaggcaggagaatggcgtgaacccaggaggcggagcttgcagtgagccgagattgtgccactgcactccagcctgggccacagagcgagactctgtctcaaaaaaaaaaaaaaaaagaaaaaagaaaaaaaaagattctcctgagtttggtcctaggcttctaagattcaaagttggatcatgcttgggtgactattaagaaacagcagaggccgggcgcagtggctcacgcctgtaatcccagcattttgggaggccgaggcgggcggatcacgaggtcaggagattgagaccatcctggctaacacggtgaaaccgcgtctctactaaaaatacaaaaaattagctgggcgaggtggcgggcgcctgtagtcccagctactcgggaggctgaggcaaaagaatggcgtgaaccccagggggcggagcctgcagtgagccgagatcgcgccactgcactccagcctggcaacagagcgagacgccttctcaaaaagaaaaaaaaaaaaaaaagaaacagcagggagcagcaggagcctacgactaaagctgccatcctcatttcccctgccacctccatctcacctccccttctagatcctctaacctctgcactccggactctgcctttcagaatacttttatcagatagagagagagggggaaaccagatgtatttatgagaactgaaaacaaaagagctggtaatttaaaaaaattcttttttgtttaaactgaataagtaattaaggctaaaacacatttttgtgtggaacttctttagcagttttgcagtgtcaggcccaccatatttagaatgggaatgtctgaggtagaaggattcttagatgctatccaactccacgctctcttttaacaggtgaagaaacaagtccacttaagctgagctgcacacagctgcatctgtgtctctcagggaaacagatttccctagattcctaaacagcaggcccttcttgtccaacagagcttctactggacaaaaagaaaagtaaaatagagctttctagacaccactttccgggactaaattcaacttgggtcagttctgtccttacaggcgtgagaggcagctgcagagtgtaacggaccccagcaaaagaaggcagctgaggctaaagtgggaataaattaggatctatttgagagaaaattccagagatgaggcactactgaacttctgaatagacagatggctgggaatggtagtggaatctcgttttctatctgtttgaatttgttcatttgtgcttcttagaagcaaggcgatgaatagattgggtggccttttaaggttccctcctgtccaaggactattattgaattaggtaatataatacaggtgaatcaaaactgaaatgctccccaaaccaatgttaactggaatgcagcttcatgagggaaagttcagctgagctcttaacttctcatttcctctttgatatgcagggatttgcaacatggggaagggagccagctggtgtagctttttgggaaagaaatatgctactattaatacaatggtacaggatgaaaatggactcagaaccttccagaagagaggagaaagaaactgatagaaacagggcagtgaggtattctcattgaattaaaccctgatatatttgctttcttttcttctttttttctttttggagacagagtctcactctgtcacccaggcaagagtgcagtggcaatcatggcaaaaatcatggcagccttgaactcctgggctcaagtgattctcccagctcagcttccagagtagctgagactacaagcatgtaccaccacacccagctatttttttttaaattttttattttgtagagatgggatcctgctatgttgcccaggctggtcttgaactcttgggctcaagcatcctcctgcctcagcctcctaaaatactgggatcacaggcgtaagccaccatgcctggcctatgttagcttttagtaacagagaaggggaagaggtttttttttttttctttttaaagattggattggttccccatgttctttgagatttcttaaaaatacaatagccactgtaaccacagacagctccatactgcaggacaggtcaccgcacaaccccttctaactagaggaaagggacccccagtgagaagccattaacaaaggcaaaagacatgcaaaacaaacaaaataatcatgacagagagaaggccagcagccagtctggctctgttcttcccccctcctgctgcaggcacctccagacaatgtaaacagttaatttgttcacctgcaggctctgggcaaacagaggcctggtcacacctgagtggataactcgattacccctgtaatgccagtgtggtaatgtacacaaattctattacacggcaaaccttgctttcgggcatttgaaataccaatcaggccaatgtccactcccttttttgcttccaatttattcttggtgtgtattggagccacacagaaatggcactagggtggtactgagttaaggatccaggataaatcactagaagattgtgatctcactcaacaaggcctgcaggcctcctactctcttgcaaacaaagggttggatttgaattgggtccatatttaaaggggcctgattctgttggaaccatagaaaggtgctgtgggttagacctagactgtttcctaaggtgcttatggtatatctcaaaccaagacaaacctttgcccaaggtagtaaaattcacagaataaagataaaagatactgacacataaaaaaaagaagaaagataaacgataaatgacagattaataaccaacgggttttcagttttcccttatggaatccacatactcagcaattaaagagcaagttgtgcctatttcaaaaatgtgtttgtagagattgattggctgcatagagagaggactttttaataagtgctagggacagagcctattattttagcccacctatagaatatgtatggtctttctttaccaacatgatgctactgatcccccaaactgtagcccatgagttctgaatcttcttcacatcagtgattgatctgtaataatccatcctttttttaaaaaaccagtttgtttacggtcaacactactatttgtaagatggttagctggaactaggggttaacttatgactgaggaagagaataaagttagctggcctgtgtgggattgaattcactctcttggccttatcagcaattgctcaaaccaattgagttaacgagctctgactcctcccccatacataattatgttacagtcttgtttatctataaatgaaataagaaggcagcttacctagccagaatgttttcaatagtattacatggtaataaattatgtacatagtgatgacctttaagcacaagtccctgagaaagattaaattttgattggcatggttttggtataataccaattttattgcattttttattttattatttttattatttatttatttatttatttttgagatggagtcttgctccatcgccaggctggagtgcagtggcgtgatcttagctcactgcaagctccgcctcccgggttcaagcaattctcatgcctcagcctcccaagtagctgggactacaggcatgtgctaccacacctggttaattttctgtagtttagtagagactgggtttcagcatgttgcccaggctggtcttgaactcctgagctgaggcagttcaccagcctcggcctcccaaagtgctaggattgcaggcgtgagccaccacgcccggcctagccttgtatttttaaatgtgaaaatggttcctgaatctggattttcatttaaaacttttcctaacaattatgaataaatgggaatttatattgtgagggagccatgggaagtgtatgacatggaataattctgtttatggtgactaaatcaagaatgaaaaaattgactttctatttaagccccacactttctgtccttaccttgctcagaatacggatgaggtcaccccgttggaaggacagttcatctggctggtcaccatggcaatcccataggccctggtagtaactggcatagtctactgatcaaagagaggagaaatcaaagttaaaaggactctattttttccgaggtacccatgtttttgctgcaaatggaaaccagggttctgatattgcccctaggaaacctcagattaaggggagttgagatgagatacagccaaacactcagcatgagcaaaggactatgggagaaggagatcattaactaacattaaatatttacagatcactcctagtaggatgccgttcaacaatatgataaatatatttatttattaataaaagaaaatcaggcaggtaatttttcacttggtttgtaagtaagcagtgcagaggtttcccgccagactttcctgatccagggcaactaactatctagtttttctcttcattatgcatttgaaggatcagagtaaatctgtgacttctgcctatttacaagaaaggcttagtcagccagcaggcttctggatcacagctcacttttcggccttctttgtccataggaactttgtcctgggaacttcccacctaggtactatatgaggtaatcaccaataaatactgaaacgaatagcccagtctttaagtggaaccaagggggtgtctcatccattacaactaaattctgggtgggctggcccttttccagcatctcatttgtagaccttgaacatgtctgccaagatttatctgcaagccccaggggaacagaaaccaaagtgatctgcattaaaaatgaaagcaactgaagacgacaaaccaagctttagaagcagctggagagatttactgagcttctcagcagaactagatggcaatgatgccacaggacagccatcgattcttaacaatgaagaatttgtattgatcttctacccggaaaggttaaacactagagtacaaagtgggagaggatctggggatttgaatggcaggagagctaatgcccactagaccaggcatgctcctttttccttggggtgctctgtatcagagctgtgaacaaagcacctacaaaagatgaaattcaatagatgggagtcaggagtcctgggttctaattaaaattcacatgattttgggggactctgttctatagatttccacctttccctttattcattttaccctcccatgagcagtgatagtattggtggctgaggatagggcaagtgggcagtaggggcacagacaccctccctatatttgctttttttctacttattcctgacttacgagcaatttaaataataaaggcacggagggacaaaatccctatatgtctctggaagagaattttggtaggaatcttaaagggtacaaaaacagaggagggagagaactatttagttaaaactcagatattgcaaacaaaagtaaaaatgtcaaccatatagaaattcaggcatgttttcttcacacataaaattgtctgtgtgtgcagtagacaacagagggcagcaaacaagataactactgtgaaaacattctgccacagagttgataatatgtttggaagaaaaatactttgggagaaatatgttagttattgaatagacaaagcattcatttttggaaatattaagtacatgaaataatagagaaatatcaatccctgaaaagtgaaagtagttttcccagaggatatattatgaattttccattttaatggagttgattaattaccccaagattttgactaaactcaggaatgaaagaatattaacatcaatatttttcatggatttatatatggtagagaaaaccatttttgtaaaaatagattctaaaaccataacaatatttctaagtggtaaggagactaacaaggttatcttggtcttttctggcctagcagatagtcactttggagtacggttccctactgtgtgcctggatatgggataggtcctaatattgagtgcctttttggtgtatacataaaaagtgatttgacattgggtatatatgggcctgggagaacatctggaaaaagatctattctaaaagcacaaaagatcacagggaaagcaagaagctaggagaaaaacagaagccttccaggaaaaaaataaagatagaaaaggtctttgatattaaaggccaaaagaagacagagttcaggaatccaggagatggtttagctcagcccaagaatagggaacttcagtcagaagtagaacagctccaaaaaaacaggcagaatgaagggctaaaaactgggaaaagtttgaacttgctagctagctagaagtattctctattaaggaaatcagtgagggataattccttagctgggcaaggtgactccatattgcagacttcctgtttaacacacatgtgatatgcatttatgtgtatgtgtgcatgcaacttcactaattcattctcatcatccaacagacatgtatacagtacctactaaatgccagggactgtgttagatactgggaatcccacattggccacacatgagccctcctctcaagggtaccttctagtcggggaagcaccatggaaaaaacagttacacaaatgtttatttatgattatgatatgtctgtgaaggagaagttgaggacgctgtgtgtaatagggaatctaacatagtttgaggggtcagaaaaggcttttctggccaagtgggtgttaaagaccttgaagaggggaagagataagttggaggagggcttcattcctgaagcttggcaccaggaagagcttaaaagcccagagtctgcagggctagtccagcttctccctaaacctgcccaactcatcctataaacaagagaatgcatgaggagactttgctttcttttcttttctttctttctttctttctttcttttttttttttttgaggcgaagttttgctccttttgcccagggtggagtgtaatggcatgatctcggctcaccacaacctctgcctcctgggttcaagggattctcctgcctcagcctcccgggtagctgggattacaggcacgtgccaccacgcccagctaattttgtatttttagtagagacggggtttctccatgttggtcatgctggtcttgaactcccgacctcaggtgatccgcccacctcggtctcctaaagtgttgggattacaggcatgaaccactgtgcccggccgactttgatttctgtagagcagagagaggaactgagagcccaagggtgaggcttgcctctatgggctggatttagattcctttaggcttacactactctggcagccgtctgaaatcagaaatggtgcagcattctgaccatttaattaattcaaaacatcctaattctcattttaaggacattattccatctaattattttttttccagtctgtccatttggaatgaaaaacaaaagaataaagcttaatgccagcatttctcaatgtctctccgaaaaacataactctgcactaaataaagcctggtaattcaaaagcaaagcactaatatattcagcataaaacagacagaggacctagagcaataatgacaccactaataactaaaacagttataacaattaacaacaattacaatgatagagaagctaatgggtatgatcactgcatttaaattgctagcagagctgagaagggctttttctagagaaaaaaaagcagcatcttactctctttatcctatgtaagggaagctaaactccaagcaaccaaaatgtcataagaagaatagcaacagaacaagttaaaaaaaagtattggtttcttttttctatttattgcaaagcatttgtcattgcatgccaggttctttacaactagtgacagtcatttctcttgtaactgaggccaagttggtgctactgatgatagagtcaatggctgaaaattagcctgtgtgacgagcaaagttttaaggtaaaaaggaccaggacatctctctgcctttctccttccttagggacaataaaatctgactgttccttccacagttcagcttatgtttgggagtcactgggtagcgacagaattcaggctgtgatcagggaaaagtggctaaaggcaggccagcatgttatttacattttcttgattactaaaatgatcgtgtcaataaggcctggcattgagtacaacctcttaagttatggaaaagagagacaaaacatgaagatggataaagccagtcctacgagaggatgggatggtaagacttggacaaaaaacgccaaagtagtgacccattggaagtgacttgaaatgttctttaagccaggtcagaaaggtctaacatgttgagttcattcaagtaaactctgacaatttttccttttttttttttctgaaatagggtcttgctctgtcacccaggctgaagtgcagtggcacaatcatagctcactgcagcctcgaactcctgggctcaagctatcttccccctgcagcctcctgagtagctgggactacaggtgcatgccaccacacccagctaatctttttaattttttgaaaacacagggtctcactttgttgcccaggttgatctcaaactcctgggctcaagcaattctcccatcttcgcctcccaaagtgctggaattacagatgtgagttactgcgcccagccttgatagtttattaactatttcagaagaaagctatgaaaatatttgccaagcccccaatgactgtggcaccagaggaggaagagcaattggataataccatttgcttatttcatagccctttaatcttgagttttgaaattactatgatcttagtggtataagtatgatttggaagtggggtatactcagattctgattttcatgtcatttcctcttttcattgggccataattttagctggttaataatcagctcatgtttggtcttggaaaacaggcttcaaaaggtaagagctgcaaacacctctgtggtttccctttgtttctttcatgtagtagttcactctattggcgcgcactaaagtgagaagggggcctcagagatggaatggtataagcaaccattttttggccctcctaaaagcaatcatttgcttataagaccacaatagtgtggtctgtgtctccttttggcttagtttttccacaatttcagagttggggttgggggcagactgaaggaggtacgggtgggaggggtctgtttcaggttttccttggtcagggattttatgtatctaaggatgatttgtgcctccagggttgctttttatttgacatagcacatgcaaacaaatggccagtaatttctataaaaaacgaacacagaggaagttttatttttggttacctggaggttaccttttcatgatagggaaaggtgataagttctcattacctaagacccttaatgttagactactgggctgatgggttggaatttagtgaaactctgaggtgttgaagagtcactcattaaaataaccctgttactaacagtcatgctgtaaactgagctctttatagattgagcaatcaatactacaaggctgtgatagattttctaggtaacagaatgaaataaaagaaattacatcttacagggtcattaacactcaataaggatgaaccgaatcccttcccccctattctgataagatctagttaggccttcagaatgttagcaattccatcagagaaaaaagcacagcattcaaggaacaggatccatcgaggttggagaaaagtacttggattttaaaagtaactctgctagccatagcatcttttgggaaaaaaggaagaagggaaaggtcaacttgcttatatatatttttctccccaaaagcatgttaacacctgagaaaaggctgggcgtggtggctcatgcctgtaatcccagcactttgggaggccaagacggtcggatcccctgaggtcaggagttccagaccagcctggccagcatggtgaaaccctgtctctactaaaagtacaaaaattagccaggcgtggtggcacgtgcctgtgatcccagctactcgggaagctgaggcagaagaatcacttgaacctgggaggcagaggttgcagtgagcggagatagcgccattgcactccagcctggacaacagagcgagacttcatctcaaaaaacaaacaaacaaacaaaaaaacacacacctgagaaaaactaagtagcccaaacttgtgtagcttgtctatgacataggaattcacactgtcctagagctccctgccttttaaatgccttcactggggctgcctgcccttcccccagacctctatcttttattgttacaaaactaaatgatgacatttggatttatgtatttttcaccatttctatagcgcctttggagaaaaggcagtatataaaatcaatcgataaataagtaaacacaaataataaaaattcctgcctcagattctgcagagagagcaaaaagtcctcctgttttttaatcactaagtcaccaatcattataactggtgggaagtgtaaaccatagaaacatattcagagcttgctatactttaacaacacttattttggaggcaggaagcatgaggaacaaaaggtttttttttttttaaacctacttgaattatagctgtaggaacagttaagaaataaatctcctctcacctcccagatataaccttagagaaagaggtggaaggaggaaatgagatgagggaggagtctgaaactggattctagactttgctaaaagatcaatgctttctgaatggagtttaatatgaaattggccataggaagcttacagttactccacccaagctgtccacatgaagtgtttcttttctgcactggtgatggaagttggttgagaaaagatatatgtggaacatgggcgggtcagaacagattttcatttggaattctgtacagtaagtagacaacagaaggaaataggtttcagaatggacctaatcacatgtgttcactatcatgaggtacttgcagctacactcacatccgtgcatcacacccgcctccactgctttctttctctcctgctttggcgcatgacttctgaggctgcatcttcgttgtctcttctcttccctgggagaagctggacccttaggaagttgggtcctgaaccttttaagtattcactttctgtagagaatgaacctagaaatgggggttttgctggatggataaggagagaagaaaaagcacaaggaaaggagagaggagaataggaaaagacagggctagataatggagaaggagcagggagggaaagagggcaagaattcctaggcttaagattttcatagactccctaagaaaaatatcagccagtatctaaatcagtcatgattagggctctgccgacggaacgaatgtccttgaggtggcccttgcaatgtgcagcattcctttactgacaaccatggaataggtccttggtccacttaaggaggcttcagaggggcatctgaccttagaaaggatgggctcactaacagcctgaagcatggttaacagtctgggatgaataagatgtaattttatattcaacaaacctgttacatattcatttccaaatgtgcctggaatcaaaccaggctatcagaagtcagcatcaccaaggaattttatctttcaccctgtgttcacttttcagatctgacacatttccattcccctctgaacttgcaatctccgggcctctcagagaggagacatttccattctttccattctcaatcctctgatctcttagagatgaggcaattctattttcactgtactgatataagaaatattgataggaaaaaataaatgtctggtttggcttcccacccgctctaggataaatcttggctgttctgggaacattaattaaagtgaatgtatggctgcttttaaagtttaggtatttccctacccagtcactttatttagggctttggggttcacacacaggtaccctcttaattattgagttcagtaatttttgtagtctcagagaaaggtgctttctctaatcagaagcccataatgtcctacccagtgcctgtgcatttagaagctcttatacctccttttcgtcgagtgccactctcatcctcttctagatcatgctcttcatctggggggataaatgatcagtattagcaattagtggttcacagtctcatgttcttttttttttttttcgagatagagtcttgctctgttgtctaggctgaagtgcagtggaacgattttcggttcactgcaaattccacgtctggggttcaagggattctcctgcctcagccccctgaggagctaggagtacaggtgcccaccaccacgcctaatttttgtatttttagtagagatggggtttcactatgttggccaggttggtcttgaactcctggcatcaggtgatccaccctccttggcctcccaaggtattgggattacaggtgtgagctactgcgtccagccagtcagtctcatgttccttatacggaaaggtcccctttctctgagctcatcatactctcttctttaaggaaagtttaattactgttgtttttttttttttttttttttttttaggcagagtttcactctttgttgcccaggctggagtgcaatggtgtgatcttgactcactgcaacctccaccttccgggttcaagctattcttcccgagtagctcagcctcccgagtagctgggattacaggctcacagcaccatgcccagctaattttgtatctttagtgaagatggggtttctccatgttgatcaggctggtctcaaactcctgacctcagatgatccgcccaccttggcctcccaaagtgctgggattacaggcgtgagccaccgtgcctggcaattactgtgttcttaaaaaaaatattaatttgtcaccttcaaactggccctctccttcccttccctttcatttattcataagcatgttgaagtgctcattacatgcaagacattgcactaggaactggggacaagcaataaacaagactgtcagagttcctgcccttgtggagcttccagtccattggattatttagatgtctatcaccagaatcctaatccttttcctcaaactccatttctccttccctctggaattctcttcaaaattattatctctatgcaagcattctctctagttttaagcattctagagttaggatgttagagtgtgtgtgtgtgtgtgtgtgtgtgtgtgaacaaccctctgtgattggctgggtgcggtggctcatgcctgtaatcccaacactttgggaggccgaggcgggcagatcatgaggtcaggagttggagaccagcctggtcaacatggtgaaaccccgtctgtgctaaaaatacaaaaatcagctgggcctgtggcgggcgcctgtaaccccggctactcaggaggctgaggcaagagaattgcttgaatccaggaggcagaggttgcagtgagccgagattgtgccactgcactccagcctgggtgacagagcaagactctgtcctggggaaaaaacaaaaaacaaaaaaccctctttgattaattagtccttaatccttaatgtatccatctttgttcagctgtaatggaggctggtcatgtacataattttatgttcctagtacttggggcttgtagttatctttttactgtttttattcagcatgtcttgttcattagagtataagctcctgagggtagctggaatggtcttttaattaattgccgtagattcacaatgggttctaactcaatgccagtgtctaactccagtcaaatgtttatacggtcaaagtcataacataattggcctaagtttcttactcccattaaccggtttcatctcgtcacattacccgataaaataggaattggacccttataatgtaaatatgtgtaccagaatcatatttagctattttatacatggggcaaagtgaagaaaaatacactcgttattcttttcactaccaccatgctcttttcccactctctcactcacacatatatacacacatatgcacagtagatagggtatagtaagcaatgttttgagggctgaatactcagctcctcctggccacatttactttcctttctcctgagtcttaatgacatttgcttgtcttgcttctccatagttttgccactaaatgaaactttgacatttctctttctttttttaaatgtaatgtttatagggcaatatgagttccggtatgccaaactggggaagtaagctccaagctcataggtaagaaggagcagcataaaaatatattagaatactataaagcattaaaggagtaattgatttcaagtaagaaagagactgatatggccaggtgtggtggctcatgcctgtaatcccagcactctggtaggctgagatgggaggatcacttgagcccaagagttagacaccagcatagacaacagagcaagaccctgtctctataaaaaataaaaataaaaattagctaggcacagtgatgcacacctgtagttccagctacttgggagactgaagcaagaggattgcctgagcccaagagtttgaggctgcagtaagccatgattgcgctactgcagtccagcctgggcctgggcaacagagcgagaccttgtctctaaaaaaaaaaaaggacggatactctgggaaataaaatatatatatatatgccctacaatatagtatgggaaaaggagcactttgactcaacagttcttatagccatgtatgatctagcagcagagaatgttctacttgacacctgtagtgctccctcaaccctaccacgaggaataaaacaacctaagctaatggaggagtgaaatcaaatataggaaacagatcatgctgaaataaaccacattaaacattctttgcacattgtcttctcgttactcgtccacttccttcctttctcagctatgatgcatttcttttttgacatgggactaattttaggattggaaacattagaggaaaagttggtacaacctcagttttagagatacccaataatttggacagagagcagctcttttgttgatatcaaacaactccatcacaaagaccaataatttgctgtgcttaggcacttttgcagaggtttattctacctctgctgtctgtgcgcagctgtctcttcctcccaattctaatcaatgtaaattgggtcagatctccactgtgaattacaaattggatccgaagttggagggtcacagtgctgctactccacctccttcccaccaccattagatgggaagcttcaccaaagatcttttctaaataaatcagactttattgtaaaactcggccactgacgagacataacctcattagcattgattttaaaataaattattgaaagtggcttgcctgctctttgcatttgtaaaataggagaatgtaaatgtatttgcaatgataaaaatgaaaactaaaacttaattcctttattcttttgggcaacagcacttaatctagtcataatacaaagatggaacaatagaaatgtgttctatgcagttcagttccagaccagttactcttgatttccactgcacttttggaatcaactagaaagaaaaaaaaaacattggctatagagcttttatatcattcaccgccattactaagctctacgatgatggatgtaaacggggaagctccaatccccacatctgttttatctaacaccgtccttcccaggtggctgaaagtaggctcaaatcaagaagccttcccattgatgggcttggcgctatgcctctggggtctttggaagactgggtagggggcactgtcacatagtgaaggaaaacaccattcacagctggttgtgaaaattacacccctagacacctccctaggttcagagggcacaatacaaataggcatacaagttatctcagatctttccatgaaactgaacaggtgtctttgcaaccccagagtcaaagacaactattatatggcaacagaaaaaaagtcttgttgctcacaagaaggggtgggttaaatagctaaagttctcatttttattaatctttaatgtgacactttaattttaagagactattttgaaaaatattttttaggctaaagagcttgttgaatttctttataagaatattattaggcatttcagcattatgtctactgaaatacatcttcatttaagagtgaattaaaatttatgtgctagctcaactttaaacagtaatggattataatggtccttgctcctaacagggcatatgggaccccaaccttacataggttttaaacaaattaacctctaaagattactgtccacttatcacattaaatgctctacttgatccccaaatatctcatctcaattgggaaaacagttgaagaagattctgttaactgtgtgaacatgtaagagaaccatggggcatcacaaatgagcatcagtatctggagagtcgatttcaataaacattcttggcacaatgtcagggacactaatgagaggctgagaggaataggacactgaatccacctcagagggacagagaggagccagcagcttctcatgacacctggctattttctgaagtgctgctctgacactcctctgacattggctacactgatatcagaaagaataacattagaaaaaaatgactaaatcagaaagaggggaaatcagttacttccccaaataaagaaagtgataaaagcttcaaaaaatgccaactgtgtaaatgtgcaaccagatgtcaaggtgctgtggtgacagatgcaacagaaatacagatagactcaaggtgcaaaggggacatgcagaaaagtagaaataaactgctcccccgcatgcacagatatgttataaatccacggatgtatagcacctcatcagacaacatgcaaaatacaagcaagatgctaataacacatttaattctctgttgtgtatttggttatctcaactgttagctcaaaatattcgcatcctatttcagtgatatgggcttgatgtataagatattaaactcaatttgtgctaactgcaacacttggaatgcactgaatttaacttcacaaataatacctaagcatctactaactggggagaaagacctgaatacaaatcactggtgagggctaaaacaaagcttaattccagttgagtatctgggaaggtgtcactgaggagacatatttgagcagaatgtgtatgatttcacaggctgagatcagggggatggtctaggtagaagaaacaacatgattctagttttggtgctggccaagcagcactgtgtggctggggctcagtgggcatgggagtaagacagagaaaaggccagaagttcagaggaggcctgatgttggtgttgactcttccctgatgctctttcttcataaactttgtatttttggtctctattttgtttcatttccttagacttcttatcttcactgttcccccttcctgtgggtctgaacaactgtacagggggaaaaataattccacagaatgcttgtttccatttgactcaaaattttaaaaactcagttatatgctttattttaaagcaatctggtttctaggtttataataacaccctggggcagtgtgggcagcattggaatgtgcacagaaattcccaaagatggctcgtcatctctctttccatttgctcttctgaaatctctctagagaacacagccagattccgttgccattgcagctgctacaaggccccagttacagcacttcaatggtctcagacgtcttgctggatcccagccttgagacctcagacaaagcgaaacctgacaaaagttgtccttttatggaatcttgaatcatggagctgggcctatgctggcctgtaaaataacttcggtggtggtggtggtggtggtgagagagggctcagaaaagcctccattttctacatattgctttagcatttctttgtggtagttccctgcagtttaatctactgcaaatgagatcctaaaaaaatcaagagcccacatatgctcaacacggatgttcagaaattccaccagataccaaccttgaaaccatattttccaggactaacgtttttgtggcctggctgaaaaccttgagggctctggttttccctcaaggggagaagagtgctagccacatagcaaatgctaattatcccatgattaatgtgatggagtgagtttaatgtgatgacccatgcgttattttgattacaaaaaaacattttttattgacttggtatgtattacatacacttttctccctattaggaagcccatctaaattatactctggaaggaaggtctcacttacatggctttccctatagagacagtgtgggcttgtgtgggccccatcccaaaagggaggattagcagaaccgtcaatgttaaatatcctccacaaagcacatttacctattataaggaaacaaatgttagaggcccacatcatttgactcttgatgggtatgcaatgttagcacaatccaatgttactgtaggctgtccctccacccagcacctggcctcgtagtcaaaatgggcctgagcagaaggtgcactccacattccatctgctcaggattttcagtttcacctgctccatacacatagctggaaataaccaactggactgtctcaggtctggttcgagagggcagggacctaaccatccccagttcttcaaggaggtaacacttcctgtttaaacaccatcacattaataacagccagcatttactgagtactcactgtatgccattgtttgccagggttctgtgctaagaactttacacatgtcagttccagactcctcagcacatccatctgagacagctactattgttttccctgttttgcaggtaatacaatcagacagagagggcaagtaacttgctcaagatctcacagctagcaggtggcagagcaaatccatcctgatttagagctagtatctgtgcctaggataccattgctgtctcatgtgccgctgcttggtagatggtcttatgagagggcagcagaaaggagacagtgttaggccccctcacattcccttcttaatttctccaggtgtggcactatgcaaaattcaaacagcaagttcagaagcaacagctaagtggagtggacaggaagctgggtgatggaaacttgtggctgaaatattcatatcataattaaatgccaatatatcccacctccaactctgactctaagaactgtgatggatagaggcttatgggaaagaacctgttggctgggtacagtgttgtcctttggaaactaggtgcagtttagctgttgtttccctaacctgcagaaagagatcctggatttcctactgtgtggccttcctcacttccaatgggcagctgttgtggatagaggttaaatgtacctacagatgagtcttcatgcccttggggccactccaacataccagctggtgtaaattttggaaaaatgccctgatactctgggcggtgctgcattggccaaggggaggagtttaggaggcaggagaaagatggtcattaggaagccaatcataccttcattgcccactcctggggtaaggtgacagtcccaaactcatcttattttttgaggactcttcctctttattcacctttgctctgtgtctctaagcatcagcccccgccccccgactcctttgaaaacgaaacatggtgcagaaaaaggccctttctttccacccgagaaggttcactgaggttttcccagagcattcttccacagttgtaacccaaagtggagtgtcacccggatatttccccaagcctgggcaggagtgagcagaatgtgagctcactaggaagattctggccaagctggggaatgcatctccttttagggagtattgtgaattagatccatttctgcaccctgctgttgcaatggagccgactgtgaaagggaagattctcagaggagctgtgttttaatgtagcaatttgattcaattttccactctataaaattacccatcactgctcgttgctttctaacagacaccttcactcttaatttaacaatcctatcgaattctgccagggaaattggaaaaatttatcacctgtgaaattttattttcctttggttgtatctgtttttgtaaaacttcattaacgacgatgacttgctgaggaaattatcattttttttaacgtcagacacaagaaatggctcgacctcaaccaagatatcatttgcataataaaacacaacaaaaaggctggagaagtcgggactggtagaggctggaagtgctaggagaagaagcaggctctccttggagggtgggtgaagtccccagcagggcagggacatgtggtcacagtcctgccacttgactcaggaagcaaagacgtagcttcttccccaggaagagatgaatgcagtgtggagagggttggacgctcttcttaggaagccttgaaatgcaagttgcctactgatgatgctttcagcaaccagccctgtcttcagggacttgagtgttagattcaccttagctcttaggttcatctgggattgaggttcatctgggttcatctgggatctaaattgttataaatttaggcttaacttgaatttctcagcagagcactgaactcctggcaaatttccataggaatgatctttctgaatggacttgaagattagcgttcctgtggtctaactacttcacaattaaaaggctcaggctttggttctccactgtctgacccccactgagctttgcaccattcaccagctgctgttatccccaccagacatggctatgcagaagcagtgatgactatacattttttgagatgctagttttcatgcctttggaagaaaggaaatatattgagtagacctgctgtaatgatgagcagataaaacatgttagggttatttttaagagatgtgatttgattcatggtatatctgaactaggtaataatgagttgttctctatcaaggtttactatcaaggtttggtctatcaaggtattactagaaaggttggtcagcatttgcatatttcagagttttgaaatccttcataattttgaagcgattttccattattctcacaactacacaccaaaaagttgaaactagagaattttgatgactcattccaaaactcacaataaaccaataaaaaccaacgtaagtattgttgactctttaacctggtggacacatgtaaaaagttacttcacatggcatggatagaagacactcattaatcaaattcttcttgctcccagagcaaggcagagcctcattacccacttccctacaatctcataaagcgtcccacattatctccttcagaggatgagggttagatttggcttcctttggaattttcaaagttattattcttccaccaggtcatgaatttctgaaactagcataagataatcagaggacaaaatttctcacctggcaagacttcataaatatcttcttcttctttctcctctgtaggctcttttatccccacactcccaggcaagatagtgggtctgcactgggaaccacaacttggggagtcaaaaccatcaatatcatcatatgtctcttctttttcttcttcctcctcatcctcttcatatggaatggttaaggagctcagatctaacaaggcaaagatgagaatgaatcaagaaacagagaaaaagaaaataagacaggaaaggaaagagggagaaggaggaggagggatgagagtaaaatatgtcaaatgaaaatgaaacattaggttaaatgctattatttctaatgtgggctttggtggcaggaaatctacagaaaaggccagaatagcactgcatcaggtttaaaccatcaacataaatccttccttgcaataaaacttgatcagagtgaagcagcctgaaaagtatgggtgtgtgaatgagaacatgaggcaaagggaagaaaataggccagaagaggaaaagccagtgtgctgtacacagcttatcacgtagaaaactggaagggtgagtgaaggcttgcagtcctccagggtactcaggccgtgggagctaaggtggcctctgtagggtgctggagctgtcagaagcttatctccccagtgatttcactgcagaatttcagacaagtttgttcgcagagaaaaaaatgggcaacagtggaagataaaaagaaacggggtatggaaaaatataacagtaatacaagaccaaatggaatggctgaacaatgcagttaccatgtccttttgcaactgcacagtctagctgaccttaaagtgggtcactgcatagaaggtgttgagccattacagcactggggagcaccagggcaggggagggagattggttttttattttaatggggaactgagaatgttcattctctgatgtgtactacagagtgctctctgaaaccctgctgagggccctctgcaggatgggtgagtgcagtcagcatactctggggaaggaaaggatggagagacgtccaactttcatttcaaaatgcaataaaattgtttggcttgattagccttttaataaagattttgcaacaattttcatctgaattttggtgccaccacatacgaggaaaagatcaaaaacacatttgtggcttaaaccatatgttattattttgttttaaaataaaatggaatgaataatttcttcaatgtgggattctgaaagtaccacagggtacagctcaataaagctgctttgagttttattgaggtttacacacttaggggtatattacacgcataaatccaaggcacctagatgagagtgtaccctgtagtctcgccatcaatgttcatgtttgcctagttccagtctattatacgtgacgctgttggtagatgcaatagtttgcttttgtgatagcaaaggcataactgagtaaaacaggcaattcttgtaattaaagcactggtgcttccttctttttatccacaataaaatcttatagcagaataaaaatctgagatgaaaaggctttgcgtttttagcttgacgtgtgtctttctaggtcttgggccatgtataaagttggtgtttctgcctttctgcagaacagaggtagggtcctgccatgatggtaggtgacaattatataataccgagtgactaactcaaggttggcttattctacctgacagaccactcccagataaggcttccctggccattgtttctgctttgcctacaggctggccagcagagggtactctaagagcagtcatttaccatcttcaggcaggactcttcccatcccaaagcaaggaacatcttattgtggcttgggaaataacagtttgtttttaatgtccaatgtccctgaagaccatctagattggtttagatttctacttcctcctaagactaaaataaggagattttgaacctcaattgcaactagatgactttaagttggatattatgaatttcctttccagaatataaggggttaggagacaccgaattgggctgagctgatttttagaatctccttttctagtgattttgaatattacagacttgcctgtaggtaggtggatgagctatgataccagaggtcctcccaaggttgatactgtctttatcttctcattcacacatagtactatttgttgttgtaatatggggaatgtggtaggaaaggtagaggtgagaaagggcagaaaaaatacatactgaagtctgtagattatatttatgcaacataacttcaactgcaaatcaactcaagtattatttctgtaacaatgacacttaccctttaacaagaaacttatttgatccacccagtctctggcttctgctggactagtagctgtaaactagagaaaaatcagtgaattaatttatcactgtcactaaaatttccatgaatcttgacagggatgtccaagggggaggaaccactgagtttcagagtcaagtttaaagctcaggattctctgcctgcttaacatatagaaaaaagaccaaatatttcactcaaactgattttttccttctgcaattttgcatacccagagatgacagctctttgagtctagacattcatgtccttgtgcattctttcatttgattatctattccttcatcagacatttatttgagaaaagtttacaagaaaaagaagcaaaccaacccacacacatgaaacgggaacactaaaaggaggcacattttgtaacaaccggatatcaagaggagacagggagcacctgttgttgcctagagtaggtcagagtggcttgctgaaataataccattttggctggattttaaagaagagttggtggaaactggtggacagagttggacattttaggtaggcaggcctatgtgcaaaagaacaggaatgagaacatgacttacggggaagcctggcagatcagcttgactgaagaacaataacagatgaagttggagagttgagggtcagagaagagtcggtaaaagggctctgagtactaggagttcagagttaaaatgcaggcaacaggaagccactatcagctctagcaaaaggagtgggggattctttcaatagtagtgagtaggaaggattggaatagagaaatctggaggcagaagaccaactggtcctctggatgaagtgacaggaacttaactattgtgatagctgtgggaataaataagaagggaaagagccaaaggatattgtagaagaagaatccacagaccatggtaacgatttggattcaataggccaaagaaaagaagtaaataaagtacattctgattaacaaaataggccagtcaagcatcagcctttagtaatttttttattttaaatgaatcaacttgaaataattgttcctgaaaaatattttaattatctggccattagggtaaggtaaaggtatatgctatacaaagaaactggattcctgcataatgcttattaatagacattgttattcttgatttcttaaaaacaaatttctataaaaacatttctagaaatactggtttagacttgttacgtaaacttttacctggatgtgttactatcagaatgtaataataaaaataactaggaacatattcagtgcatagatctatattatatatattcataaaagactctatagaaaagttttagttcaaatttcaaaaaatttctggaaattacataatgaagacctaggtcctttaacaaaataagagttaagatactgtagaaataaaaaagaagaatgctgagaaaagtctgaagactaaaagtgttacttaagtggttaatttactcttagtatggtgttttcctttttcataagctaaagtttttctaaattgctttaataaaattgtgataagataaaaattaccaaaaagcaggaaacaatacacacacatgcaaacatacatttttggtgaaaatcactatatttccacagtcagaaatttttaaattttattggtcattcagcatgaagatggcaaaaataaaataaaacacattaattttataatgaggtaaagattcaaactgagcacagtacggaataagtctttcttgccccgaccaggtcctctagtccttcaattattattgttactatcgtcaccaatatcttagaaatccttccagagatatgcaaagcatctacacacaggaagattattttggatagcaagatgaacatgggaaaataattttttttcactctacagttagatctttttttgggatttcatggaaggaagtgaagaaaatcagtcgaagaataaagagaatgggaatttaaaccataaaatcggagactataagtaaggaatttgattgtgtgctgcaattgacaagcatctcacctatgaagtgaaattgagaaggggaggaatgaaggatggaagccaagcaaagtctgtatctaagatgagagtggcaacagaggggagggtgtggcatagcaaatatgaggacatgccaagaaatagggtcttcgttggcatgaaatgagcaggtaacaaagaaaggctggaacccagcatagcaaccatggctcacatgcaatacagaaggaaactgcaacaccaagaaggatcaccatctccttgatgcgtcctacctcatagctgcgcctatcctgggaggtcagttcaaagcaggattctttcttggaatctcttcgcaggtggggggccatccgtacaccgtagcccttaatgaggaaggtccctttgggctgcttgcctgcaagacaggaaagctccctgtatccctagagagatgcaactgccaagggaaggcatcctctctggtatgtaaaataaaagcacagaaacagctgttacatccctgaggaaccacaatagtcaaggaaaggttattagagaagcttaagaagaggctactgcgacagtaaggcagatatcactgccaagctagggaaatgcaacgtgaaaggttattttgccaaaagagtacaacagagacagagaatttattagaatgttaagagatctataacaacagaaagaaggaattattacagcagagagagtgtggctgtaaatgtgaggctcttgaaggctattataaagctgaaacattattatcagggccagcagagctcacatttgaggggagggacagcagcacaggggggcattataaggtcccagaatcgcctcccatgccctatgtagcatttgggctaaacttctcttccccttccctgctggtcaggtgggaatttatgccagagggagaataattaaaactcagtattttatcctccttgtaagaggtcaacctgggaagtagcagaataacgttgagtattattagatgacgaggaaggagataaaaggaaaaggaccataagtgaagagagactattctgcttgtcactacttaaaaaaaatgttagaaacagaaaaagaggaggtgactctcaagaattttgtatcctcattgtgtgggtcaggcagaacacacagagaacaggaaccacagtgtctgggatgctttgagctctatatcatgtgaaatgaattgcttaataaatgccttttgatgatgataatgatgacaaggatggcagtgcgatgccaatattaaaaaagaaagaagaagaaaaaagactgtgctcacctggttgagctaaaagaaatacacaaacactattcttactaagaaaatgtcatgggcacagtaagaaataactggcgagaagggagccatggaacagtgctttttgacaccagaatcttttttgttaaagtatctctccttgttctaactggccactaaaatgttttgttgtttctttggtcaccagattttatttcaccctaatggcaaaatggtcaataaaagcttccgagtctcttgctcttgctctccctgctcctctctcaccgtgagtatggaagattctgaatgaacagatgtgacacacctggttttatatctagatatgccaaccacttatttaaatgcaaaataaatgatgaacatatttacagtgagaagtgtcatattagtttgaagttttaaaataagaaaagaacaactggctggattgaatgcctataatttagaggagaaattgtggttgctgggttggagagtgggctgggggttggaaggacacagaggacttgtagctcagtttacaaactatgctgttatccttcccaaacagggctttagcctttgcccctagatgcgaaatgttctgaggaatctaggatggtgaaaggtaggcaaaggtctgtgataactactgcaggcagtgtgagacaattgcttgggcaaatcttaaggatttcaagtcacttagcaaagctgcagtttttatttatttatttatttatttatttatttatttatttatttatggttgagacagagtctcgctctgttgcccagggtggagtgcagtggcgtgatctcggctcaccacaacctccacctcctgggttcaagcaattctcctgcctcagcctacaggcacatgccaccatgcctggctaatttttgtatttttagtagtagagacggggtttcactatgttggccaggttggtcttgaactcctgacctcatgatctgcctgccttggcctcccaaagtgctgggattacaggcgtgagccactgtgcctggcccaaagctgcagttctttccactaccttagtgccacaggtgcaggaagtacaaaggcaactgggtgggtgtctgattattccctatattggatatccaggcactgggaaagcactaagtttgaggaaggagaaacagaaaatgattgcaaggaaaaagaagagtctactcaaactgtatcgctggcctctgtacgaaggtgcacagtacaaggaaagccccaagaagaattgatgctttttaaactttgtctccctcttgcgtcttagaattactcctggggcagtccaactctgtagaagagtatcccctattcgaaagtttgcattcatctataataataatttttagcttgtctttatttgtaattgcctccaattgtgcttatatcctctatttcttttcataaaccaatcaattacattaaacatggatgggaggtcttctagggttagctcatgagtgttgacttgattaagtcagtggtggctcattaagaaactatctctggcccgagtcaacacttcactgctgctgtcatctggctgaagggcatgccttgggtacagcaaccatttgggtctcaatattccatggctataggaatgtccactggactacttacttactagcagtcatgaagataaagcagggagcatgcccttagggggttctatttctgggccattgtttaagttctttaagtctttctcagaattaatttatttcaatttttagctatggtattgatgcctgtaaagagtttgaagttctttttattttttttaaaaaccaaaacattcaactttgataatgtgttgttaatcatcataaaagataaccatttgatgtgctgaccacactcttagtgtttaaaggtgaaataatttctaaattgggttctgctttttcggtgatgggcaaggtattatttgtccatgccaatttctttcctaagcatgtccctttatgggtgttagttaaggactgctatcttgggatctaagtgcttgagaatttacgaagtgtttgcatccaggagtgagatgctgctgtgtaaatgaagaacacttactcttctcattagcatagtagtagaagagacctctgctgacaacacaccatcgcttctgccactccgatccaaagaaactatgatctaaacagaacagcagtaggggacataaattcaggtaactaccatcattgaagagtctgtaaaatccaacaacatacagtccagtgtgttattgttttatttcccaggttaatggactgtaaaaccctccttttcactcccacaggttatcccatattgactcagggtccaggggactagctcagtcaaaggtccaagttctaaacagggttgcctgctctgtgcccccacagctgtctttttatctagactcctttatatctttcgggttctaatctcatcctgtacattttcaaactctccattatatctttatgtgttgcctttgacaaagcaaaatgattctccaggccttggccatgaaagagcctttgttttggtgctgagccaatttgcctgttgagtgttaaacctgagatgccaactctagtggtacctactctaattaaatgagttaaaggtcaagagttgggtttgaaggcagaagtggtggctcacatctgtaatcccagcactttgggaggctgagatgggaagtatgcttaaagccaggagtttgagaccagcctgggcaacaaagtgagaccttgtctctataaaaaaataataaaatagccaggcacagttgtgtgcacctgttgtctcagctctttgacaggctgaagtgggagcattgcttgagcccaggattggaggctgcagtgagctatgatggcgctactgtattccagccttggtaatagagggagatcctatcttaaaacaaaaaaagaaagaaagaaaaaaaaaaggccgggtgtggtggctcatgcctgtaatcccagtactttgggaggctgaggcgggcagatcacttgaggccaggaatttaagaccagcctggccaacatgatgaaatcctgtctctgctaaaaatatgaaaaattagctgggcatggtggcacgcacctgtagtcccagttactcaggaggctgagacagcagaatcgcttgaaccaggaggtggaggttgcagtgtgccaggttcacacccactgcactacagagtgagactctgtctcaaacaacaacaacaacaataacaaaaacaaaaaacaaaagagttgggtttatctgaaatttgaaagtagactgcttcacatatgatacaaaaactacacagtgggagcacactgagagatgaggacaagaacaccattcatggattcaacaagttttatcaagcacctgtcacataccaggcattggggatacagaggtgagcaggacataaccatccctatcctgatgaagcttacagtctgctcaaggctgggacatctctctttagcctacacgaaaacaccagactcctttcctttccttgctttgcttttgccttgtatccgcctagcacagtaccgggcacagagaaggcatccaatgtgttagccttctttttcctcacttcccttcccttcctggaatgttctgaaatctgtgggtctgaccaatacctttgcttttcttctccaagtatccttgcttgattacgttatcaagttcttgagctccttttacgatgtcttccattcctaaaaggaccaatggcaaaatgctttattgaaacctggcaaaattttcatttatttaggctactttaggtaattcacattaataacagagtacaaaaagggcaattgcttaaacacagtacaaaataaaacaatttctgtatgattggagggaaaagtaaattttcttgctttttctttttttttttttgagacagagtcttggtctgtcacccaggctggagtatacaatggcgctatctcggctcactgcaacctctgcctcccaggttcgagccattctcctgtctcagcctcccaggtagctgagactacaggcatgtgccaccacacctggctaatgttttttgtatttttagtagagatggggtttcaccatgctggccaggctggtctcgaactcctgacctcaagtgatccacccgcctcggcctcccaaaatgctgggattacagacgtgagccaccacacccagccaattttctttcttttcaattatatctaatgctaaaattgcttaaaactatctaaatatacactaatttgtagtaaggtgaggtagcgtaaatatgcactgatgggcaggaaaaggactccagaaaattaagaattttttttttttttttgagacagtctgtctctgttgcccaggctggagtgcagtggcgcgatcttggctcactgcaagctccatctcccgggctcatgccattctcctgcctcagcctcccaagtaggtgagactacaggcgaccaccaccacgcccggctaatttttttttgttgtatttttagtagatatggggtttcaccgtgttagccaggatggtctcgatctcctgacctcgtgatccgtccacgttggcctcccaaagtgctgggattacaggcgtgagccactgcgcccagccaaacttaagaatttttttgtggatataagttccaagttggataaacctcactgagataatcaaaagtcaaatgaatagctaccagcacagacagctttaatgagtaatagattccaccataaacgtagtcacctaagagggagcaataaatacacactcaattttttttctcttaacaaacagatagccatctctgtgaacataaatttttttaagttcatagaagaagggctatgcaagctgaacttagcaataactgtcaaatcctgatttcttaaaagtctgagaaagaggctgggcccagtggctcatgcctgtaatcccagcactttgtggggctgaggcaggcaaatcacgaggtcaggagtttgagaccagcctggccaacatggtgaaacctcatctctactaaagatacaaaaaattagccgggcatggtggcacacacctgtaatcccagctactcgggaggatgaggcacaagaatctcttgaatgcgggaggcggaggttgcagtgagccgagatcgtgccatttcactccagcatgggcgacaggatgagacttcgtctcaaaacaaaacaaacaaaaaaaagtatgcgaaagaatctaagaactgtaaaaggcttcacaaataataccctgaaacttacatcagcctttaattgtatgctgctaacattcttggctttcaattagccttgttaggtacaaatttattgagaagtcaagatcctaatccatcttcctccactggggtttatacttacttcacagaagggagggacaaaggatggagacaaagaaggaatttacttctcaaaaaataaaatgaaagaagaatgaaaaaaaaagcctcttttaaggacacactccacatttcttaattaggcaaaatgaaggtaattgggctagcggtattttaacatttattctttttagtcccagaactcaaatctcttttggattgtcttaaataatttatgaagcaaaccaaatacaaaacaaagtaaggcataactacatatgaatcaactgggccacctatagagtatcttgagagttatggttgaaataactttttttcaaacaattgttttttgaacatttcctacaataacatttattcaatggtggctatgagctggcactttgctcagtgcttttcctactttttgttttaaaataacatctacgacaatttaaaatgcaatcaaaattacattttgctttaaagctgtttcaagcttagttataaaaaggtagatcagaagagcctctttttctgtttttaagtgtgtctatgtgcctgattttttatccaattggtccttattgttaacctccttgttcatggactacttttatttgtgtgtttcacagttagcaaactatgtggttgccataaatccttttaatcaatctcagggtgcacgcatgagatgaacagcagcaaaggaaagttcatttttctagggttctttcatttctcctacccctctgaaaacaccctccaaggaaacagtagcagattctactgagggtgaggcattgagtggggtgaggaccagttacagaagagaaggctctctgaagtgctgtcaaaaaattgctcctggggaggccaggtgtggtggcacaaacctgtagtcccagctacttggaggctgaggtaggaggatctcttgagtccaggagttcaaggctgcagtgagctgtgattgaaccacttcacaacagcctggggacagagcgagactctgcctcttaaaaaaaaaaattgctcctggaggcctaaaaattaaatgaaagacatagggagatgaggaaaacacgatcccataagctgggagtttccatctcttctttccacaggttttttttttcttttctttttaaaggtcttgttaaacttagagacacagctccttgtcaaagatgccaagagtctgaatcataaaagacatgttaaacgttctattagaattcaaacctcctttttttaatgcaaatttaaatgccattttatggaacatctataattatgaaaatgggaagacattgcctcgtgtgcagggagagtctgtgagtatgaatattacattaatgtgcccacaccagctcactgatcctgctggcaggagcataaaaaatgcctgagtgaaacttttatttagatgttaagactccaggccccagcggggtgacagagacagcccctgtgagttgccatcagagagagagcttgaattgaattacccaggggggaggaagtagtgatgagcactgcttcgcttatttaatttcatttactttcagtacattatcagcatgaggtttttctctccccaccaactgaaacccaagaatgccaccactaaggaaacaaagacataatacagcagagatgtaactctaagtcactaattctaggagacaagggatagcaccatcaccaccttctctccccaagagtcaaactcagtttgctaaaattgggtaccaaaggagctgctgaattttttctcttggtcattcactaacaagattctgaaaaggaatagagctggaaacagctttttatatggtgtgtttttgtgtatagtcagtaagatgtgttatgttgctttctttctttcttttttttgagacagagtctcactcttgtcgcccaggctggagtgtaatggtgtgatctcagctcactgcaacctccacctcccgggttcaagcgattctcctgctccagcttcccaagtagctgggattacaggcatgcaccaccatgcctgaatagttttttgtatttttagtagagacggggtttctccatgttggtcaggctggtcttgaactcctgaccccaggggatccagccgcctcggcctcccaaagtgctgggattacaggcatgagccaccgcacccggtctatgttgctttcttattcattagacagaatctgtattgaggaattctcttgcctggttccccttatgggcagtgggaaaaaatgggattataggctcagtttagaatgtctacggaaaaaaaattaggaaatgaggtcagatcagtctctagtctactaactgtcttctgtgtacaaggtactgtgtggtgagttcaataacagagttgttctcaatgtagttggctctgagctcaatctcattagctccatgatctatctgacaaatccaaataaccaaggtgggaatccacagtggcatgcaaggtacctcctctttcagtgtcagcgcagggtcctactgatcaagaactagtgatcctgaggatgaacagtgttagccatgccatggggtgatgaggcaggaatcttgtatgcctggatccacacctactggtaaacgaacagatctgcagagaactacttaatgcataatagaaagtatgtaaaatatgctttaaaggacggttataaaaataggaagaagttgcaaacaattgtataagttgctattttaaggcaaacaatttatatttaagtatacaattaaaaaaagaagctttttattcattacctgagaaaagatatcaccaccgtcatgaaaaaataaaaatgattttgatttattgagaataaatggccctcttggctaagtctaaaggtgtattacattatatcagcacaaaacagaattacattagtgtcataatctctccctaccactacacttaactaaacctctcagaacagcccgtataaagaaaagattcacttagctgaaggatatggggccacaaagataagatcaacagagaagtatgttacccagaagtgatggccacccaactttcatggcagatgaagataaaagaaattctcagatatctttctcttcatctagtttcctttaaacccttgtatcccacccacatcaaaaaaagcaataaaaaacgacagaataggattccatctctcaatgctaaacatgactctttagtcagctatgcacagcaacaacaatggggaccctttggagtgtgatacatttccataaagcagtcaataaaaaagacacgagagcttatgtgagtcacggcctatttaaccagctgcgttctagcccactgagaaaagagaattggagaaatcagttggcaacaccagagcacaaggctaatagcacaggaggccacacaatttccacgcaaaaaggctgcagcccctgcagaacaaaccaggtgcccactaactttcattataggcagctggcttggtctcttgctaaatcatcctgaaaggaaaataaatagttttttaaaaaacatcttttgttcaaatcgtccccctgttaagttatggacttctcccatcctccctcttccttttaattcaagttcttttcaactgtttaaaagagggacctaaccaacttgagcctagagactaatagctaacaggggtgaatttcagacagggtgaagtttagcaggatccttcattaaagtactcatgtaaaaaacctggggattgggtgtatgagattggagaaaatttaacatctgaaggctgggaatggtcaaattccacctgcaattccaatgcagtcacagatggctggtgtgtgtgcatctgcagacataaacacaaacacacgctttaaaatgcctcaaatgtaccaaggtgaggagggtattgcagataggttggggagggggtagttttctcttgtctggtgattgtggatttcaaatctgttcatgaacctctcttttgtgcatttgatttctgtggccttctttaatatgttcattactgcttttccttagcttcttacttttctgggttacttttttgccttcttctcaattttcaggaaccagtcaataaatgatagtttgtagtgtctggcaggaagtgtcatcttccgatgctaacaaggaagttggtttcaatgactattccttgattagtcccttgaacaggcatatataattctttaacttccgtggttccatttgatatccacctgagtttacacttataccacacatttttcttgcattgtgcttcacttataaaggaatttagcttaacatatgaaaggtgaaaaattctaaaacattagtaatagatttagcatctaaaatttcaaagatatagaaagcactcaaacagatggctttaaactaactgaatggaactgttcatggagaaataaattggacaacagatgaaaggaagggaatgaacacaacgtacttaatcaagttcttcaacaagctgtgatgtaagaagctaggaaacagaacatgagcaacaggagctagactaaaggaccccagaaaatggtagaaatgacacatttgtagttagcaaaccaacacagaagacaactttcatgagacctcaatagactcatgttgcccttctaatttttgaaggtcttttaaaaataccagtgaatccaggttatagtgaacccaggttacagaaatctgtggagaaaatcctgttatactgaagacaaaaaaaacctctgaggttctaggtcagtagtacaaagaaaaaaaagcagataataaacaaaataattaaaatgaatatgctttaacaaaaatggccccccaaaaccctaaccagttttaaattcatcagcattgtatcaagcatttttacatctaagtcccacaatatccctatgaggcatgttttattatcatccccactttacagactaggaaactgaggtgtaatgaaatgacataatttgctgaaggttgctcagttggaatagcccatgctgtttccaatactctgagcttcagacatgcacagaagtggatgaggaaagattgggtcttcctatctcactcccccacaaaaagagaccctgttttttggaagaagaaacaggcatgatgtgtggttattctaactcctggtgtcaaaaaattattttagtatctatatttcttatttacttttttatgagtaaaatgagcaggttttattttatttttatgtttttcagcttttattttagaatcggggtacatgtgtaggtttgttacaaaggtatattgtgtgatgctgaggtttggagtatgaataatctgtcatccaggtagtgagcacagtacccaataatagtttttcaacccttgcttccctccctacctcctcgtgcatttacccagtgtctactgttgccatatttatgtccatgtgtacccagtgtgtagctcccacttataagtgagaaaatgccatattatgttttctgtttctgcgttagttcaaaaacatggaatgcttcacaaatttgcatgtcatctttgcacaggggccatgctaatcttctctgtatcattccaattttagtatatatgctgccaaagtgagcactcggttacttttaaatgtactaactgattaatctttggaattgcctcctagggcagatctatgtgaaatccaagaggtcaaaagagatatagagcaaaatacaagaaagtctcagaattcaataaaaggacacatgagttaagtacctataagagggcacagccagaagctctcaaaaaatgctgcttggggctgggcgtggtggcccacgcctgtaatcccagcactttgggaggccgaggtgggcagatcacgaggtcgggagtttaagaccaccgtggccagcatggtgaaaccctgtctttactaaaaatacaaaaaattagctgggcatagtggtgcacacctgtaatcccagctacttgggaggctgaggcaggagaattgcttgaacccaggaggcggatgtggcagtgagccgagattgcgccactgcactccagtctaggtgatagagcgagactccgactcaaaaaaaaaaaaaaaaaaaatgctgattggtcaccaaggttcgtaagacctcttctgatgcaagggtgatcatctagaaaaaagaaaccctgttccagtgtagggctcatgcagaaatcttggacatgatttacttactcttgaaggaagagatttgggtttgaaaaggaagattttccccagcactttgggaggctgaggcaggcagatcacttgaggccaggagtttgagaccagcctggccaacatggtgaaactccgtctctaccaaaaacaaaaaaattagtcaggcatggtggtatgtgcctgtagtcccaggtacttggaagcttgaggcaggaggattgcttgagcctgggaggcagaggttgcagtgagctgagagtgcactagcctaggtggcagaacaagactcaaaacaaaaaacaaacaaacaaaaaacaaaaacaaaacaaaaggattttaaagccaaatatccaaactggtttcttttcataaagtattccctcagtaatgccaagccacaaggtaacttacagaaaccatgagtattcatggaggatgaagaaccctctcattcctacaaaggggcaacacatgctaattgtctaggagacctgtggtcttgcaagatgctctcttccacatcttcactttccgtgggattttacttatgagaaatgaaagtgtcaggaaaaagcccttctaactccaagcatggtaacttcaatgcactaatgatagtatctaaataaatggtaataatcaatactttctggtaggtgtcaggagttcatcttaaagaatgactaactgtaataatccattgcttctcaatcgtgaaacattggtatactttgatcagttaaaggacagagattttgaataatttacttttagaataagaatgggttttggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctactcgggaggctgaggcaggagaatggcatgaacccgggaggcggagcttgcagtgagccgagatggcgccactgcactccaacctgggagacacagcgagactccgtctcaaaaaaaaaaaaaaaaaaaaaaaagaatgggttttaagtttttctataacaataccactcactgcattctgatacgctttcttacagggagaagtcaatcaaaaataacttatagcttatcctatgtatgctacagcctatagtgatgaaatgaatctgatgtactatcataattgtggcatcatgaattcccacagtgctttatttacttgaaaaaaaaaattgtgttccttcaaaaccatgagtgttctgtggtggtgggttaagcatatgtgtcttttgattttatcaataacacatatctgtaacccaacatcctcagcttcatttttatcctaagaatccatccttaatatagaaccgcaaaagacctgaagtatctttagcagctaagtcacagtaagtggcaacagagcaaagtgggaatcctgatacaaattaaggcagaaatccttcaatggtctcatgattctaaaaaggagaagaggattttaaaatgccacattgtctttttacaaaccttgcaagatcgacgtattccccctgagtcagatcacgattatacatgcatcacttgagagcctatctttaaaaacgaatgacgaaatgtcattttcagatctgtttatttactatgccactggactgtgataagagcacagagaaaaggaaataaaaagaaaagagccttgcctgggtttagaatcactttttaactggttcaccaaactgtggccagaagtcatctttctaaaacacagatcatgtcacattcctgcttaaatcctgtaatggttttttattacctacaggatgaaactcaaactctccagcatacaaagatttttaagtacttggtgtcttcctaccttccagtttcattttctcccaactttgtcacctcccagtactccagcaacaataaggaacagactctgtcctgtggaacatgccatgcactttacactgccaggtctctgtgtattctgtttttcctgtttggaacttcctctctctacatccagctgccgagttgggagtactccttcagttcaaatgtcacatcctctttgaatctttgattccaccatgtaaaattatatactccctcttctgtgcttctatagcattttctagaacatttttatagcacagtcttggctcccagggaccctaaatcttttcctcaacgtgctccattcttgccactttgcttgggtttccataagaccttagtaacaatgtaaagctgctagaatccttgaaaaagcaaatagaaaaagggctattcctgggaaaagaacggtagttgtggacctgggtacaaggcaatagggaggagggtaaaaatagatcttgcagtcataggaaaagagatgacaccatggaagaaattaagtgaacagaacgttatagtacctggattaaaatggggaaacgaagttgcatattagattcttctttggtgcatatagccgtgcacgtagggggatgggccagggttttcatggcaattgtctaggtaagaagagtaagaattagattgaggaggaaggctggcgcggtggcttatgcctgtaatctcagcactttgggaggccgaggtgggcagatcacaaggtcaggagtttgagaccagcctggccaatatggtgaaactctgtctctactaaaaaaaaaagtacaaaaataattagctgggtgtggtggcgcacacctgtaatcccagctactcggcaggctgaggcaggagaattgcttgaaccctggaggtggaggttgcggtgagccgagatcatgacactgcactccagcctgggtgacagaaggagactctgtttcaaaaaaaaagaattaaattgaggaggaactggaacatgtgaatagctgagctccatcacaagattgggccattctttctttctttctttttttttttgagttggagtttcactcttgttgcccaggctggggtacaatggcgcaatccctgctcactgcaacctccgcctcccaggttcaagcaattctcctgcctcagcctcccgagtaagctgggattacaagtgcccaccaccatgcccagctaatttttgtatttttagtagagacggggtttcaccatgttgatcaggctgttcttgaactcctgacctctggtgatccagccacctcaggctcccaaagtgctgagattacaggcatgagccaccgcgcccggccctgggccattctttaattagttgttgaactgatgtggaattaagaaggatctttcccttaaatatacacaatacactgtaaggagtgtgatactaattatttaatttctggaagcctaaagaaaagctgccagtgggaaatctggtccctttcatagagagcagtgcaattcattatttgtatacttgtttctctttttatccccaggggcctcgtacacacagtaggtacccaataatgtttgttaaactgaactgaaaccacttctagcctaataggacttgtgatctaggaatgcaatatggaagtgaatatttgttagtcaaaccattttcgcttaagtcacaaacagtcatttttgttctactttaatcttagggttggtatcatataaaacaagaaagtaagaagaggcaaggaaaggaggattttgccaagacaacaaggagaaagtgggggtgcagaagttagctcgtatcacagcgctgagaatgaaagaaagaggaccaaaaaggattttggagaaaaaattagaataaaatgccatgaacctcaaatggagagaaataaatttctctctctctctttttccttccttccttccttctttccttccttcctttcttcgttccttccttccttccttctctcctccctctctctctcttccttgcttctttccctccctctttccttctttcctctctctctctttcttttttgagacagggtcttgctctgacacccaggctgaagtgcagtggtgcaatcatggctcactgcagcctccatctcctgggttcaagcaaccctcctgccctcagcctcccaagtagcttggactacttggtgtgcaccgccacacttggctaatttatttcttatttttggtagagacagggtctcactatgtttcccaggctggtcttgaactcctggtctcaaacttctggtctcaagcaatctttccatctcagcctcccaaagtgctgggattataggtgtgaactaccacgcctggccaagaaataaatttctgagtcccatgttacagcctgattggcacaccaattctgtttgccttggaccttatctatctccagaacagggttcagaagaaacaataaacaggcaaaagactgtgccaaatgaataactgattactctttaggaaatagctattgatagcaacttctgagctatagactttgagtggctgagaatttggtcactgatagtgtttcctcagtcttgttcttttatttatctcctggagaaatggcattttccttttgagcttttacatgtacattggtttgcatcctgtgagcaaacatcttatgtgtgtctgagcatttaatactgttaatggtgaaggctacatggagattagtgtgacagactcctgacatctctattttagttgctatccaaagcaaaagatttaaggaggaatcaaatgataataattttgccttctctatgtctctctagtaaaagacattcagatatcatcagagtactgcattgagaaaactttaaaagcaaacacagcagaaaagacaaaagaagactcaggaactaattatcgtgattctctgggggtatttcagggtgggtgatctaatgagaactcttacaccccatcaggaagaacttgatgggaaagcagtgatcttagcaatgtggctttgacctggtatgtattatctcctggtcaaagggccactcccaagccaaacctcaccctcagacagctccatgtgtgtctctgtgtagcagtatgggctcagagacagaaaaatgatgttggctgtgataagtcacctttaaggcaaaaatcaccctcccttaaaaaagaagttacaaattctagatttaaatatttctggatttttctgtttcatccgacaaaactcaagcaagtttgaagtcaaactttgcaaggaaaaagatttaggaggggaaaatgagggtgatgtttctaaacccaaaattttccaaccaaatcaccaagtctgtaattgcaaaataaaaacactaaatctcaatatctatttgcacagctcattaactaagggctcacactcagcaaacggggaaaaaaagaaaaagaaaaaaactttagtaccaaatacatttggaaagttactatagagacctatatttcccttgaatctaaactaggccctgccacattctgctacactgtggttggatgcatctgtttgtctgtctgtctttattgcttatttagcaagtagcaaatcgggatgaggcaaagcatcttttgtcagaccatgcaggagagagaaagagaacatttctttccccactgaacattatgaacattatggcaggcactggacctgctctgctactgggacaacatgatttacaatgtgaaaagggaaaacctaaatcaccaagtaatgaaaacattaaagttaatgcatcacaagtgaggaatttattaccattaactccaataaacagttataaaacactcgtcctttcctgtccgtgcacagggacacagacactggacttcattaagctcaactttcttttcttcttcactagaccagtcatgtgtgtttgaaccaaccaccatttattgttaggtggactagctcattttccaggactgtagaaagctgaaggcacatccattctgcttcacggcacttggtatagacggatgaaatagcaaagtttagaagacatgcagctcggtattgctgtataagtttatttaaaagtctctaaaatgtatttctgacaaaagcagaatagctcttccgagcagcctttctcacaggcaggtatataagtaataatgcctggtggggaggatggcatattggatgccaatgcacgtcaggtgtgtttaactgaataatttttcccttgttattgtttggtatagcaccttggaagcctgagatggaaacccatttccttctaacatttttctctgtcacaggggcagagaagtttattaccttaaggttgttcctgaacaaaagaggctgcacatattggatggctaaggtagattggttccagattcatttgttttcaaggaaaaaaagaactaaagtgtctttttgaaaagccacttctaattgtggaattgcctgggtgttacaaagcacataggagaggcagcatgaaattcaggctttcctgaccaaataattacaacagtaacatgataatagtaatactttacatttggataacactttatttagtgtttataaaatgctttcgtgtatgacacctccttaattctgatctccttcattcagacagaaagatctcaccagtctggccttctgaagctgaaacaggctcacacagttgggaagaagaagaaccaagatataaactcagatttttttctttttttttttttttgagacagagtttcactcttgttgcccaggctggagtgcaatggtgtgatctcggctggagtgcaatggcgtgatctgagcatctcccgcgctcaaacgattctcctgcctcagcctcctgagtagctgtgttataggcatgtgccaccacacctggctaattttttttttttttgtatttttagtagagacggggtttcaccatgctggccaggctggtctcgaactcctgaccttaggtgattcccccgcctctgcctctcaaagtgctgggattacaggcgtgagccaccgtgcccagccaaaactcaggtatttttaagctccaaatccagttttttttccttttgttttggctacaccatgctacacattttatctaatgtatgttatggtcctaactataaagtcaagatgaataatgctttaattctatatttctcagcccaaatttcatgatttttaggaaccccattctgctaagaatggctacagtaatatactactaaatggagccattatgcctgggagttgtccaggatattcagccttaaaatgggatctgatctttggcattaccagagaagagacaggtacctgggctgtatgaggttcacagggatgtttagccccagacattgagtgggactgctggacttctatgggtcaaactgtgtagagcacatgaaaggaggaacaagaatagctctgatgcagaatctgagcagcacatcccacattaccaaagctaagagttccataagaccaactactaaaatgttgcatgatttaagatggtagaaatacttgtcaaggaaatccttccttccttccttccttcctccctccctccttcctctttcttttcttttcttttctttctttctttctttctttctttctttctttctttctttttctttctttctttctttctttctctctctctctttctttcttctttctctctctctctttctttctttccttctctctctctctctctctctctgtctctttctttttttgagatggggtctcactctgttgcccaggctggagtgcagtggcttgatcttggttcactgcagtctccacctcccaggcttaagcaatcctcccacctcagcctcctgagtagctgaaactacaggcacatgtcaccacgctcagctaatttttggattttttggtcgagacagggtttagctatgttgcccaggctggtctagaactcctgggctcaagcaattcacgtgcctcggcctcccaaagtgctgggattacaggcgtgagctaccacacctggccaaggaaatcttaaatagaacaaaaagatcaagaaaaggaaaccagaaaagataaaaagtattagaacacagaaacagagggaaggacattatcaaagaaataataacatttctcaaaatgataggaatcttttgattgacatggtcctccatacacccagcacatgaatgaaaagggactcacatattggtaatcacagtgatatttcagaacagaattcttaaaaagaagatcctaaaaccttctgaatcaggggggagaaacaagtcatacaaagcattaagaatcagaatggcactgaaattctccacagcaacaatgaaagctggaagccaatgaagcaaagctttccaagttctaagggaaaatgatttccattagcattctcacacccaaactaacagttaagtgtaaaagtagaatacagaggttttcagacattcaaagtctcaagaaattgacctcccaggcatcctttctcaggatgccaccacaatatgtgctccatcaaaatgagggagtccaccaagaaaaaaggtgacattgggtccagaacgtggtgctctgatgaaggaaagggatgaaagggaagtcccaggatgacagctgtgcaggaggcctgagagcagccagcccagagtggggaggaggatggagatctccaggagagactagaagcacaaatggaactgatggatcatctggtgtgtttgataatgtggaaaattacaattctgcaaagtttggaaagaattagggatggtgacttagaaaactatgcaaatgaagaaagtcaaggcatttgccaactctaggaaaaacaagaattttttttacatttcctggtttattataaaggatataacaaaggatataggtaaagagatgcatagggtgaggtatgggggaaggggtgtggagcttccatgtcctccctggctatgctaccctccaggaacctccacgtggtcagttatctggaagctctatgaacccagtcctcttgggtaaaaaataaagacgtttttttttataccccttggtataaaaaataaagaaataaaatttaattatacaattttataagggttgacgtaaataatatttacatagttaatgtaaacactaaatattgattaactaaaaattatgatataaccacactcgaaacatgaagaatggggaattgatggctgggatggaataggaatgctgactcctcccctatcataatataaaatcaataggtaatgtctgaaattgataaactaaaaaaatagctgtctaatcatattatttagaagtgtggaagagacacatcagaatggatgaaaaagttaatttttaaaaaatggaaaggggttgcctctggaaagcagaactccagggtgactgcttgtagtattatttgattaaaaaaaatttttttggaaatggggtcttgctatgtggccaaggctgaattcaaactcctgggctcaagtaatcttcccactttagcctcccaagggactacaggtacacaccattgtgcctggctttatttgatttttaagaactatatgcatacattattttgataaaaataaaaatagaaaattttaaaaatagtttttcaaccatttcacagtacagccatgtctccatatttatataatgatgtccattctgagtggctgattacacaaaattcctaagcttggtatgaaggtacgtggcaaaggaatccagaaaagaaagaagaaaccagtgtagaatgaagagaaacaatgctattaaaaccacttgcacaggttgggcatggtgactcacgcctgtaatcccagcgctttggaggccgaggcaggcagatcacttgaggccaggagttcaagaccaggagttctggccaacatgcagaaaccatctctactaaaaatacaaaaattagctggatgtggtgatgcatgcttgtaatcccagctactcaggaggctgaggcacaagaattgcttgagcctgggaggcagatgttgcagtgagctgagattgcgccactacactccagtctgggcaacagaggaagactctgtctcaaaaaaaaaaaaaaaaagaaaaaaaatttacataaagttatatttgaattagatattgtcttaagaatactttaataatctgtagtctgtatgtaattttaagactcatttacaattctaatattgtactttataccatacgtctaatttgccttagctcttcctacattgcaaggggacccacaaaagcaggaggtctctttccactggagagctgttttatttcataaggaataaaaggtatggaatcccattatgaaatttggggtcagaagcccagggtataaacttgggttgcaatttacaaagtattattgtattactgggcatgaccagaatttgatcaagtacctgtagatcaaatcaaatcaagaaaaatttatctggaaccttccacgtgggaggttttgtgccagagagcacagaattcctagaatgtcctagaatgacttcagatcagtgcaaagacagagacagcacagacatgattttaatttatagggttggaaaagtacaaggctataaaacaggacacctgttgtcttgcatttatgttaaaggtttcacctttttaaaaaataatcagaaacacataatcattagtcttgacataaattatactttagattgggagtggaaatcgtgttttcagaataggaaggaaggaaaagtaaaaccaactgcatgtaatttttcaagtggaaacaacggcaatatgaagatatatgggcgttagacccactggtagaggaaggaggctgtgctctcttacctcttaccatgtcactcctgtgacctctaccatttgaaatgctttgattccaccttgcccaagggacctgtgagcaccggggaaagggatgaaggatgcctatgcctgacctcacctttacattgtctaacgactgaaggtataaatcagctttccccttgaagacccaagtgtcagtagctcatgtgaaatgctggaaatattaaatgatgtccccgagggttttactgttactcagttttctcctgtaactgggagagctgttcacatgaaggatactctcccccaggacctcaatttgtatataaaatgaagtatgaaactccaacaacttcttgccagtttggaaagaaaataaacaattaggggaggctgcacttagcccattgtcctgtttatatttcatttatctctttgactattcctagtgaacagtttacaccaacaaaggtgtgataacactcttattacaaatccttatttccagggcaacaaatctttgacagttacaaaatcaccatagacaattcaatgtgtttttgtaatggacaagaacaaaagctcttcctttaatcctatttagcagagggagtgtgctaataattagaagtgagaggcaagtgtctggatgccagggttccatgtctagctaggacttgggcctgtatctaaatctcccttccagattctttctgcagaatttacaaaatctatggatgcttacttctcctaatataccttgattcattaatcctcaccactacctctataatatgagtaattttctataataagaaaaatgaccatttttctcttgatggagaaattaaagtgacttgctcaagcctcctagttagtaagtggacaaggcaggaacagaaggaattatcatggcaatccttagcattagtctgtctacatctcagtctttcctcctcctctttccatcaaaaacttaagtactgctacacaaagaatacagtccttattatagaaacattattatacatttatgtggggctttaaaattttttagagcactgtcaaacctcctatttaacttggtttttataatagtcctattaggtttgtatttacagagtctggaaggataggataaaagtaataagaaacaaaatagttgagaagaaaagccagtgaaatattaaggattacctaagacattgtagaatcttaattaccccaggtttgtaaaagctggccagatacatgaaaatattgattagactgactgtgcctgtgctgtaacaggggaatgatcactaaatgactctttgctctgtgttctaaggttggattccatgtatgaaaggatattcagaagagtgtaatgtgctctcttaacatgagctctcttgccatttaactatggctgaattaggggcaaacagcactgcttctctagaggtaagagaaagtgtgagggctgaaggtgatttcaaacagcaggtgaaggaagatgaagaaatagatacttttcccctcagaagtctaaaacatcttctgaatcaggcccggttgttttgttgttgttgttttataagtagaattggtgctgcttaaatggtgtgtgtttaagttaactggaaaagggcccctcttccaaaatatcttttcaactgacttctgtaattcctgaaattccatcatttggggcccattcccttagattaaagcattattccctgttgaactacaaatgcctctgggagaggtagcacattaatcgagatattctcatccacagtgtggtaacaagctagtacatcagaaatcactgggaggaggaggcacagagctccagctctcctagggataaggcacagctgtctgtacctatgcggtagaccactgagtagaggtagataactgacagatgtcaggtagcgacgcttatccatgaggtcacgtgtgtgtggctggcactgttatacggagccattatcagtcatcgacaccttggagccgtggttcgtaactctggctgcacatcggaatcacctgtctactttttaaaaaagtgtagatacctgaactgcaccccagatatactgattcaggattatctggagtggggctgaggcatgtttatttttacaaagttctatgagtagttctgatgctcacctagggctaagaaccacagcctcagagtagatttgtatgttaggtccttatcatcctgatggcttgctggagggccttggtgaggtgggcccagggaggcccccaggtggagggcctggacagtgagtatcagaacaagcacgaggggcaagagaagtgctataggcaccaaagtaaccaaaggtgacctggaaaagagccaagacaacttgtactcacagcaattttaacaaactacccaggatcattattaccaagactagaataaactacattaatcaaccaataaaagttaggacttctgcataacaccatttaagaaatactaaagaaattattatctgtgctaatataactctggctttaatcgtttccatggctgaggaggccacttgtagtcatttcatcactgtggtatctttcccattctattcctcatagtctcctcccgagtgttaccctgctcggtttgtcctcggctaccctccaaaggaagtccttaccagatgtatcattaggattagtttagccagtgtgacggaaagccccaaataatagaggccttaacaaaatagaaggtaatttgtccctcatgtataaaaagactggggggaggcaccccaggaatgggagggcacttcatgctcctcttttttttcctgaaaaagagttttgcatcttggtgatcacatttattagaagggttggagaaaaataaaaatgccatttagcttaagaagttatgaattatctgggctgggtgcagtggctcatgcttgtaatcccagcactttggagggccaaggtgggaggatggcttaagcccaggagtttgagaccaggctgggcagcacagtgagaccccacctctattaaaaaaaatttttttttaatagaagttatgagttgtctgcaaatcaattcatttcaggagtgggagaatttcttaatatcaaaatgtttgctggtttctcttttgaatgtcctgaacatttaaagaggtacctgtacaaaatctcctattttccatatgggataaattgtttcagccaactctcaacggagggacaaccaggacaaaacatcttctgggaaaaacagcattcgaatattctgtttcgctgatttatatatctcttatatatgatggcttcttcctcaatttctgtagtagtcacagtttcttccacatctcccaataacatatttaaatgtagatcataagcatgtaatctgcctagaagctcctggtaatctctcatttatccataaattcatttatccaggctgagcctgatgaaatcaaggggctcctctatggtgttggtagtttgttgctggtttatgtcgtccaccatgtttcaaacccttcgccctttcctcttcaggctctttctatctttataaagtatgtcatttgttcgtcatggtccaaactggctccagttccagccagcaggaaggaggaaaggggcaacacagacagcaccaccatccctctacctgcttaaggacacttgtgtgtggccctaaaaagttgacacattacttacacattccactaaccagaagttaaatcacgtggtcaaatctagttgccgtggaggcagggagttgttctgggcagccacgaacccagaactgggggctagctagcagtctcagctacaccagtaatactgcacacagctaaataagtattggcagtcaccttatgaacctagaatatcccactggaaagaaagaaaatgagtatggtaagagaagactgcttaattccaggtgttgggtaattcgtggcgattagaggaaagtgttttccactaatgaagagtgagaatttgttcaaagtagttatctgtggtccaagaatcataacagaggcctcaaataaatgaagtgttggtttatcttttgaaaggttatgtttcctcttggaattatgtgattcaaaagtccacctcttgcctaaggaaggactggaatacaggccttcttgtccaagttcctgaagttaacttctataacactgtcaggagcagaacaacatataagaccactggagtgtgcgctagctgttagtgctcacaaaaagtaggagaaatgttagtactaatttcacacccaaatttgcttagatgtgcttaaaaagattctgatcaatgaaaaggtatacttttccctaactctagggctccaagtgcttgagggttacagataatgctgttctagatgcatgtggtataaaatacaaataatctgtttaagtctatggcaatgtttggattgcttcactgactaggatgattttaaaagtaaagcactgtatcttttccaatctgatctccctaaatcatgcaatagacttgtttcctttctttgtgtttctcatttgtccagctcattgaatcgtatggctatttacctcagttagatagagaaacatggtgctaaggagacgaaggtgacctggtgctaaggagacaaggctttatcccaagtgggttgattggcgtgcagaattcagttctgttccatgtctagttgactgcttctctacccctggctagttattctgaggggatgcatgcttcttaaaatggggggctgagtaggaaagagtgggtgcctcagcagaattaagctgtactgttggccgggctcagtggctcatgcctgtaatcccagcactttgggaggctgaggcgtgtggatcacctgaggtcaggagctcgagaccagcctgacaaacatggagaaaccccatctctactaaatatacaaaaattagccgggtgtggtggcaggtgcctttaatttcagctacttgggaggctgaggtaggagaatcgcttgaacccgtgcttgaacaccacggaggttgcagtgagccgagatcacaccattgcactccagcctgggcaacaagagcaaaactctgtctcaaaaaaaaaaaaaaaaaaagctgtactgttgtaaacgccctgcaaaggcccttatacagagttgatgggccagaagtacctctatgcaaagaggaacataagtagtttggatatgaaatggtctctccaacaataagccattctactttcaggagactatgacctagcagcttggagattgaactgtggcatcaggaatggaaaagaaagctagtgtggcaagaacaactgtcatattcacaggacaaggtttagggctctccgtcttctgcttcttgctgatctgggtcaccacattctgcctcctatttccaacctaccttggtgtttcccacccccagctgagttgtcactatgtgttgaggaaaatcatctccataacaggaatgatatttgccactgttttcacttattctagatagaaatgttatttctcaccacagaggaagacttttttccctcttatcaaaatctgtcagtctatccacacaacctggagaacaaatgtgttttttatccctctgtgaacaaacacggctcagcacctgcacagcactcaagggtggccagacctcatcctgactctgagccaactgctgctcttggagagagaaagtaaaaatgattgattctacatcttaattaagataaacaaagagggacatcaaataatggccctgacagtttgaaacaaactaaaagtacagcttagcatttcataaaataaaaagcgtttgatgtgaggatggcagtttaataatttgtaaatatcactggcttagtattatagctaatccaaatattttcatttctcatcataagtcaccctctgttgatggcttgtcctcttcaacttacagctttcaccctcgagccttcaacagaggcagagaggagaggaacagaaaggatcacaggttctctctggaatgtgaattacagcctcagcttcctttatactttctgattctgaatattcactagaaaataccactgaccagcccaaaggatgtattgccttcttcttcatctcctctaaaacatatcaaactttaattacagcttcctattagcttctgattgtttcttcttctttaattttttgtagagatgggattttgccatgttgcccaggctggtctcaaactcttgggttcaagcaatctacccaccttggcctcccaagtgctggaattacaggcataggccattgcactgggcctgattgtttcttaattaagagaagctgaactttctccagttcctttttttttttttctctttttctaaaattagaggctgggctcacacctgtaatcccagcattttgggaggctgaggcaggcagatcactggaggtcaggagttcgagaccagcctggccaacatggtgaaaccctgactctactaaaaatacaaaaattagccaggcatagtggtgcgtgcctgtagtcccagctacttgggaggctgaggcaggagaattgcttaaacctgggaggcggaggttgcagtgagctgagattgcgccgctgcactccagcctgggtgacagagtgagactctgtctcaaaataaagtaaaataaaataaaataaaataaaataaaataaaataaacagatggcattccactatgttggtcaggctggtctcgaactcctgggttcaagcaatcctcctgcctcagcctctccaagtgctgggattacaggtgtgagtcactgcacctggcctctggtttttaaattatagagaaataaaaaaattgaaccaccatactaactgtaatgttcctacagtactgtttttatatcataatgaaatagtcagctatagatctatatctaaaatgtgttttattgccctaatgccctctgaagaagggtagctgaagggtaggggtattcttgttaatgcctatgtctacacttccttgggtgggtatggaggaagacaagcagaaagctgtgataataattataaaaagataaaagtggaaacctctatgttggccatagccttgtgatttggcttttgtgaaaaatattcagggaaatagtagggaattttaacaattgatttggaattccccagggtgcaagccacaacatatatctgcgaaagcagaaccgaaggaacaccattgggcagacggaggctttgggctttttaaaaaggtatgtaaaaagggaagggtgaggatgcagacgtgtcagatcagcctgttgtgagatatgactctggactcaggagaagaccattttctcatggcctccccattctttttgctaaggttcttaacagaaatttttttttttcctgctgttggatgataccaagtccaggctcgagaccacactggatggacatgacaggcaggggcccacagagggaagctgcagttcagataattctccacagggaagcagtatgagatcagggtttagatagaggcagccccagcatcaccagctctccctggttctaattggagacagttttcctcctttcctttcactgtgtaagataagcaccaacagggcaagctcacctttcaggagagcccctgagcctaactgcaatcctccatgtagccctttactcccaggcctgttcctcctcacttaaacagctggctttcagcatattgctttgtttattccatctctgacctatgcattatctgaaggatgccataagggttcaacatgcccacctttgtgaaattacctcattctgagctgctgggttcataccactgacacagaggggaaacctgcagagggaagcttagcaacatgtcacacacatgttgttcttggcagtatgaattccggtgacttttgacatttcttaaacaggagtcagttatatctttcctactctgaggaaaatggtgccagctacaacttgatcttgtttgagttatagaagcaatacaactttatagacaagactctgaatagagagcttacaactgagattctatcttgacaacatcccattgatagagtgtgtgataactgcaaagccactatttatcttacttgcttatgaaattgaaataacatattgctgataagtcttaagaactaagtaccctatgtccactttgcacaagcacccaatactgtgaatatactttttttttttttttgagacagggtctcactctgttgctcaggctggagtacagtggtacaatctcagctcactgaaacctccacctcctgggatcaagggatcctctcacctcagcctccagagtagctgcgactacaggtgcacaccatcatgccaggctaatttttgtattttttgtagagacagggtttcgccatgttatctaggctagtctcgaactcctgagctcaagcgattcaaccacctcggcctcccaaagtgctgggattacaggtgtgagccactgcacctggcctgaatattcataagagataaaattttgccctctcttttgtcagacattctctagaatgcatgttctttcatggacagattggcaaatattataagtatcagattcaaaactttctaagaaatttaaatgttgaattcttctaatacaagaagcaaaaattccattttcagcgtttcatgtgttgagagtgaaaagggggaatataagaaagaagtgaagtccagatttcctaaagtacatctcaggtaagcctctctcttatcacatattttatttttttacctgaaatatttcagaacttaaatgtttttgtcaaatttgaaaaaggtgtgtggtattgacttcttcatactgatctcatttttattttctttatagtctgtccaaatcattttcaggccccttaaatcagttacctttcttctagggacaatcaatagaaagcaagcaaaaagaaaaaagagtgagacctgccctctcagtggtctcctgggtaactttatctcccagacaggatgatgcaaagatgaacagaagaggggtttctgaatagatttccagtaggattgctgtcaagatgggatcagctgcaatggtgccagataaaaactgcaggagaccgagatgggtggattgcttgagctcaggtgtttgagaccagcctgggcaacagggcaaaaccccatttctacaaaatacacaaaaattagcctggcctggtggtgtgcacctgtagtcccagctgctcgggaggctgaggtgagaggatagcttgagccaagaggtcgagactgcagtgggctgagattgtgccactgcactccagcttgggtgacagaggaagatattgtctctaaataaataaataagaaaaggttaggtaaaggtaaaaattatatggagtccactgcaatatctcttatccaaaagaaatttgttaaaaaaaaattttaacagctcaaactacctttgaggctaataaaggcaccaaaatggattatcagaccatgatttgaggtttgaaaaaggatgccagtgctgactgactgggaagctattggaaataaattaaaaggctacattatgtgaaacagagggtcacagcataggaacatcttgaaaagccataggtgcaccaattacatttatcaagatgttagtgaaagctttgtgtatggcttgtttttgcaggtcatttgtatgagatattgttggataaactgatttcatagagaaggaggaaggtactaagtatcacattgtgttaatgtgccagcttgccacctttgggatcagatttggtgcagggcacaaatgaaatgagtttggtggcttcaagctaggctaccactgatatttatccttaaacaaaatcacaaatcatttgctaacagctaggatcagagacctggggctgagacagtaagaatgttgcaggtcaggaggaagactagctggcagagttgggttagggaagcagccatttcctctaggtctccagcttggcttcagcttatgttaccaaccaacccttctcatccataaacactgacattcacactgattttacaacctctctttgcctggcaaacccaacatcaatattcccaacagcatttcatgaaacctctagttatcaaagtcctcatcacttaatcaattctaagaataataatttcataaacactatggaaaaggagtcctattattagactgtaactgtccttagcaaaataatggaacttggttgttctagtgaattctaaatttaaacactgcttgctctgtctccactcaacgaagagcttgtgtgctactctgatgaaaatgcaaagaattagaaaacaatgactgtgtgaatgacatttacagagatctcatactggaaagggcacattttattgtgactttgtgtcaaaagtgtagtttcatcagagcacaggaggcaaaagaaacaggcaatcaatacttgggcctctaatatctgaactgagaaagaaaatcattatcctgttacttctattgtagggtgatgcttgaaatactgcaccttgtttccataataattcaatattttgggggtttcagattgttaaaaaaaaaaccctcatggggtggccatgtgaaatcagaacatgaagagtagaaaggaataaacatgcacacattttacagtgggaataaagagaaaggcagattaagaaagagaaatagaaaaaatataacaacctaatttcctattagtatttatctaatagtatatgtttaattttggaatctctagaattaacctgaaagagttctttgcttccaattttttgaacaaaacacacagatttccaatagagaagagtcccctcaatattaatgaggttacttgggcagaatttttatctctagatttattgaaaattgtattccattgttgagaaactaaaacccaggtgggaaccatgtggaatgtgacatttgattttaaaagtcagttgtactattcacttctcattggcaaaaaaactggccactgaacttgaacttcttgctgacaaaaggagaggaattatcatccacaaacctttttgaaactcttatatgtccagcctcaaataaagcaccagttctgcctatttctaatatgactgtttattggttagtattttcaaaacacttcaaggcaattaaacccttccccctctagatttcagcatccagtttaaaagtctctctgaatacatattatggagaatagggtcatgtcagttaatgttagttgcaaaaacaagtacagctgtcctcaacctgactttcatacttttgtgtgttggtaccataacccagttatttaaattctgggttttttcctcttagaattattattgatgaaattagcattatatagtcataaagtcattacctgcttttctaggctgtctgctgcacccccatggagagctaagtgggcccttaatgaacaagaaaaggttatctggctgcacacggtgtctcccagtctgctctggctagaagctacagcagccacagataacagttcaaagtcatgcaaatgagggctaggctaccactttgttcctcacagaggagatgttcctgtgatccactggcaaatgtacaatggaagcaggaaaaaaggatattttcagagacctaatccctccaggcagctggtttatttcaattgaagaaactactacagccacccaccagaattgctaaaattaagaaacactgacaataccaagtatcagtgagaatgaggagcaactggaattttcacacattgttggtgggagtaaaaatggtacaagtctgttggaaaaatgtttggtagaatctcctaaagcggaatacgcacataccctctaattcagcaattcctctcctagctatataccaaacagaaatgccaacatagtggtgctccaaaagtctgatataagattgttcacaacagcattatttacaatatttccaaagcagaaaaaaaccatacgtttacctaccatagaatgaaataaaatgaataaaggaaatactatatagtaatgagaacaaaggaactacatgtgttttgctacatgcaaaaacacggacaatcctcacaaatataatgctaaatgaaagagtccagacacacaaaagtatatatagtatgaatctgttcatatgaagttcaagtataggcaaaattaatctggtgatagaagtcagaatagtagttattttggtggagataactgggacggggcataaagagaagtttcaggccaggtgcagtggctcacgcctgtaatcccagcactttgggaggctgaggtggaaggatcacttgaggtcaggagtttgagaccagcatggccaacatggtggaaccctgtttctactgaaaatacaaaagccgggcgtggttgcacatgcctgtaatcccagctacttgggaggctgaggcacaagaatcgcttgaacccaggaggtggaggttgcaataagcccagattgcgccactgcactccagcctgggtgacagagcgagactccatctcaaaaaaaaaaaaaaaaaaaaaaaaagaaaagaaaaaaaaaagaaagagaagctttaggggtgctggtaatgttctatatcttgatgtgggtagggcttacataagtgtgttcactttgttaaaaaaaatcaccagggtgggcacggtggctcacgcctgtaatcccagtactttcggaggccaaggcaggcggataacgaggtcaggacttccagaccagactgacaaatatggtgaaaccgcgtctctactaaaaatataaaaattagctgggcatggtgatgcacatctgtaatcccagctactcaggaggctgaggcaggagaagcgcttgaacctgggaggtggaggttgcagtgagccaagattgcaccactgcactccagcctgggtgacagagtgagactctgtctcaataaataaataaataaataaatcattgagttctacatttatgatttgcgcatttttctgtatatatgatgtattgcaataaaaaagttgacaaaaaactatcaaagtagtttgttactaactaatgcctttgtcaacttctgaaacactaggaaacaaaggaagaatgactaaaacagtttctccttgagtaaagtttgctacagaattactttttaaaaatcctagagaaattacataggcatggctaaaagaatttgtatttcctagcctggagctcataaggctaaatggtgttttggtttaaaccttcaagtactgtatagtgcattatatcaaatgttttataaggaggttactaaccagctaattctgttcgtgccgcaagagaaattgacttaaattaaaacaggagcaatttcaagaagttaaataattgtgggatcagaattgccgagtatctttaagaaatccacaaggttgcctgcagtctctttcagttctgttctccagttcaacagtgggatggtggcgtaatttaaaaatctgcccttcacagagagcactgcatgttttaagggctcttgccctaaactcacttatcaatactgaaatatccctaactcagtttctctgtctagacgtctctgttgcccactcctcctgatgataaaggagggagaaagcccaattggttaacatctataatttgtagtgattctgtgatgaaatatggtatgtaaatgtaaagaattattattataataagcccagtcaaccacaacaatggtggttggtggtgccagaaatgtctaaggggtaacttggaactcttaccactctctcagaaattaagttgctacagttagctacaggctttgagaagtagagggaaccacaaagagcctaagcgtagggagctgaggtaaaaagagcttggtctaaaggaaaccctaggcaaatatgacaaaaagggttcctcacgctaatacaaatcaataatagttttagctatcatctaggattttctagaagttttctttccattaattactcttccttcatactcctacactctttctgtctctaagaaaaactgtattcaagagatattgatgaactgacttgggtttttttgtttgttttgttttgctttgcttttgtagctgaaaaatgtacatagctaaaataggagatgcatatagaagaattatatatatatttttttcccgagatggagtgttgctctgtcacccaggctggattgcagtggcacaatctcagctcactgcaacctccacctcccaggttcaagcaattctcctgcctcagcctcctgagtatctgggattacaggcccctgccaccacacttggctaatttttgtattattagtagagatggagtttcaccatgttggccaggctggtcttgaactcctgacctcatgatacgcccacctcggcctcccaaagtgctgtagaataattttaatgcttcctaaaatgtcctcttaaggccgggtgtggtggctcacacctgtaatgccagcactttgggaggctgaggcgggtggatcacgaggtcaggagttcgagaccagcttggccaacatggtgaaaccccatctctactaaaaatacaaaaattagctgggcgtggaggtgagtgcctgtaatcccagctactcgggaggctgaggcaggagaatcgcttgaacctgggaggcagaggttgcagtgagcagagatcatgccattgcactctagcctgggcgacagggtgagactccgtctcaaaaaaaaaaaaaaaaaaaaaaagccctcttaaaaggtgcatggtttgaagtcaagctttccagtgttaaaatgctaccagattttaagctcaattcctgtgtggttttggagatgctggcattctaaaaactgctgattctcacttggtaaatggaaactgagttatagcaactaaggtctgaagaatcagaagtagatttatgcttaacaaagatctatgtaagataaaaattattatgtggaaatttagggcccttccaattttaggtttctgacttctctggagtggttttctggcacaactaagacactggtgctcaattatgagcaacacagcacttctctgaattatgtgtccactcccttatattctggatactttcctagttgctcctaaatttccacattactaccattatatgctgcgcagtatatgaaaatgcccttttggcatcatctgtgaactgctgaaaactgaagtgtgggcaaatgtcccatgtggatatgtatctatataaaccaagccacagaagtggtaaatcagtctaagcacagaaatgcctgcaaatttccatcaatcaagtctagaagaactatcacatgcatttgaaaataagcaattgttgaaaataagccaagttaaccagtttttatgagctcatagtgaccgatggttaacagtttgcttggggttattcactcagaactttactggcatgttctatgactacaagtacaaggtaccaaggaacagcagatgtgcacggcactgtatgtgagaagtatgagaggaaaagcagatggcctctagctgaatatctgaaattgttaattaacaataaaaaagtatataggtaccaaaataaaaacctacagctcagagaaggcagtgtgtatagactgtggagaagagtaccttgagctgaactctgagagatgggagacagagagagagagagagagagagagaagaaggaggaggaggaggaggaggaggaggagaaggaggaggaggaggaggaagaggaggaggaggaggaggaggaggaactttccagaaaggaaacagcacaagcaagagcttgaaagtctacactgagtataatgtgttcttagccaacagtaacttgactgatgcctggagcttttggtggatatgtaggtgtgggtgtattctaagaaataagctaaacatttatcctatgggtgtaggacaaactctgaaagatttcaaaggtcaggctgacaagttctaataatctagttttccctagtttccctcactccaatttctcattatgaatgctgaaatgagcaggtcctttaaactggagaggctaggaggtctcctcagctatgcagagttattgaaagttttcagtcaggaaatgacataataaagccagtgtttttctagtgatgaagatgatttaaatatagttgctctacaactattcttctattgactgaactattccatttttcaaatagaataataattcttaacaaagtaaactggttcttgtcttagattctttctggaacaatgtggtatcatacctatgcctagttaatggataggaactgtcatcaaatttaaattttctcttaaaccttgtgttattttaccactttaggtggccaaaaaagaacaaatggtaaataaatatattaatggaaatttttggagaccactgatcatgcttagttcaaaaagccatacttagtggccttttgggggaggggagatgggtgtgcttctggctgagagtttatattgcatacatataatgtggccatattttgtgtcagtacagtttgtatgatagaattaaacatatatttaatgaagttttgccaagtgtaccagaacacattagagaactactgcttttacatagccatatttgaatctactcaatttcaacagatttggaaaggactacaaataactatagggggcagaaatttaaaatttaatagagaagggcagtctactatggcctctggttcattcatggtaaagtgaaatagaatttgtatttctagtatgtacgcaaattctctaaagtaaagtagtatatttcaatatgcttctccctcactaaaactgatttaaatataaatgggattgaatgagttaacggctgtcccatagaggctccctgtattcccagctcttggcacacacagtaggtgcttactcaacattttaaaaatcaatgaattaaaggactgaatatagcagggagtcagagattttaggtcttgttattgatcttgccacacatttatttatcaagtagatttgggtatataggctttctgtgctcattttttccctctctgaaatcaagatgataaaacttcttttacgtatggtgatgcttgaaatactgtgtgtgaaatgatttgcactctttgggagaaaaggatcttataaatagaaagcattgttcaggttaccaacagcattcaaatttaatttgtaccacatggattatgcggagggcccatgacctaagtaatgaaggttgctgagccctagatgcccatggaaaaaagctttttctccttgtttttctggctgcaagagtgactgctgtttcctctgcctgcctgttctaactatgatgcacttattttccgcagcctcatctcaattccttattatgaatactgaaaccagcaggtcccttaaattggagagggtaggagatgcatacatctgaaagtgcagtaataagggccctggacttaagaatgaagagttgagagagatgagtaaagaacactgactaggacgtgcgagaaaagacagatcaatcccaacgattcatcatgccaggagctgtccaaataatcaaaggtatcagccagggtgatgtatagctgatgtcacttggggagacccttaacaaggcggttagtacaacagctgctgctggtcagtgagtagcacagcacatgccaggccagggcagaggaacatagaccatccatcactgacccaacctaatggctaggcttattagtaaacattctctgtggctgacagcctgtaatggtacaggatgttcccctactgtcccccaaataaactgacccacctgacagatgtgtgaaatccgtggtctctcttcagattgtttgagtaagtataatttattctattttattgagacaggcaagaatggatctttagaaagaataagagaagggagttatgtataaagcctccatttagcagaagtatttgtaatccacttcccccaagatacgttttttttttccttcttaatcataaatcagaaaagtgacagtatatgttgacatgcatgcatttttctataggcactattgtaggtaagtttcatctatatctctattatggatcagaaattcccaaagtggaaataaaatccactctctgtattaaagatatctaagtctactttaactacattatgttcttggaggggatatcttaatggactaagtatgaggtttgaaatatctagacttcctggaaccacaggttcaattcccagctgaatcagctcagtcctccagtcttcactggcagataaagtaagatgctaacaagcttactgtgcatagatctatcagatgagttgcagtaactcataatcttgcctattttttttgaagtggacatttaacttgattttggtggttttgatcttgaaaaattccatacagtctgcatggtaaacttgatgcttaatttattcaaaagggatgtgctatttagggtgagctcgcaccctccaccaagtttgagacattcttaaacatctgtggggtttgaaatgggcaggttgttgcgattccaattacctcttcctaactccataccttccagtttgcctggacttgagcttcctgtcttgcctcaccctttagtgtatcttcctcttggcttgaccttagcttggctctctagttttggttattgagcttgctttgaattctggcacaggtgaattcttcaagccctacttaacttggattctggacttttcactactctgacttccaggactggcatgatatctcaagttttacttcagtttctgtgaatggagagggaacatggtataaaaaaagagctctagggcttgggaaaaattaagagtttccagaaagactatttcctaaactgcccctgtttattcttgttctgtgcgctagtcctagcactgacacaaagtagttctgcaatgatgagcaagtcatttgatttatctgcagtttggtctgcagaatgggtaggctagactacatgagttcatggctccttctctgtcctaagattcttggatctttcttggtttctgtctgggcaccccatcactcaagctccagctcagtacagaaagggactgaaaaatgttttaaaacctaaattttatgcatcatcatagccactaattaatgccaattgagcactaacaccttgtgttaagaattttagaattctttacctctagtggaaaataaaagaattttagaattttatagaatgcagagaggattggcattttggaattttttatcaaggggagattccataacatagtctcaaagagaagctcatttttatttttattgtggggtctgaaagaaatgaagttgactggctagtagagagtggtggtgaagaacatggactctgcagccagagagcctgctctgaatccaggttccaacccttaccagctgtgagacttcagcgaactgatcaatttctctgtgtttcagttttatcttataaggttgttacgaggataaaatgaattactgctaaatagtgcttagaactgtgtctggaacacaatatgcactatgtaaatgttggttaaataaataaaaatattggagctacaaagtctctcattcatttcaaggtgtatttctgtgtatatcctgatcactaataagtagcagagatattatgacatatatttaatatctacaattaagttgcaggcttatgcatagagaaacactgatgtaattcagtattgttaagattgcaggaaacataattatataagatgtgggggtggggtagggtgtgtgtgagagagagagagagaaagacaaagagagatagagagatagagagattgaatgagcatgagaaatctttctaatacaccaataaaaagtctgtctctaaaatacttaattttttcacaccgtgtatttgtgtctcactaaaaaacgcaatatagaacatctgtattgttaataaacctcccatagagagcactgacacttgaatagcctgaaatgttttctgacatctgaccagagctaatcatagatgcttctataggttggtttctgcttttggagcattattcaaatattgctgcagtattgtgttaaattctcaaatcatacccaatagatagcaaaggtgggccttgaataatttaagccttgtattaggttttgtgttagaactgaggaaatagcctggtgagcatttattagactccacttatgtatcagttgctgttctaagtgctttacatgtatcaactcattcaggtttcaaaacaaccttatgatgtaggcgttttcccattttatgaatgaagaaactgagggatacagagtttaagtaatttgctcaaactatacagctagtgactgccagagctcagttaagcctttttgtttagtgcctggggttttgggccaggtcctaggcattttggaaaactgaagagagaactaggcaccacagagctgggctaaaggagctgacactgtggtgggattcctaatagaaccctgtggtttgctggcacagggccctctacaggcaggtggggtaagagctggggcagataaggaaagacaccacagtttaacatctgatgctcagctcagagaggagacctctctgcctcttctcagcactgccttcaggtctggagtgagtctctgtactcttggtcgtgcatccctgagggtgaggtctggatcctactctctttacacccaacacttagcaccatgtctgacacattgtaggcacccaaaagacctgcggttaagtatgaatctcttttttcaacttagggttctgaagctttaatatgaaaattttatttatttttgtttttattacgtagacttggaaataaagcaagagaatgatgatcatcaactacctagaagcatcagttaagttagcagtactaaacctttttttgtcatcataaaacatttgcgggcctggcgtggtggctcacacctgtaatcccagcattttgggaggacgaggtgggcagatcgcctgaggtcaggagtttgtgactagcctggccaagatggttaaacctcatctctactaaaaatacaaaaattagctgggcgttgtggtgggtgactgtaatctcagctactcgggaggctgaggcaggagaattgcttaaacccaggaggcagaggttgcagtgagctgagatcatgccactgcactccagcctgggtgacagagtgagactctgtctcaaaaataaataaataaataaaatatacataaaaaataaataaaatatttgcagtttttttaaactcacaggttcaactcataacttttttctccttaatcttgagtttatatattttggctggtgctaaacaccaatgtcaccctctccaattataacagcaagaagacattttaacctaaacagtgttcttcagattaatgaaatctaatagcaactctttcacctctgggctattccaaaccaagtggtaatgaccaaagaccattcctcatcttgtgcttggataggaaaccctgagaaatgagtcttgggcttggtccagtttttagtggaaagtgcacacatcacaaaacttagtttcaaaattcgcctccatgctgacagtctctgttagaagggcagagcatccaggctcagaccttgaactgaaaaatccttctcacttttcaacaatgcccctttggttagaatgcaggtcaggcatacttgtccagccatggccattactgggctgtctgctctagggctaaaaaaagatgttgatttcctgtaatatctgccctgcaatttttacaggaacaatgttcattaaattaaaaataataaaccaggcaatgttcttgtgtaacctgtttcttagaacttgctgtccacatgacagccttccaggatgtcttttcttgtccatactaggttaaagcatcaacaaagctttgttttgtgttaaactcaaaggtgtctttctgcagattcttccagaactgcttgatgggggagagggaagatcatgcctggcaaaaagtgatttacactaacatatacacaaagaagataatcatcttgttttatgtgccggttgcagtggctcacacttgtaatcctagcactttaggaggctgaggtgggcagatcgcttgaggccaggagtgtgagaccagcctgggcaacatggcaaaaccctgtctttacaaaaaatacaaaaaattagccaggtgtggtggtgtgtgcctgtagtctcatctacttgggaggctgaggtgggaggatcccctgagcctggggagatagaggctacggtgagccacgatcatgccactgcactgcagcttgggtgacagagtgagaccctgtctcaaaaaaaattgttttatgagtgagtaagcatatataattataagtaagatcctaaatctttattagacagacatgtaatgaaatggaatagaatagaggcataatgacatattaacctgatttttgcataaaagcacagttgcataaaaaagatattgtatagtcctttatgataatgaaatgtattacatatattatctcatgtaatctgcacagtttaggaggtagatgtgatacagatgatgaagaaagaaggctgtgggcatttaattcagggataggttaaaggatagatgcaggcagtgtttacatctctctgtcccagtctgtttaaaccatagtattttcaagttagtgtacacagtggtttacaaatcagctgcatttgcatcacctgggcaccttaaagatacctctagagccttgcccctgtttcaccagatatcagaatgaatttctgggtcaggttattggaaatttacatttttaacagactcccttaaattattctattatgcttccatgtttgagagagatcttcacactaagggtctctcagaccagtaattataccattatttcaaaaaacagctaataatgtgtagggattattgcaatagctgttgtaaaagcatacatgcttacacagcctgaagaaagaaggctgcttttgcagaaagcaaaagcaaattaacttaacaactggcatagtttgaggaagggtactacacaagtagaagggtactaaatactctatgtagttgagagggtttcagaaaatgagttaataaaaaaaaaagaaagcaaggaattttacgctgagaccttctaactgtcctgaaatatttgaagggttgtcccatagaaatagggagtagtgggagtactaggacccacaagctgaagctaatgacagtgggggttaagttcagcctgagaaagaccctttagaccttagagagcctccacctccccagcctttgggaataatggtggtcatgaggtaggaagcctcacctcactgcagggttaagcagggactatataacctagtgttaatagattcttacactgatggataagttggctttatcttctataattcctattttctctatactctcctattcattcttctcaaaatacctatgtaaaaaaaacaaaggcacacgttactgatacatattttataatctgagaaactgaagtcaaaagctgaggtgagttgccaaaagtgaggcacttgctagcaaagctaagaacagatctctccttcctggtattcttccttcttaacccccttttcttcaccctacaaaccacataggtgcctcttaggaaacactaaagcacttaggaatatagcctgaaaactgctattgtaggccagtcaccttcgaacctaaaaatgcaagttcctgggcgtgcctcagattaactgaatcataatctgtgcaaatgggactcaggaatctgtatgccaggttgggcaccaccattttagacttctttccatctggaataagggacaggaaatctgatagtctcgtgttctatatactattctttgtaactgctgattgatttctatgagtgcaaagataccaccaggtgggtacctttttatgtaaagatttcaatgctcttgctttacatttacatgggcacaaatatttatataatgatcacaagtttatttacagaagtaacagatggctgtaaaggtgatacaaatgtatttgagtcaacggtaaaggttccattgtgtattttacaggcctgggtaaatgtcagcctttacccaaatattggcagcataaagtatatggatatgggaacagtatggagttagaaaaaattccctgcccttctcgtaggctctgagtaagtatcccattggattaaccagagtccacttgattgctacagtttcaatagcttgttcagacatcgattgctgtcatgtcactaggagaaaaggattaataatagggtgctcaggctggctcaatactgctgatagtgcctgacaaaagaccgttagtaggactcccatggggacactgcctgcataggaaagctacaaacaacatcattcaggatttcgcagaataatgattaactacagaacttcagcctacaaaacccaaccaacagttctattatttccaaataaattcactgcttgatcttccttttcttaggttcacagattatccagaatcagaatgtctagtggatattcataaccatgattgtgttcttatataagtcactgtgcctggactgttttcgagagatgcatttctgccaatcctgatcatggaaaacagcaagatactagaggagcttggtttggcaagtgtctcctgagtaaattttacaaaagaaatgctccatctccaataggaactctgtggcagttgtggctaatgggtaccacaatctggggaggtcaccagttctggatctcacatttgaaaaaactcaatttcagctatggaaaattaaatggggctactttgcaatgggtttcaatgttcagttgagattaaggtgaaggagggtgttaaaaggaaatattgatgattctttacatcaatagaaaagagaaaggatggcagtgctagaatgtgtggttttgttgaactgtgttgtccctgtttggcaaaggtttggtgatggaactagaaagaaggggacaaattctgacttctagtaaaaacaagaatagtctgtaatttaaacagataaaatataatactataaaattttactgtactaattgtataaaatatgggtaaaataagattactggccaagtgtggtggcttacacctgtaatcccagcactttgggaggtcgaggtgggtggatcacgaggtcaggagttcgagaccagcctggccaacatggtgaaaccccatctgtactaaaaacatacaaaaaattagccgggcatagtggctcgcacctgtaatcccaactactagggaggctgaggcagaagaattgcttgaacccaggaggcagaggttgcaatgggctgagattgtgccattgtactccagcctgggtgacagagcaagactgtgtcttgagaaaaaaaaaatgtttacttagagtggcagaaatacaagccaacagcttctctctctgcatcccccatgcttatatgacaagagttccaagttgtttgagtgtttggtttttttggcagtgaaaggtttaagggcatttatctctataactagcaatttaataagtacatgacttcttactcaagtgcatttagataattttctaagctttcataacagctttatttatttatgctttaatgcctttcctcttaagagctcaagatgctggttatttaacattttatattcagatatgaggattaaaaaaaggcactgggtgccatgctgctgtctccaatgatagctccactaaaaataacacaattaacttgatgtcagccctcagcttgttcttaaatataggtttcttaaaaatatccagactactttaattagagtcacagaatattttaattattcctaaaagactgagtatactccattgactacaataaagacatgagatagaaagcagttctctaggaacttatatatgctaatgattatgtcacattaatgggaatatgggcagttgtttaggatgaaattggtacagggctagacatggacacctgtgaagaaaactgaggccatgtgtcatctggcatgaggtaaatggcatctgagccccagatatcatcagaaatgcaaaattctgaaattcaaggtaatatgttgttcagttcaacttaattttaatcagatgcaatccaaccctggaaacctttattcagcatctgttatatgtcaggtaatgttctgagatctgtgggggtaccaaaataaataagaaatacattctattttcaaggcacttttttttttctggtaggaaagacagtcaaataaataaccacagaatgtgatgagtaaaaagcaaaattacaaatgtatgcattaatacaaaatgaataaaggagatttatggtggcatgatatggcagaacaaggatgagttttgaaatcatgcagaccctggtttaaattctggatatttcaattgcttgccataaagcttttagccttggttttatgttttgagaatggagatctcaatgtattttaaaatgctttgtgaagataaagcaaggcaagatttgtaaaagtatcgaactagttcctagcatgagaatcctaataggagctcaagaaatgttacgtttttccttgtgtgtatatgtgaaggcttcacagaggagacaaagactgagctgggttttgaaggatgaataggagttctctaagactaatggaacaatatttggaaaaagagagatgtggaaaagtggggaatatctggtattgttgatatataaaaggggaatgagcagcaaagggacctgaagatagggaggtggcagagatctacaaagaaagtgagaaatgaacataaatgtgtatacttagggaacaccacagaatgtgtgaccatggagcattcagcatcaccatggttgaaggtccataaagtaacaaattgtcctaacttgctagacaactatcaagtttgaacagcctcaaaagttagctttcacttttttttttttagtgagttcatcaaagttgctcacagactccatttagtagaaaactgcagaacaagatcaactacaacaaaactctgaatgcagacacagtcatttcattctgtgctaaggtaactgataagtggacaatagaagaatatccaagatgctgctggaaattgtgttaaagtaggacaagcatgagagaggtttaatgccatgaaatctttcagtagtgcagcaaagctgaggatggcaaagaatgttggtgttcacctcccaactccaactcacagtgctgagaacttagcaagtgtatgatgctattccactcccagaataacatcacccagaggcaagtcttgcttgtacttggaccagtaatcatagctctttctcctgctttactcatcaggagcctatagtcaaatataccagagaatactagaagatctgtctttcctacaagtctggtatgtagctcaagggaccacacttgcttttctttgagaaatgatccattgatttaagaggaaagccagcccaggattttgggtggagtggcagacacaatttgaaggataaaattcatgaggaaccatctgaaaagatgttgggccttttaaaaatagttacactggatgtgatgattgtaacatttcaaagtcaagggagaaaaatacattcatacatagagttaacaaggttaagcaaagctctttaaagttgaaaatgctttccgatattccttcacttattcaataaacatacactgagcaccttcaaagttttaggtactggagagacaaagatgagtaaaataactgctgtgaaggaactcagtctagaggagaaggggacagaatgtaaacaaataactataatgcaatttatcatttgtattaaggtttctacgagattctttgggagcacagagagggtaattgtttccaaatcttgaatattacattactattattggaatatacactatgtagaggtttatataccacagtaggttcttgataaatattccttgtattaatgaatgaaaagtaatcaatccccaaatataaatttctctatcatattaggttacttaatcacttaataagattacataaacaaatttaaagtacttggtgtaaatctggcaatttataaaatgctgtgagactatggaagactgcttgccaatggaggaggaggaacgaataggatgttaactgagactgcgaagtttgagctaaatcttgaaggaagagaaggaattcaccagacttacaagtaagaaacaggattccagacaaagagaaaagtatctgctaaggtgtgtaagagtgtgttttacacttgataagtcatttagtatatctgtagacataggatgcttgtaaggagagtcacaggaaatgaggtcaggaagtcaaaatagtaatatctactctattgtcaagtagttacatttcttactatgtgccaggcactgggccaagcaattcttatgcattgtatcatgtaatcttcaaaacaacagtaagaggtaggtactaccattatctctattttatgaataagggaacttgaatttggtgaggataagtgactcactcatgatcatacaactattaggtcatgaagttggatttgaaatccagttctttctgactccagaaaccatccacttacttgttgttagttccaccttacgtattacaagggtatttgttgtgccctaatcatttcaggttcccaaatacaataagagaatgtcataaagattttcagggctatggtaaaatgaggaaaataaggactacatagtgattttttccataaagttgtatcattattcaatataagagactttattcctaacttgtgttcttcctattttctgacatcaaaattctttttttgtttgtgaaatcacgtagctagaaggtggtagtgatcttaaaaatgttctggtcaaaactgaaaattgtcaatcccatgatactgttccaaacctataaatcattgctctaggccatgaagctatgctgccttactaaagattgtgtaagccatggtacagcatttaaatttatgctacaagcaatgagaggtcatttaagtatttttagcagtaaaattacaaaatttgcattctagagggattattcttttattagcattgaggatgtattggaggaggatgaaagatagggagattaactggaagatgatcatggcaatccgacaaagaggtgatgagaactttgaactaaggcaagaggagagagaaggaatggttttaagggattttgaagaggtaaagtcagtgggttttgtgaccaatgaaatgctagttgtgcaagagagatagaatctaggaccattcccaagtttccaatccacaacacattgaagggtggaataattcctaagattttgtatacatgaagaagactgggctggtgaagggaaagattgatgagtttggttcagatttttttttttttttttgagatagagcctcgctctgcttttgttgttgttgttgttgttttttgtttgttttgttttttgttttttgtttttgagacggagcctggctctgttgcccaggctggagtgcagtggcatgatcttggctcactgcaagctccgcctcctgagtacaagcaattctcctgcctcagcctcccgagtagctgggattacaggcgcatgccaccacatccggctgatttttgtatttttagtagagacatggtttcaccatattggccaggctggtctcgaactcctggcctcaggtgatccacccgtctcagcctcccaaaatgctgggattacaggctttgacttcaaggacaatcagatgaatatgattttaaaatattgatttctatctcaccaagcttctggggacaaaaagattatctttcatgtagtcatgaaacttgacataagtttgtttatttatttattttgagtttttttttgagacagggtctcattctgtggcccaagctggagtacagtggatgatcacagctcactgtagcctcaacctcccaggctcaagcaatcctttcatctcaacctcctgagtagctgggaccacaggcgtgtgccaccatgcccagcagtctccctatgttgcacaggatggtctcgaactcctgggctcaagcaatcctcccacctcagcctcccaaagtattgggattacaggtatgagccaccgcgcccagttgagataggtttaaatagtcaaggcctaaaaaacagactttgcttcatgaagtaaaaaattgtaataagtgcacaaaattaatcttaggcatggatatggagctccatcacatgactactattatattgtgatccttgtcacactttatttttaagatgactcagagaaacagtgaactggcgaaatgtttggaaggctagtaggttattttggccctgtcagaaagaccaaaataatggttataaagtactttttgagatcttcaaatgaaagatgcccagaaaaagacattattaatgttgactatgaagatgtagagacaggtatctttagttatttgaaaaagcttataaataaaagacaatgacttagtgacttgaaaacagaaatatctggccttacttctgattttctatatgaatcataacaaatcaaatgcaccctttaaaaatatgaacacttggggtgaccacagcttcctgaagacagaaatgaatttaacacaataaccatctctggacagtgaaattcacattccgcaccaccaccagcccaattaaagggaaagaatttcgacttgacaatctgcccttcagtatctcagacccaggctgagggcagatctagtgacctcctcctgaataaaaaggggaaggggattgggcagtaaattctgtcctggcgaacatcagcctggcagtaaatcggaatcctctctgtgccctctttattatcacattcacagcatgaagttatgagcttcctcacagctcctgctataaaaatgtgatggatggtagggaaacctcagggagttaatctattcttccattaaattttactttaattggtctgtgagtcaatcagaaactcactagacagtgaattaagaaagaaaagagtgaaatagaaaaagctttcttttgcagttactatattataatgcagaattattcttccattgaaagaaaactgagaccattggtccatacaaataatccctggctctgtaaagaaaatgagagaaaaacaggcaaccatgaatcctactcactggtgacattaacacatatgacattacacatactcacacgtatctcaccaaggaaaagcaggcttctcagaccccctccacccccaccaacagtaattagaatgagagagagagagagagagacagagagagagagagagagagagagagaatgaacttgaatcatggcctctaagaaaattaatacaaagaaaaataagctgttgagaacctctatcatcagtaacataactctataggtacaaaagaaggtagatgttaaagaccaaaggtggatcagctgaaatgttcatggattcagttagtaaaatgtttgtgcagtatttaaggccataatgggctctgataaagattctcagaatctaataatggcctctctggacttcttgtctaattagtggaataaggagcgagccagcttggaattgagcattgctagatatgagggagaagggaaaaaaaaaagccaaagctgcaagaaaaataaaccagagtaaaggagaagaaaaacaagagcagccagtgctttcagaactgctcctgagctgacaactgaagtttatgccttgaaatatatgataataagattttatgggagtgagccccagggacccaaatgtctctctgtaaacaacggacctcagggaaaagccaaggtttgagtaatgtactcagtctccactcatgataaaaaaataaaaaaaagcaaaaaagcagtgaagacaggaaataactccttttattctaactgtagaaccctgagttgcagcaaatgccctctgagggcaaagacaatcgacaaccagtatagaaatacagttgtcccatattcagacaagggatttaaacctcagcagcctcaaaaacctgaggttgtatgagaagaacctagtaaagtgctgcctgtccacccttcacacatgggcaatatatgtccagaaaccaaatggtttattgtgcagtgttgttccagtggaattactggagggacatcagaatgacctaatccttgaagcatgtgccagttatcccagtgctgcaaagagttaaacctgaaagtgctgcctgttcccactcgttcacaatccagattacctagaaagatattaccagctgaactccacacatagtatgatggcttcctttgaagacttgggtcaggtaaagctcaaagttagccttaagcaactactaaacgatgaaagtccctagtgtactctgagactaaatcaggttgcctttaaaattcttcatcttcaaagacaacagctctatcctctttttataaatgtgaggccatgagacagcaaagtgctatttctactggcattagttccaccttatatattaaaaagatatttgttgtgccctaatcactctgggtccaagatcataagggaccttgtttcttggtgggaggctatagtgtgaaaaggttacttagtcatcactagcctctagcaatgctggaacaccacacatggggctcctcaaacaggaagtcaaagccagttctgacccctggatgaactctgcattttcgggcaagaggcctgatgaatctccagggacagtgctgccctgtgtctctgtgtccatatgtatgtgtttactcctctgtgtgcatgtgtggaggtgggtggtactgaagggaagcagggtgtgaaggttctggataattatgaaaattagatcttttacagcaggcttcaagctcaatttgggctgacagctcatgaacagatcatctgaagtcttaataggccaatgctagttcaatagttgtatggttaaatcatgcacatttgtgcctcagctgacacaaaaagcagacccagatgcctcacatggatcatgcagataagtctatatttaatactcttcctctctcggggaaggcctaacaaagcaaaacaaaacagatctaaaaccatgcttaaaactttcaccagccaaagaaacattccaacattcttttcactataaaacatctaatagtagaaatgatacatgattgataaagtgattctaaatatacttaattctggtgtcttttcaaaatatttctgaacccagcagtaacagatataatcttccaaactgggagttttttccatttttagttacctgtcccaaaagcacttattctcttactttccattctttgctggtagttttgtacaatgatgtcaagatatcaaggctcctgacacatcctgaattctgaaagaatgtgcttcctgaatattcctgataatgggcttagtatcaaaggggttaatgaggttgagttaagacagcatttcctgcttgaaggagaactgagtccaacaacactagaagcattttcttattatttttctctgcgtttgcagtaactgcttctcctggaagctttacctgggggaagggataaagcaatatcactaacctgcctggcatctggcttccagcagggaaagaggctcatccacctcacccctcgggcttctttaactgaattagctgtattaagtgccttggtagcccagggaatgaacgtcgttgatcagtgtgcctagaaaggcatgttttcagggtataattctgccggaggagaatggactccccagcacatgggcctaaactgcagagtaacagagccctaaatctccagttacagatttacagcctccattctccttctttactgcaaatacaatccggcagtaatggtctaacacagcaacaccatcaccaactggctgatggctcgcataaaagcaatgtcaaccaaaaactatgagtttataaaagggaacaaaccctcaacagtgacaagaacatgaaacccattaacaatttaaacactctccattttttatttcccaccttgaagctattattgctgatagaaagctcctcagtggagttaaccactgcaaggaagggttaggaagctagcttaactcctaagacaaggggttatgtggtttgaaccatttgatggtgtggtttgaacctttgttaataggaaggccatttgataacctgtagtgcaaaagaaggtcttagaatactgtaagtgtgataggatctcccctagtaggtctatcaaattattctcaggaaccacactgaataaaaacggttagaattggattggctagtctattgaatatgccaagacttgagcctgtactgtaaaaggaatggtagaatattttttggagaaagttctgtaaaaatcaagaatcaactcttggcattataacaataaatgcttatatgaagttttatttctgtgatagctctaactcttcgaaggaacattgccaccacaatatttccattttgcaaattgactatacctggactgtgatgtaaaatgtaactcgtcacacactattaccttccagtctttaggtaatcagatacaaacattataactaatttctcaacttaactacaggactctcccatttaaaacaaatattactgtggaattctctggtgaaaaatgcttgagcaagccatctccctccctgccctttcaaattccctgacttcccctagtaaaaataaaaataggactttaaagagatataataagcccatgattgggtattttacccccaaaacaaaacttcttccctttgttctataaatcagacaaacccaatggcaataagaaagttgttctctttgtggttttgagctttttgcatgtgtaatttgtcaaacagttcatcttttggaaataggatcttcacactaaaaaggaacaaaatcctgtttttgcaaaggggaaaaaaaggccatgttgaacatggtaacatatatccatacgaatagtgccaaagaacttaaagtccctgatttacatatattgtgctgattgtttgagcatcaatataaaaaatttaatctgtactaatgggcctggaggaagcgcaaataaaaccgaggaataagtacttgttttgcagtacaatgaatgctattaatatatatataaaacaggcttcagtgatgcataagctattgtattctaaaaatattcctacatttttggcactttaaaaatgtattacctcacaaaggactatcaacctatctgcagactcttaacctgggctagcattaagaaaggaatcatttcattctgcttttgttacatgtacatagattttgaactaagcagatatggcacctgttggttttaaatgtctcctcctctaagaaaaagaaagaaaaaagttcaggagaagaaaaagaagagatgttaaataaaagacaagaaacaaggaactaagagaataaaattattttccccacagtgtgcaatgaaatcaagctacactaattctacttataataatgttagaaaatggttagccttaatgcctgataatgaccagagctaatgtggttctgctttcagtgtggataatgtttaaggaagtagcagaatgcatggcagctttcctggactatacagtcaactccaatgaagccttttctccagcttgagtcataaccataaatactgccccatccccacattccagtaacaaagtccttccttcctcctttgcccctaaacaaaggggacaacagtgtgttcggtgggaacatcttgaaataagataacactccccaaatggaaggaagtcacaggggagattgacgccataaaggcagttctatcctattgaaacgccagcagatggggtcataaacatttccttctccccttgctaacagccaccaagtcagcttcatctttatctttatctttatcttcctgtcaggtcataaatacctctcactcaagcttcactcacagctgggccatgccaagcaagtttacttcctgttaaaggttcctttcagcaaacattaacaaatagttgggggaaagaaaactgaaaattctgctgatgatacacagttataatattccaaaggaagcttggaaacctcaaagaaagggtttggccagactaagaaatgaccaaactgcctagcaaaaagcatggagatccacttaaaagaagatgcgttcacagggaaaatgagtcaaataattagttaaaacttatatttacatccaaacaaaataaaagagctgaatagtgtcatgggctttcattctttcttctagaacctccaaatgatgcatggatgcttgccatttgttcctgagtctaaaacctggaccataatcgtagaaaatgaaaacagaagatttctaggagtagtaactcaatacaaagtcatgcttaggccaaaggttagagaaagaacacacccctttactttcagaattttggctcatgaggaaggagtaacctgactctctttccttcctggggaacagttttacacttgggaaaccatctgcctgaagtactgctggcagctccaaaattatagaatctaaaatggtaggaacctggaaaatagtaggtatcttcctccttgacttggctggagcagctgcccctcttgaatttctgggatataagattacaaccaaaaatgactgtagtctttctaaaacacaacccacaatctgatttttttttcttttttctttttgtaaaagcatcattttaaggaacacattctgacaaaatagttaagtcttttaaaattacgatagtgacaggttgctgttgattacgagaagtagacttttgctccaacagggattgtttaaaagtgcctttattatgctttagaacgactgatccatactggcttatttcactcaatctttcaatttttacatgtgcttctagataacatgtgactttaaagagagaaaaatgaagacagcacttactataataagttttctatggtagttataacaaatgggtttgaattccagctctgacactttactagctgtgtgactttgggaaagttacttaacctctctgtgcttcaatgtcctcatctataaaatgtacaataagaggccgggtgcggtggctcacacctgtaatcccaacactttgggaggtcaaggtgggtggatcactggaggtcaggagttcgagaccagcctggccaacagggtgaaaccctgtctctactaaaaatataaaaattagccagtgtagtggtgcatgcctgtaatcccagctactcaagaggctgaggcaggataatcgcttgaacccagaaggcagaggttgcagtgacccaagattgtgccactgtactccagcctgggtgacagagctagactccgtctcaaaacaacaacaacaacaataacaaaaaacaacaaaaaaacccacaaaaatttacaataataatgcctttctcaacgggttgctataaattaaaatacataaatcacttagaacagagcctggcacattgtaggggctctgtacattttaacacacatataaaatggaagacttaggtaatttcattatccgtactgtatctaaagcaaaggatattggttatattcttaaaaatctttaattaagctgaatattatacttcagactagcattcaaaggtttccaaaaattaggctggtttacctttactgtctcctctcatcatcctcctacaattaagtaacccttgttagaccggactatttggtgtttcctgaacacattctacatttccccacacctacacctttgtgggtatagccccgttgccctggagttcactattctcacttctatcttcccctatctctacctgttaaaatcatagcatagcagaggttctctcattcaaaccataaagctttattttattttttatttttatagtcatccttcaaagcctgattcaaatacggttcttcatggagttctagagctggaagagctttagagactaaatgatctaatttctccttttactaaggcatgcagagattaagtgatctgcccaaagacatcaagctacagcttggaccacatttcaggtctcctaacagtgcagagatctctgagagttaatcacccaatcctgctggtctttttcatcactctaatctaaactgactgatctccttggagctgctatgtacttacagtacttatcacacagcctcttgaatttcagttacttgggtgcataacttatctcccacgtcatctctcatgtgcctttgacacctctgtctatccctggaatgcttagaacagtcttaaccagaaggcatttagtaaatatttgttgaattaatgtatgaatgaatgttagaaagaaggaaattaaacaacctttcccatccccctgactcatacctctcgcagtctcaaaagttctctctaacccaactatctgaattgaaccatcaattctagtgcacaataaataaatacctccacatctgcagaaaagtgtcactatacctaatacatatacacaaattcacttactttacaaaagtctctgtgtactcactgtgtgcatttcacttccaagtatgcacacaatttaccaaagaagtaggagaccaaaccctgccttcctattagtcacattccattgggaagacctgtatacagcacaactagacatctattaactaagcaccatgaaagcatggacatgataacgaaggcaaatagctagaaaaagggattcagggaggctaaagaagtagtagttacagaggaagctgccaatactatgcagcatatcttatgctgtctcttttatggggctgcaatttgcaagctaagcccaatacaatttgtttccttctatccaatacttctgatttcttttcctctatcattcattttctttactcaatgatttaaaggtaaccgtcttttcctacctcacaaaagttttagttgctgaccaaagtttgactaaatatcatttcacgtgtatttttccagttggagatagtaagtcatagtaacaatacatacaccacctttaatttttcaaagtgtttatatatatattttttcatcctttttcccccagtaaactcagcagggaggtgtcaagtgcaaaccgcatactatagatgcatactcgatgcataacagctacactttaattttgcaacactgttctacttctttcctggaatctctcttcatgaatttcctggaaagaggaaagcagaagaaaggcatatctctattacaatgacctgcttattttctttatcacactaatcacaatatgtaattattttatttattggtttaattctttattgtcggtctccccagtagaatgtaaaactcctcaagtttactctccttaaatgtaaaactcatctatcttattctttcattgtaggcactcaacaagaaatttctgaatcgatgaatgaatgatcaacaacactatttctattaaggcaaataggtcatgataaaagaggccaatgaacagacctcatagtgtagaactgattagctatatttttacccatttattcttccaaggatggcctgcgcaggaacaggtagtcttcttagtttttacttttgccaattcttcaccaagtaattattattttctttgtatacggtactgtatgaaaaactataggggaggatgggcacaggtggctcatgcttgtaatcctaggactttgggaagccgaggcggttggatcatctgtgatcagcagttcgagaccagcctggccaacatggtgaaactcaatttctactaaaaatacaaaaaatagccgggcatagtggcatgtgcctgtaatcccagctactcatgaggctgaggcagaagaatcgcgcgaacccaggaggtggatgttgcagtgggcagagattgcgccgctgcactccagcctggaagacagggcaagactccgtctcaaaaaagaaaacagaaacaaacaaacaaacaaattgtaggggataagaaatttaagacataatccttgccgccaaggagcctatgtgattacagcaataccatagtaatataagacagcaaatgacaaatgcaaaaaaaaattatgcagtcaacatgtgatatcaatcaacaaagggagaaactgccttagattgtgtgatcaggaagggctccctgggagtggtggtagtatctgagttcaagataagtttaatttctatcaatgaacagggtttaatagagggcctttaaaaaaaaatcatgttatgtcttaacataccccaagtttagataagaacatttaattaggccggcgcggtggctcaagccagtaatcccagcactttgggaggccgaggcgggcggatcacgaggtcaggagatcgagaccatcctggctaacacggtgaaaccccgtctctactaaaaacaaaacaaaaaaacaaaaaaaacccatttaattaaataatataaacactttgagatcctctaatagacaataacttgtcaatgcaaaatagttctattagactattcaggtggcctccaaagcaagtttttaatggctttatgtatgtttaatcacactcagttggtctagcttactcagctttagtcccattagaatttaaaaggtcaagtttcaaaaacctaaaaaggtgatttagaatagaaataccagcttaaccttagctacggctaaactaacattataatagtattgaaaatagtaccttatagaaaatacatggacaaaagaagaatattaaaactttacaattcttggctgggcacagtgcctcacacctgtaatttcagcactttgggagctgaggtgggcagatggcttgagcctaggagtttgagaccagcctgggcaacatgatgaaaccctgtctctaccaaaaatacaaaaaattagctgggcctggtggcgtgtgcctgtagtcctagctactcgggaggctgcgacaggagaatcatctgaaccccggaagtcgaggctgctgtgaaccatgatcatgcctcggcactccaggcagagcaagaccttgtcttaaaaaaaaaacaaaacccggaagccccccgcaaaaaccacttcacaattctttcctaaggttatattttaaaagtagaatttgagtaaaatttaaaatcacaattggaattttactaaaaattatgactcactgatagcttttaatgcatattgcctatctgggagggcacagaggccttataagtgagtgagaaagatgtagacctaacagcactgatagggagccatctcttgaaaatgacacagatctgttacagctcagaagggtaagagaggagtttaggagcattttctaaagcttgctggttggagctgttgctttctgcctgaagcatcctatccagtctcttaccctcactcatgctgccattaaaatatctcctgccttttctcacatactcattcctcaatttctttccctaatatttacatctcatttactgcaatttcataatgttttatattaaaatgactccaaactgttataatctatgagatctatgttataagctgtgagattataacagtttggagtcattttaatataaaacatattatgaaattgcagtaaatgaaaaaatacatatattttgctgccatagacagtttttttttttttttttttttttttttgagatggagtttcactctgtcgcccaggctggagcgcagtggcatgatctcagttcactgcaacctctgcctcctgggttcaagcaattctcctgtctcagcctccctgagtagctgggattacaggcgtgcaccaccgcgcccagctaatttttgtatttttagtagagatggggtttcaccacattggctaggctggtctcaaactcctgaccttgtgatctgcccgtctcagcttcccaaagtgctgggattataggcgtcagccaccacgcctggccatagatagtttttttaagctgcccctttcatcagtcgaaaggttagaaattagtctaaatatgcgatcttctcgtttttctaaaaaaaaatagtgttttggcattatttaaagtaataattctttatttttataatcatctctgttatataactccatctctcaggaattatagctccatttctgatatttccacacctgcagatatatagaggagtaaaaagtggattaagaaatgtcaccataaagcaagcaaagtcctgagggagacagtcagggagacaagtaacttaataaaaatggaaggtgccaaatggtaataaaaccaaaatgggaaatcatgaaaataaaataactatgcattaaaaatatatttgggccagctcctctgaactcgtgttttgtaatattaaccatttaaacctgcttaaaatgagagctttgagttctcaaaatcctttaattcggttaaacatccgctaccctgaaaggactccacagcatcccataaaacattatttatatgtgtgcgttaactgcacgatactgtaatttccagaataaatgctgggtgtaaattgttgtttatgttggatcctgactgtctttacgagaaacaaagtgaaaacggaatcttcacagctttatttcttccgttaaagtctattctgcagcaggaaacatgcctagtggagtttcttaatgaacacttataaagactgttggttaaaaccaagtatatagaatcacctccaaatgtacaccctcttttattctacattcttttcatttaaatcaagttaaattaaagtgaaagtagcaccattcacattgttatagttaagggtctgtcagcatttttatgcaaagccttgttgtcacaagtttataacttgaaagggacaagaaaatgttttttaaaaagaactttaatacagagaaacttggcctggaaatgaattgctgtattcatttatctttaatgactttttaaggtccatcttggggcaaaagatatagatatcctagtgatttaaaacatttggttgggattttctttgttttccaccataatagctttcaaaggcatttcagctataaaattgattaaaacatgaaattctctatgtgcatgaattttctaaaggacattaaagattagaaatttcatgtatcacctcctgacctgctgccacacattcaaaacacacaacaaaaataattaccttttcttacaaatgaaaaatcaggcatggagaagttacaaaggtttcaaagtcgaatatgcatagaactacgtaaaatttcaaaattatcttttaaattatttctctggacacttgctaattatttcttcccaaacaccattgctaaattctaaacaagaatagatagtcttgtgatgcatgtattaagtattcatttaacatttattctggaaaaaaataactgcacagattttaacgctaagaatttactgtgcctctgcagcagctgctctcacctgataaaattgtgatgattctttctgagcgattatgacttatcaggtcagtgaccaacaaactataaaatagattctaacagcccccaaagggttggtatagactcttgagtaaataatatatgtaagcgagaatggggcagagagagagagagagaaacacaaggagagagagaaataaagagaagagcacacacatgagtgttataggacaggaagacacagtccttgattttaatcccagttttctcactcagtagcacttcttgagaccaaaagtcagataaagagatagtactgtttttagcaagagagaggtcccatagcagctctatagaattttctggtatatgttgttttgcgctggatttcatccatgaacttgttactttgcctgtactttacatatatatctgagaaggcaaccagtgacttctaggaaaatccttaaaatgaactctagagaaggaatatgaggatagtacattccattttagtgtcttgttctacttaagaccttaatgaatagaattgctattcagataagtttacattggatttaaaggaattcaaggaaacctcaataaaggaatcagactgtgtgataaaaatggccaaagctctaagctagtgtgtgtgtgtgtgtgtgtgtgtgtgtgtgtgtgtgtgtgtatgtgctcatgtgtgtacagatccagctacttacaaccacagccaatatgagggaggaactttgatttatatactgtacttaagtcaagttttcctaattgcatcagcttccctggaggtctctgctgctttattgctggagtagatgctatagaacttctctcgggtttaatggcatagtaagagttgtatttgcttttcagattttgaaaactggatacaaattgttgtctaggttttaagaccacagattgagtgacatcattctggtccccagtgggaacatgtcactgtggtcctctggtcactcttcacttaaagaactgcaacatgaagtaagcatgataggtttcaggttgtgagccatcctagctcttactaaaggggggctgtcaatctttctctggagatttgcaaggtgggagtataaagagaggctaaggctgaggcaaggatgaaatggtttctacgagtcccctctaagattccagggggacacttagaagtctaacccttaaaactttggattctttttttctgagtctttttctgggccttcaagttgtggcaaggcctagaattaagaagcaaggggaaggagggagaaggaaagataaatgtaagaacagagatggttttccagagatgagcatgggatatttgccaaacaatccacactactcttgactcaagacagtgctagcagttttatgagcaatggcttcatttctctctaaaattacacgtggcatttcttggtgtgattttatagagatattatggttgttgttttctccaagggaatccaaattaggtacggattaggatggctacaggatacttctcttaggcataggtgccggactcatctctccccactgaacctggaccctgctgtgttctgtaatagacctcttcttctatacgactgtggaagggaccagagccaatgccacctcatgccttccttatctctctctgagagatcaagagatgctctggctgccaccaaggggaggaaaggaccagagttcagataaacttttgataaagtgccatagcaaacccctcatcagaaggcaggaaaggtcacacagtaaaaaataataataagaagaaaatataactgctttcttatgaggaaaatattatgagttcttcccctttttcagcttttatggaaggagattctgccagttccttcagaaaaaaataagaaaaagtagttttaaaatgagattatgcaccttcagggtgccattaggaagttttactgtactgagatgacatgaaagctctggaattaatatccctgagatgcttcaaacctgcaatagcaattattgtactacgtgtccctggataaataatagggccattcaactaattagcttcagtgatttcaactccctgtaaattctctctcactcggctataaaaataacactaggaaaacttttggtaagagaaacttccttcaagagatgttttcttttccttttttcccccttcagttcataatgtgcaatgtgtaaagtaactttcactcctaatcacaaagctagaatggaatatgcaaaatttgcacattattaattgccatttactgctactgaacatattgatttaaatctctaaatcttgccttccacatatgacataaatgtttgagaaatttaaactagtttcttgatacatagtataagcaatcatgtctgcatgggcaataaagtataaatcccaagtgcacatatatatagatgtattgttaaagagaaacaaaagaattacttaagtccacactacaatatattatagccatgttattttagagaattttgacaacacattagcttttcaatggtgttcatggaatattaattcattctgtcatatttactgaacgcctactagatgcaagatgtaaagttgcttctgtatgttgtcttagaagaaaagtagatttatttaacttaaacatactattattcctgcttaagtgacaaggattctcttatacttctgtcacctagaaataccataaaattctgcaaattccaagcaataaggatgtaaacttcaataatacaagcaaatacaattctaacatcatcagcaatggtctgaaaatctatgatatgatcccaagagcacttgaattttcttatagcttgggcttttgttttgtttttcttttttcctttgggtaagctgttgagatttcttctttccctttcatggaaacttctctacacattgaaatgaatcagaagctcctcccctggatgggctagtactcctccttcaaatgctgaacgtcatcacaggagagacagagggacctagtgaaaggcagatggtgataagctcatacttggtgaagaaaggaagaggaaaagagtctgaaacctcttattgggcttatcttgtttttaattaacagaatataattaaaattcaagccagacaaaatgactggatcttaaatcagaattatgtctaagagtggagactgcagtcatctgtttgcactcattaaaggtgacctccactactttctgggtctcccattttgcactgctacttataggcaagttctttttttatttcttagccacataaaaaaggatttttttcctttctgcaccagtactaactaaatatatatatatgtatatatatatatttacatatagttgtactgcacattaggataaagaatatggtataacaggatacaatataatagatttttaaaaatcttgacctttctctataattattacattcaaaatgattcccctaacattgataatcatgtaatctggcagagaaactaattttccagtaaaaaatttgaaggttaaagttttccctaacttaaacaaaacgtggctagagattatagtttttgttttacaatcatcccacaatattcaaacattctagtcttactacctcaaaatctacacctaagagctatctaggaggtttgtaatatcaacccccataatttttccttcgaagagatctgcagcctcagcttatgaaaaatgcagtctgttcaccctaggagaatataagtcataacgtttgttttggaaatctattttacccaatatttctcaatgaaataaattgtataaatgaaataaaactgacactgcaatatttactaaatcactaccgtctgctctctgcttaacactctggctatcattggtttctccttcttcagtttagcagccgaaagagcaaaggaaaaaggcttctgcaaagatgcatttttaaatcaatataaataaggttataaaatagccacacttagcatggtttcctccttccttgtcatccccatgcatttgtcactttctcactggcttctcttcttaataatgtgcattcttcagtttaccaaaatgtgtgtgtgtgtgtgtgtgtgaggagttcacacatagaactagggcaaaaaggtccagagagtagtgtaagagagaaaaattcaagtaaatcaatcccatgtaaactttattaatggtctgatattacatacagactgaatgatgaaaaaattgttaattataattgacattcttatttgaaaataactattaataaaaatgaaatatttaaaggtgaaagtggttagccaaaagatacttttaaatatcaagtctacaaataaaaagaaacaaaaatattttcagggccccgaagagcaaatgttccttttagtctgtggcatcacggagtcacactgttacattgacaatgaaggagactagactccaccagcatcctagtcctagttttcaggatagctgtgaggtagtgtacaaagcctcatgcagagaaattcccctttattctgtggagaatttgattcatgaaggagcaggactgatctgtttatcagtgctgagaaagtcttgtaaaggacattgcctatgaaaggagagaaggaaggtaaaaatgggacaggaggctctgagggctcctttggcaattgaaggtaaggaaggaagaagctaagctataaataaaaaatatttctagaaatggtatgtggatgatgcattattaatgatggtgaaatacatctcaatatggaggggagagtggccacatcttaagatggaatagtcacttggtccaaacactgctgatgctcttgtgattttagaaggatgcaaaataccccctaaagtcaaagaggttttaagtgttcacatgtctacttgattaagcacaaggatgatactaaagaactaatatgcaataaagagatgaaaaaacacacaatgttattttgataatctcaaatgtttaagcctcacaactgtatgagagcctagcttactgtcatttaaaattttttttttttgtattttaaaaggtctatcttaacttttaaaaacaagtctcattacctacagagtctagaaagtactgactgtagcttgaggttatgaaactgaaggattcctgacttactgttctccattttaaccgctagatgtattttctgttaacatattctggggttaaaaaaattggcctttttcacatttacctggattcccaagtatgtatccaaacagtatttagccagtttactacaaacacaaatcttacatgtggagctatgtgtgaaggtattataattatagcagtaatgcaaatatggtaaagaggaccaaaacaggtgacagatggtcacagacttaagacttataacttaaaaatgcagcttcactttgaaggatgtattgtggtacatccatggacattcagaaaatttgtcggaaacttacaaagaaggaagatggttagcagcttaatatactcttttcttttcttttttctttctttcttttttttttttttttttttggttatctagatgggagatttagtcctggtgcctgaatttgagggtctctcacactgctcatctcaacaatcaatttttactgctgtagaagataataatggtaataacactatagaaaaaaactaccatgacctataagttattagtcttttaaaaataactgtagtgtatgcagcttcttcatttcctgaagtagaagagaagctgatagttggagcctctgaagctgttcatatatctcctgaatgcatgcaagaggttgatttgctcacaaaggaagagcagctttgagaatgggccacatggatgagaaaagcgacccaacattagaaatctgctgaggacaatcaccttctggcccacctgtcttcttgcaccaagttccagcaaaaagctcgcatcatgacacactagtgctttatcatcctacaacaaaaaaaagtcaggattcgaggccagttaaagtgatgctcttaggtagcaaattgtcagtattcccaaaaggacagtcctctgatggtgcttttgatactgaaatttcaaagatctctgttcacctgaatgacatccataaattaagtctcccacaaagtccaaaatgttcttctattgcatttaacagagaagatacaaaatataaaactttatttcatgtgtgtgcagatttccatatgcttaacaagaactcacctggtttctatattatgtgaaaagattgtccttataagacaaattatattctagtcactttcaaatgaagtggattcaccaagcacacagtttatctcaggatctggaagccttccttaaagcatgactgtgcaacaagagttttaatgccactccactctgtaatgcactgcatgttaacaagatttatatacattactggtgccgttaaggaaacttaaatgacttgcagtttctctagatgagattttaaaaaatcttaaaaagggtgtgtagcatacaaatgaaatcagattacattagaagttgtttaaaagtacaaacataatactgcttgtgtaccagctatggaacacacagcaaagacttgttttacttcagacaagcattctacagtcactgaacataaaaaaccataaagttacagctgcttttaaaatgtcacttagggacaaactgtatagatgggaaattagatagtactgaatggttctggagaaggaccaggcctgtactctgaactcctaactctgcattcatgagaaagaataaaatatttctcatcactaatcatgttttcatatgtaggtacctgtacctacaatgtgatccaaataatttatcagattcagaatgattaatactttccaaactatacttaaaattgagtctagttatattgtatgaaaattgagaaaaatgaggtagatgatgtttgggtaacaattaaaattttaggcagatgcttgaatgtccgtaattttttaaaatgggggactctacagtacatgctgcaaaaatgactcaagctaggattttcagaataacctatattttaaaagtgcagaacaatgtcaaatctttaagctttcaagcagaggattcgcaataaaatgaaatcattaggcaaagagtggtcactgttacgataagaagaaaaaataattcaaaattctcatatctattattatattagaatagttcactttcttctctacataataacattgggtattaaagagccatttatgcataccttattattatttatgaaattacaaatacacacagtgtctgataactcatctctctgtattaaataggaacatacattgttttttaaaatgtctgccttttacaatgtgttaggtaacagctttccatagcgtaatcatgaatgcattatataatgtgctttataagaaattattaaggattatgactatagcaatgtaattcgaatataaatatgaataaagcatttaggaatgatattttcacttagactgttacctacataatttgcagcaatacaattatcatagaagaagacatacatttacagaaaaagctgttgctacgaatgttagtaaaaatcctataacgtaggtgtttttctagcaacttcacaaaacccatgcctttaaaaacatgaggagaatccacaatgccacctacagttttcttgacagtaatcttgccttggcaggaaaaaaggtcagctttatttgaaaagccaggtgcatgtaaatttccaaactgcaagtaggtggcagtggagacatttctggatggcccttctcagttggaaatgtaaaaggaggaggaagcttccttaaaaacaagttaaaaacatactaaaataaataatttcctgaaatgtaaccttccagatcaccattaagagctaataaattatttgtctttagggaccaaaatcccaccaatctcttaatgaagacaaccatagcatgaaaagtgagcagcatggatgacaaaattagaaaaaaatgaaaagagagaagtgttggacaattgtttcccacaaatctaaaagaaataattaggaatttgatgtggacaagaaactccgaggctagcagcatgaaatacataaatttaaaactagtaacttagcattttaagaagccattaagaaatctcctgtttgaatgtgaatttaagagtaagggagatgagtttattaggatctggtctttaatgaagaatatcaattgagtccatcaaaaaattgtgtacaagaggctattaaacaatgtagacatatttaaagtgtgctcaactataaacaaacactagaaacattagaataaaaccacctgaattgtctttcaaggttaatgagttggcatttagattcattccattctcaagtttacttgcaaagataagaagggtcattaagttgtattatcggttcaatttaattgatttgactcgtggacatcatattagaaactggaaaatgcccaagaataaacactggaggggtgtgtgtgtgtatcaatatacatggaaagaaacaggtaaatgtgttgtaagatggaaaaaaaggaagttaatgacattatttatatcggaatcaccacgtgaaaagaaatcaaggtaaacgtccagatcaaagctttttcacaccatgactatctcgaatcagcttttctcctttccttaattggttaaccacacacacacagtttaacaacaaaggcaaccaagtggtcaagggatgcaagaaacctggtgaaaacaaatgccacgttcttagtactactgttcccctgcctggaacattcttcttctgttcatcttttaagattcacctcaaaatccagatactctaaaatgctgttcggaatccctgatgtgaatttaatcactccctctcctgcagtatttaaaaaaacttctattatagcaattatcacattttagaattagaattattatagttgtgtttggatctgaacgacccctaagtctgcaagtcctaggagggcaggggtcagtccttgacaatttttggaaaatttctgatgccatgctctgcaaggatgtttatctgaattagttgaaaggatgacttaaaaccatctctcaaaatacgccatgctttaatgctgtggacagtaaagaatctatgctttggtgaacaacagaagagtgacatgcctgtgactcactctgaatagagccttataaagccttaaaaagaaatgtggcaccaacctttaccctctccttatatacgcaggaatccttgggagctacagggttagtttggttgctaggagtaaggcctgagaattattagtgaactggcatcctggaagcagtagggggcgttttacgctgaggatgctattggaggatgtactcacagactgtgtgatgggcggtcacctagtcattgtcctggtgaccttttaaatgtaagcagcaggaagcataactcaggcctggtagcagtgatcagagtcatgggggaacaaactgtaaaaattccaaagcaagggccatactgaacccagaattctcaaattcaggaagaaacttcctaggctaattaatagagtttgttacttaggtttcccacatcaaaagggatttggtgtcgttgttttctaccctttctattccttgcccccttatggcattacaggttccttttgttttatggtgggggaaaaaaccatacacacaatgaaagaatattgaaaaagttctgtaaaagctcccctgagagagaaaaatctctggaagtcattcttcctcttggaaaggcgttggatcaatttcattcttctccagataacacataaaactcagcacaggctatgtaagtaaaagaaagtttcagtgagggtttgtttcttgctgccaagggtctgcaacttcgaattgcctgaaatactgaacatattgagacatgaatgctgcaaacatctaaaaatattagtagtgtggctgcctacaaagaagatggagggcctacctgaggcggcagagcctcttacattggagggttggagagaatcatccacctgcaggaggcccccagtcaggaggttagaagaccatatttaagaagaaggaatcacagtccaagttcggcctcaaaccagtacattttaagagtctcagtagatagcaaagagatcataaaaatgactcaccaaaaggcatatattaaaattggactgggatgcatttttaagaaagccagaaaactccaagagcatagcttcagaataagaacaacacatggttttttgggggggaagtttaataaactgcagttttggattaccttaatccatatccttaatccacaaaattctgtcattcactgttttgggcaatgtgacattatattttattgtaaagtattatagtatatttctgtttgatgagtaaaaacttgaacaattaaaataaacaatgtatattgtaatctcattgcatgaagatttgattttcctattctgttgtaaattttaaatttcttatcctgttaaaaagcccataaaacagattttgtgaacatatgttttatgagccaatgccaaagtaagagtggtaaatccctcagtcacagacataatcttcagaagtcaacacttaattattcagcttgtagattttccatgctttcctgtccctcctccttggtatttcattgcacacacacacttcttttagaaagcaggcaaacaaaagaagtagaagagatgaaactcagacttgaaggtgtggatatctgtaacattactttgaaatgttgtcagcaaggaaaaagaagctaaaagataataaaaattgttatcatttaagaatagctttcatttcaaaacagtatttcatgtgcattttttttcaaatgtctgtttaaaagtttttgcaaattaattgtggttaggatgtttcaaactaacacagtaaatagattttcacctcaaaattgtacctacttaaaaacatttaaattttacttaatactgacttttaggttgattcttcagtaaacaaagtgagagcttgtcattaactaccagcaggtggtggtattcacaaatagggtacaagaaatactgaaagggctatgagtataaccaatatgtggttcagatttatggattatggattttaaaacatttttaatggagttgtcagcacactgaaactacttccattcccatctgttccatatgaatgtggaaacttggaagtcaccttaaaatatgtgcctgtagaaagttttgcattaagaacattgggtctctttataaaagcagacaaatattttctatttttaaatatttaaattttctgtataacaatgagcttcaaacatgcacaagtatcctgactcttccaatattttgggggcctctaggtttagaatctgatctatcttctattcagggcagacacgtatcaagagggagcactgactgtatactttagccaagctaacctgagcaaatgctgaatggtgggcactgtgcacacagttgctatggagaaaatatgtccgttcttgtctccaaaaaaaaggtcccaggtttcagaggatacagaagcaacaagaggcggtgaactccagtcatcgagtcaacagcttcaggggctttaggaacaggctgaaattatttggttttgaccgccagatgacctccattgctgcccagtctgatggacagtcggaccattagttcttttaacacacattcttttcctgaaacacagacaccactctgcgtttgcacagagcaagaaaggagagcaaacgagagtgtctgaaagggagagacagagacgtacatttgcagagaaacttctaaaccagccgcaacccttctactgttttagggcctaggactagaggaattcaatccaagcaaagagacatcagcttttttttttttatctaacttaaaaatctgactttagactacaattaggcaagattatatctaataaatgtccaaaacaaaaacatggaaatggttaaaattgattttttgtattttctaaagcatttgatatctagcttaaaaatcagcaacactactttatatatatatacaaaatgtatacatatatatgtttatacatatatatatacacacacacagagatcagaaataaagaggtcttactatgttctacctaatgttagttcaggcttactgcaaaattgttttccactacatactacccagttctttgaaatccatttaatgagtttaattcccaggccacattactgtggtatatgagattcaatgtacattttatttgttttcttggtatgcatgtgttttgatgtgtgaatgaaaagtaactttggtcttattattcttataaaacaaatcaggagctaagctttgctttcagacaacctattaatccaaggcaaaactgaaaagcacaaagattgtactccaaagagacccataaagatactgaactttgccaggaaatggggagggaaaagggagtagaaaaggaaatttaggtagaggataaaattttctatagatgatgaatcattctatctttaaataaagcaatacttaaacttacatttaatcaaatctacaaaacacacacacacacacacacacacacacacacacacaccctccatctccattttcttgtggttgtggctgacagaactgtacttgtccccagcctcttctgattttcctcttgggataagtgatgagctatgctgcagtcaacgaggaaacatctgtttgactttccgaagctggcatggggagctgaagtctgaatcacaaatgccactttcataaacaggtctcccacaggaaccttgctaaaaacatgactctactggggtgagccacagctctggtgagtgatggggaaggctgctctcctttccagctatttgaaacaatatacactttttataggatttgtctgtggtgggatttaatgaattccaatctgttaacagacgtacctgaatccagttttaatttgggaagttagttcatactgaagctccaaaggctctaaatctgggaatttttaattagtaagaaagctatggctgggtgcggtggctcacacctgtaatcccagcactttgggaggctgagggaggcggatcacgaggtcaggagttcaagaccagcctggccaacatggtgaaaccccatttctactcaaaatacaaaaaattagcccggcatggtagcagatgcctgtaatcccagctacttgggaggctgaggcaggagaatcacttgaacctgggaggcggaggttgcagtgagctgagaccgcaccactgcactccagcctgggcctgtctcaaaaaaaaaaaaagcaagcaagcaagcaagcaagcaagcaagctatgacactgtggtgtgtggttactgtgttcagaaaagacacacaaaacctcaaattattttttaagcatattgacgtggtacttaaaaatcagcacacagttttcacattttattttattctagtattgttgtcatcaacaatgtgaataactcagaacaccactctggctagaggtgtgtctaacacacccgaactgtaacctttctctttccctccccccatgaaactagggagaaaacacctttgggagctgtatctgcccaaaggcaaactcctgtggcaggtggaacagggagctggccatgctccaaatgcctcccctgttagaatcttcacatctgcatgtctgtttaggttgtccaagttttcaacttaacttatttttaaaacctcttttctttagtttagtgatttttctctttatgaaaaatgactgcttgctgtttgattcctctcttgggatatttactcattctctcctgaacagggctctcatttccttgtcagcacttggtttggctgacatcactgtatgattattaacctgtgagtgagctggaaatatttccgagataatctaaacacacacccacacctacacacacccacacacacacatacacacacacactagcctagtctattcaactgaagtatttggcaaaaataatagattttataagctatatcaaatagatcttaatgtaaattgttaggctggtgcaaacatcatcctgcatatttctagttcaaaggtagagagcatttgtgtcagaaaggagctcctttattatttaaagacagtttccacctatcagaacagatggatagttgttgcctgtaaaatacgaattatactatacataacaataaatacactattgaaaccgttagttcaagaaatcaaggctgtggctggaaagcaatttaattttagaaattctgttttccttttctttttttcttttcttactttctttttttttttttttgagacagagtctcactctgtcacccaggctggagtgcagtggcgcaatcttgactcactgtaagctccgcctcccaggttcacgccattctcctgcctcagcctcccgagtagctgggactacaggcgcctgccacaacgcccggctaattttttgtatttttagtagagacagggtttcactgtgttggccaggatggtctcgatctcttgacctcgtgatccaccagcctcggcctcccaaagtgctgggattacaggcatgagccaccgtgcccggccctgttttccttttcttattcctctttttctcttttttgaaatttaaaaatgatatttctattttacaattactagagagaattattgggtgaatgaagtggaaatgtccaaatatacacgaattttctttctttctgtgactagactaacactcaacacgaaatgctttcactgcttgaaggaaagccctcatagaacatagcagatggcagaattagcacatagaatatcattttatcatgaaaaaaatgtgatgccaagccaataattattttcctcaaatttgttttccacatctttccctatactcagggctctgaatgttcctacagcatttaggatcttctgataaatttccaacttttgaattatgaacactagtaagccttttttagctttaagtgaaattaagacatgaagtagatatataagttattaggccttagagaaaaaaagacaaaattagatacttctcaacatacatgatttaacttaaacaatacctcaattttactttgttctcacaatcaaaaaataatgttgaacaaaaggaacagtagttggagaattcttccaaaatcaattttaattaaacacacacacacactttaatgttgaatatgcctgtttaatcaatgattttggctctaaggtgatacaatcagcatttatacttcaaattaccacttggtactaatagatactctatacacaagtccttaaggtcaacacccaaattattgccctatattaatcattaataacttagaaaatgataattttctaaacccatttttttaaaagagcaaacacacttgcttagtttaatttgctactattaaaatgatttgtgattaatttaatatcaattaatttaatactagattgcttacaaaattatttactatatttctgttcttttcaccacttgctcttaagtattgagccatgggagatgtttaggaactccgttaggaagggtaattacagaaccaaagcaggggaggacctgacaaaatagataccaacagataaatggagggaagggagagatggaaaggcacaccatttctcatgtgattatacagaggttgcttataggtacctttacattattatcttgtgtttgtattatgcccattttacagatgagaaaagctaaaatcagagaacttaaatgacttctctgagatcataaaggtagttaatgtaataatccagtgtaaggtttggaatgctttacaaaatgaatctcatcaaatcctcgaaagacagacattactctttagagtttcaaaaaaaagaaagaaaacttgaagaggcctcatgcaatataataagccaattataaaaatgagaagaagatgcaaaggatatcagtcctgggcaaccaaacaatcagtagctaaccctccaaatactgacctgaaataataacatgacaaaagactacttaaaaaaaaaacaaaaaacccacacctgtgttacatattgtgcttactagtcaaaagtcctaaatgacaattttctaaaacttgagtacaggcaatcctgacttacaaacccttgagttaccacctataatgtgtattcattgctgtcatatctgacacagagctgctgcggaaaatacttggaagactgaaaaggatgagttggtacgaagtggagagattcaagttaatttttttttgttttttttgagacagtctcactctgttgcacaggctggagtgcagtggcgtgatctctgttcactgcaacctccgcctcctgggttcaagtgattcgcctacctcagcctccagagtagttgggattacaggcaggtgccaccatacccagctaatttttgtatttttagtagagacggggtctcaccatgttggccaggctggtcttgaactcctgatctcaaatgatctacccgcctcagcctcccaaagtgctggaatcgcaggtgtgagccactgtgcccggcctcaagttaatttttaaccgtaatgctatacaaactaaaaccacagtaagatttttaagttacttgataaaacaattctgaaatttacaggaaaaataaaggggtgaaaatagcattttgaaattttgaaagagaaaagtcatgactgacactaacgatacttaaaacattctagagctacataagtcctagtactggtacaaaaatagatcaatagaataggataaagagctcattttagatgtaatatactaatatataataaataatgcaccacaagtagaagagggtgattgaataaatgattttgaagagaatagtaatttggaacaagatcaatttagattcttgtctcacactaatcaaaataaattccacctgaattaaaggtaaatatacggaagtcaaattatagaaaaaccagaaaagaactgaatgttgaacaaaactctagagaagaaaggacattttaagttagaagtgataaaagtaaataaataaatttgaccactttgagaaaaaaaaacaaaaaataacttctgtgtgtaacaactatctgtctacaccaggactagagatctatactagtccactagatacactagagactgttatctgtctacaccaggactagagaatgtggcataagtgggaagagcttcaggaagctgaccctgagggacctgtatttccaggcagagttaacctgctataaggtcatattcttgtacaaaattatgtaacccacatcgcccaaattattgtgctccatcattattccaccttaaatgccttcatttagagattcattcatattttgagaacacaaatatgttctgaaggatagttagtggagataacaatcactcacaaattggcacaaaattaattagcttagcttcctcctacatctagctgtgataagctgcactaagttaaagagagcttttatctagtggggatggaaagtaagtgatttgtgagtttaataaagaatttattttttattattaaaaaatgaggccgggtgcggtggctcacgcttgtaatcccagcactttgggaggctgaggcgggaggatcacctgaggtcgggagtatcacctgaggtcgggagttcgcgacctgcccgaccaacatggagaaaccctgtctctactaaaaatacaagattagccaggcatggtggcgcatgcctgtaatcccagctactcaggaggctgaggcaggagtatcgcttgaaccaggaggcggaggttgcagtgagccaagatggcaccactgcactccagcctgggcaacaagagcgaaactctgtctcaacaaaaagaaaacaactttattatattttctgcgtcctaaaatatgaaaaacatagtgaaattttaaacgatatggaaaacataaataaataaaagtcatcaaaaatatctcagtatttgtgacttttcttttggataacttttttgcatacatgcatgtgctcacacatacacacctaattttagcaaaatcaagtcagtctttaaaaattttttaaattaatttaattttattatttatttatttttgcgacagagtctcgctctgtcactgaggctggagtgcaggggtggaatatcggctcactgcaacctccacctcccgggttcaagcgattctcttgcttcagcctcctgagtagctaggattacaggtgcgcgccacatgcctggctaatttttgtatttttagtagagatggggtttctccatgttggccaggctggtctcgatctcctgacctagtgatctgccggcctcgacctcccaaagtgctggggctacaggtgtgagccactgcgcctggccctattttttattttttatctttttaaggctagtcaagtgaacaagtaagtctttaatgctgttttgtagcatgctttttcaccttctaaaaggtcaaggctattttttaccaaaaaagtagattgttatcattgtgtttatgacatactgttcatgattcagatacattataatttgtttaacaaatctcccactgatggatacataggttgtttccaaatttgcactataattattaatgctggaattcaatttttgtacaaatgaatttggaagtgcttttaaaggtagtgcaggtttaagcggggggagggggttggtgggaggggggcatgaacatatggtgaacctgagcagaagaagggaggtgtcagaaggagataggagagcaccaaggaaaattttgcttgtttctttttttaaacatttcctgtagctggctttgtgcctagaaaataggaataaactcctattacacacctctctatttttaaactccagaaaaaaggttagtgacctataattagccacatcagcaattacatacacttttttaggctggcctaagaatctaaacactatatttctattataaccatattacgagtaccaacagtttttaaattggaaactatatatatatatttatttaaagtcaacaaaatagcaatattcattcaataaacctgacagtgatattaatattcttgtttctttgtttcttttttttttttttttttttttgagacagggtctcactcttctgcctaggccagagtgcagtggcacaatcacagctcactgcagccttggcctcctgggttccagcgttcctcacacctcagcctcttgagtagatgggaccacagcgtgtgtcaccacacctgactaattttttttagtatcatttgtagagatgaggtcttgcccaggttgatcctgaactactggcctcaagcagtcttcctgcctcagcctcccaaagtgctgggattacagacatgagctactgcacctggactattcttgtttcttgattttttttctctattcagtgatttttaagagctggtgggaactgtattaaaataattttggaacttttcaaaccaagcatactttctccaatcttctgatttgacttgggtgaggacatttatattccaaaaaatctccttaggggattctgatacatgcctcccataccacttctacttcttgtctgagaagtgttgctttttatctattgctactttatcaatttatgttttgacttcctaagtaaattgacatccctcttttaaaaaaaacatggaagggtatacttcttctgaatctcaaagttagttataatgcttgtgcatcataaatacataacattttactggatagatgaatgatagataactatgtacttcggctatttaattcatgtagaaaatttaaatattataaaagcagtaatgattctcagatgtttttaaaataaattgtcttccttttttttttttgagatgaagtctcactcagtcacctaggatggagtgcagtggtgcgatctcagctcagtgcaatctgtctactgggttcaagaaattcttctgcctcagcctcccgagtagctgggattacaggtgtgtgccaccatgcctggctaatttttgtattttaaatagagacggggtttcaccatgttggccaggctgctctcgaactcctgacctcaggtgatccatccaccttggcctcccagggtgctgggattacaggcgtgagacatcgtgttcctcttcctttttaatttgggaactaagacttaggaattgttgcgattgccattataagtcttctttctcagttccagattctagggacaaagaactatctaagtaaagatgatcttatttttaatttttatttatttttattttttgagaaagagtctcactctgtcatctaggttggagtgcagcagtgcgatctcagcttactgcaacctctgcccattgggctcaagtgatcctcctgccttagcctcccaagtagctgggaccacaggtgtgcaccacgactcctggctaagtttttgtatttttggtagagacggggtttcaccatgttgcccaggctggtctcgaactcctgagctcaagcgatccacccaccttggcctcccaaagtactgggattacaggtgtgagccactgtgcccagctgaagaggatcttattttcataaatttcaatgtcaatgtcttaacatgagttgacaagtcattgggacactgggaatgacttctgcagcactaaaatatgtttaaatatagaaaggcaacaaggataaagtatagcaggtttgatcattaaaactcttaaagagcagctcagaatttgctgtgccaactgcactccttcaatccagccaacctcctgggaatggagcttctctatgtaaagatgtttatttctactggatttagaaccatttcactttcctgcctaatcagcatgaactccaggatcaaccacactcgataccctttccctttgatatctattacactcctgcaattcccaacattttgcatcaatctgaacatttcctttctgtgcctcctgggccatcaagcataccagaaataaacagaatgcttaggtaactgacatatttaatttatttataattttcaacctccactggacgtttagtattcttcagaaatcctttgcttgattccatttcttgtttcccaagggctatatatgccaaacttttatcactgtttttttttttttcttttgagatggagcttgctctgtcacccaggctggagtgcagtggcatgatctcagctcgatctccgcctccctgggttcaagtgattctcctgcctcagcctccctagtagctgggattagaggcacctgccaccgcgcctggctaatttttgtatttttagcagaggcggggtctcaccacgttgaccaggctgtctcgaactcctgacctctcaggtgatccacccacctcggccccccaaagtgctgggattacagggctaagccaccgtgcccggctcttttatcattctttagctccaattctatctccccttttgtatagtctctattagtgattctcaattttagtatgaataattgtcacctgcagcttgttaataatgcagattcaggggccccttgcactaatattctaattcactaagggtaggcttgaggaatctccaggtttaagaactctggtgatttatattctattttaaaacgtttacttttagagatggggtcttgctctgtcacccaggctggagtgcagtggtacaatcatagcttattcagtgcagcctcaaattcctaggctcaagggatcctcctgcttcagcctcctgagtaggtaggtcaataggcgtacaccaccatgcctggctaattaaaaaaaatttttaggccaagcgaggtggctcatgcttgtaatcccagcacttcaggaggccgaggtgagcagatcacttaagaccagatccaagagtttgagaccagcctgaccaacatggagaaaccctgtctctattaaaaatacaaaaaattagctgggcatggtggcacgggcccgtagtcccagctactccagaggctgaggtaggaggattgcttgagcctaggaagcagaggttgcagtgagcagagattgcatcactgcactccagtctgggttacagagtgagactctgcatcaaaaaaaaaaattttttttggccgggcatggtggctcacgcatgtaatcccagcactttgggaggccgaggcaggtggatcacctgaagtcgggagtttgagaccagactcaccaacatggagaaaccccgtctctactaaaaatacaaaattagccaggtgtggtggcaggcgcctgtaatcccagctgctcagaaggctgaggcagaagaatcgcttgaaccctggaggtggaggttgcggtgagctgagatcgcaccattgcactccagcccgggcaacaagagtgaaactccttctcaaaaaaaaaaaatttttttttcttttaaagagacaggggtctcactatgttgtccacctggtcttgaacttctggcctcaagtgattttcctgcctcagcctcctgagtaactgggattataggtgtgaaccacagtgcctggctccagtgattttaatattcatcttttcttccctcttccagtcctgtttccaaaaaggaagaggctctactcccttccaaggccaaccattcaaccttgctacaactgccatcacctccttccttctcctagataatgctccatcatctatctttcctgtgtcttatactttcaatccctcctcctccaccaactcttttgctagagaaaagactcaattttctctcaacttcaaatccctgtggctgtttcattccctttcactttaccagacttccagtaaagcaatctgtactgatgcttccacttgtcacttcccattacttcctcaaccatggagttttggctcccacctttaaagctactcttaatttgtcctttcgaatgtacccagtgacctgctaattgtcaatcccaatgacctcttcttagtccttattctctctgatctccctgcagtatttgatattgctgagccctttcttgaaattatttcctccctgggttctcctcctacctctgatatccatttagggggatctttgctagctcctctgtctgcttcatcgtatgttgacatctctcaggatattatctctggtcctcttgttttcttcctttatagtctctccctggattatctatctcttgacctttaactctcagctttaatacaagggatcttaaatcttttttcatctctgaaaagcctttcatttgaagttttgaacttgtaattccatgttcccagtgtgtaacttcttgaacttgaatgatgagtttggttttggacattgttgggtcagggttcttagctgcaaagcagaagctgagtcaaggttggaatcaagggagctcctgagggcaagggacaggaaccacagcaaaaatcccaactattgttgttgttgctgctgctgctgctgctatgagtatcatcaccagatgtcctcatatctttgaatcacttgattaagattcaaagtcttcaaagaggaaatatccatttggtcaagcctaaatcatgtggttggaccctagtaacacaagaggtgggtgaagaaggatttgatagtggaaagggaccactatatcttattaataccacacataataggagataacatgaaggggatgagagagtttataagaagggggagggtctgactgcaatggcaagcaatgaaacatgcccaccacaaaatactaaggttgatcagtccccaatgtcttaaaaaataaagcctaactatcaaccgtaggtgacaggattggatcaagagagaaataaataaccatatgattcacaactaaccgtaatctacccccccagccactctctctaaatattctccaatgtgccaagaatttttatataatttgcttttgttttctgctactttctctttctagggaatctttactttctttatttggttaaatcttacttatccttcaagatttggctaaatgtcttctcctctgtgaagtcttccctgattcccctgggcaaaattaatcatttattttgttctccctccacttagcactttgctgaaaacactaatatatcttaatgattatggttagttgtacacatctgttttccactggattattagttccttgaaggcagggactaggtcttattcatctttatatcttcacagtctgcatcagtaaggaagaattaggaagcagaaggggtgatgctgctataatgatgaggtctcttaacttgtggtttacattttttcagcttaatttcttttgttccatacatggtacttccctaatcatttcaaatgaaacagtctatggagttctaggtcaacttcaccctgggtcaggtaacttttgttatttctattctttaggtgaaggaagcagagtgtaatgttcccgttgctcttcacaactgaggtatcatcagtactttcagaggtcttacaagcaattcaattttgcttaattgacatatgtttctttcagaagcacagattgagctagttgtatgcgtttctctgtatcttagacactgggcttaaaactaagaacactaaaatactttatgtaacaagtgcattgagatctttatgtgacagactttagacacaggagatgacctccaacaatggaaatagtgtctgtgattatgaatcagtttccttttggtaaaaaatatttctatgaaatgtctgcacaataatatggtcaataagcatcataggcctaaaaggaaatttaagtttctcttttaagaatacttcttttatattacagaaatgatctcatttacttaatacatttttcaaaaattaagagaatgctttcaattttccaaaggttaggaaaacaaagtacaatctgaaggctctatttgtaaaagaaagtgttatttatagttaaatttatcaagtggacattcagcagcagctgagtattaaagttgcattcctagaaaactagatatttcatacctaatctgtgcttagtcaagccacaaaacctcaaactaacagaccctctgtcatttgcggatagtctaatttatctatactgaaattaaacatttaaaaaggtctgattacacgattaatatatggagcattcctgattagaaaaaggctcaaattctgaagatgttaatttattttttggttgattctgaccatattctgtcatcaacagccttttcaattcccactttttgagacaggtttcaagaaaatggaaatttggggttattagattagccatgaaaaaccagtgaaaaaaatttttaacaaacgtcatagaaaatcactcaatgaaaataaaaaggtgtttaatcaactttgttatttattttaaagacagggtcttgctctgttgcccaggctcccaagtagcttaggactacagtctcatacctctatgtccagccaattttttatttttatttttgttaatatgttgcccaggctggtcttgaattcctggcctcaagtgatcctcccctcacctcggctcccaacacactgagattacaggcttgggcatcactgtgcctggcctcagctttatttgttctaaaggaaattatgaatagtaatggttattacataagtaatctctatgatgtgggaaaccattaagcaccttttacatactctaaataagaattatgctttgggtttttatcatatttctaaaatattttctagcatgaaacatctaacttaacattacacacaaacacatattcctatttatccttccagacataatatagtcactgtcattacaaagccttctttgtgctaacttctttgttctctcttctctgctcccatgttacattttaccataatcattttcttgtatctctatcccccattaggcattgagctcatcctgggcagagaacggactctcttcacatttgaattttcagtgcctacgctgttcttttttctttttctttctttacctgcatggttcttgacacatagtagtagatgtccggtgtgtgttagttgaatgagttaataaatgaaaaaataaattacatgtatataatagaatataattctagcacaacgagacctcaattataatagaatataattctagtacaacaacagttcaacgagagtggagaaaaggatggaatcatgtgaagtcttccagatgtgttaattatgttgaacctaatgctaaggatagcaaaagtctttgaagaatggccaagagtgaattttgggaagtcaagttgaatgattaatagtccagatgagaatctgtaatggcttggtggagatggcagggatggagagtaacagaagtatcggagaaatacttacgatgaagaattgatagcatctggtgagtggctggatactgggctggggtaagagagacaggaagtcaaagatgagagcaccatttaccaagagaaagaagaaaaggtacagattttaggggggagaaaacaaagtttcagacatattgagtcaggtactggaaagacatccatgtgttactatgaggagggaactattcctatcctcccctcttacacaccaggaaacctgggctgagggagcttacataacttactaattgcttcccagacctgcctccaaagtccatgttgttaactcccaggccatacagcatatgattctttgtttaaggaaaacaccaatatattgcaagccgagttatactcctgacttctgagtactaaatgtgtctcaactgaagcaactatcctggaggatgaggccacttaacagcttccaaagcaaggtgacggtattcttaaggcctccttcccacacacttctctgccaaaatagatggcagctaagccaaagagcactggagaaagacatggagcagaaaaaaaaagagaagatcctcagggcgctggtagaagtgcaaaggtcttgttcaggtgaaagaaaatgtgtaataaaattcaccggttcagctgaacaggtaattacagagttaataaaacaaggattcctgacacaatagattctaacactgccatgggtgtcatagtcactaagtgactttttagtttgctgatcattgatccactagacactaacagctccaatcggatcaatgcaggataacatatgaggaggactttgcatgttaaaaatctactggaaattttacatgaaagagttcattatctgggtaatgtgacctgtgtccaaatgatacatgtggaccatttgtcaggttttttaatggaaaaaaatgaatttttttctaaaagcctaattatgtgataaattccactgccgagaaattgaagccacttgggtgtcatgaatgtgtaaacatgttaattcgagggctgtgttacctaaagaagtatatttcattccactctcttagcttccctttccccaacggggtcatctcatccatctcctccattcctatggcccaccaacactctgttcttgggtctttctctcttcgtagcctgggccagcttccattttccctaaatccttctttcctgtgctcacagttccttctaagagcttgtctcctaaggccagcatttaacccaaggtccctttgctatcttcattccctggggccctgttgtcatacagttttatcagaagagagcagacagagaagaaaatatacttatttctcatggaaagaactcatatattgcttggttctagaaagaaaaatgatctaaagcaataataataagcttgtttatggaaactagacaaatcaaaaagagttctggaaaacatattttgtatgtttggttttaaatactttattgagatataatttacataaaatacaattcttggccaggcgctatggctcatgcctggaatctcagcattttgggaggcagaggtgggaggattcacctgaggtcaggagtttgagaccagcatggtacaacatggtgaaacgccgtctctactaaaaatacaaaaatcagctggctgtggtggtgggcgcctgtaattccagctacttgggaggctgaggcaggagaatcacttgaacctgggaggcagaggttgcagtgagccgagatctgcactccagcctggatgacaggctgcactccagcctgggtgacagagtgagactctgtctcaaaaacaaacaaaaaacaacaacaaaaaatgacacacaaaaaacacaattctttttaaatgtacagtttaatgaattttgacaaatatatacatatatatatagtagttgtataaccactaccaaatcaagatatagaatatttccatcactctgaaaagctcctttttgcccctttgtagtcaatccactctttctatcactggccttgccaatcattgatctatttttgtgtctatagctttgactttttagggatgtcaaatacatgaaatcatatagtatctaatattttatgtctggctttctttaattagcataaaacctttaagattcatccatgtagttgtgtgtatcagtagtttatccctttttattgctgaatagaaacacaatttgtttatctactcaccagttgatggatacttgggttcttttcagtttcagtgaataaagctgttataaacactcaaggcagaacctgtactcagacttaggcagtctaaacccagagctcaggtttttttacttttttatttttatttattttttattttttgagatggagtcttgttctgttgccaggctggagtgcagtggcgtgatcttggctcactgcaatctctgcctcctgagttcaagcgatacccctgcctcagcctcccaagtagctgggattacaggcacatgccaccatgcccggctaattttttgtattttagtagagatgggttttcaccatgttggccaggatggtcttgatctcctgacctcgtgatccacccacctcggcctctcaaagtgctagaattacaggcgtgagtcactgcacctggcccagagctcaagttttaaagcacttcagtctactggtgcccaataagaaaccatgaagctctttgtcattgtcatggcactccctgatggggttcttctcactgctcctagtgcctgtgatgctctccaagtggagactgcctgatcgcacatcaaatgctgctcatttaggctggcaggcagaggcagcgtgctttcaaattgtgctttaaagaaaaacctttatatttccaaacaaattaagggaatttacttgtaaggaaaatctaatttaggtatctttaaaaggagaggtttagaaaataagaaattaacactgtggccaccatctagtgatccatggcttaagttttaacatggcactgaaaacttctcttacccataagtgttgatctagtataatttattatctttggaacagtataagtttattataaaatcaatgagaaaatatatgccattaggcatgccctcatactcatattgtttagaaaaacaataaaacaaaaacagacaaaaaataaatattaatatttactagtttatggacaggcaagacaactttttaaaaatcctagtttatctaatgcatatatttttagtactgcagcaataaggaaaacctgaagaacaacagctaagtgtaactaagagtacatattctacagttaaaaaaatcacacaagcatttacttgattcttcatgcaccgataagaatggtaaagaaaacagaaatcccaaaataatataagtttgtctcagctaacaatatcatttggaaaattcttatgtttacccaaagttgaactgcacttaatactttcttttatgcctttctgtttcattttattagattaagaaattataaaaagtttaaacatgtacaaatgtatagaaaataatgtaatgaacctcctgtagctatcatccagcttcaacaattatcaactcatggccaattctgtttcctctattttcctccattcattcctcacctctacccaaactaatgccttattttttttaactttgtactttgaaataattttaagttttcagaaaagttgcaaaaatagtacagagttctcatctatccttcaccctgttccctcaaagctaacatattgcataaccacagtataactatcaaaactaagaaactgcttttggctgggcaaggtgactcatgcctgtaatctcagcactttgggaggccaaggcaggaggattgcttgagcccaagagttcaagaccagcctgggcaacatagtgggacctcagctctacgaaaaagtaaaaagtcagccaagcattgtggtgtacgcctgtagtctcagctacttagtaggctgaggtgagaggattgcttgagcctaggaggtcaaggttgcagtgagccaaggtcgtctcgctgcactgctgctgcctcagtgacagagcaagatctggtctcaaaaaaaaaagaaagaaaagaaaaaaagaaactgccctttttttttggtaaggaaaattgcacatttttgtgctcctctgataaatgcaaacccacccatctgagggaacaataactacaaaatgccatccactcttagcaattatgtaattccatgtaattattttctcagtttggctaaaaaaagcaagtactttgagatctctaaaatagtcacaaactagtgcattttctagttaagaagatgtttgggagagtcaaactcttatttcagagacagaatataatttaataattacctgaatacagaaacaccaatgaagttgtggcttagacgtgttgggcatttgtaaaatataggtaatatcaagagactcctgctgtgagtcaagacaaacaagcttccccctgccacccagcataactgatgagagaatgcagagaaaagtgattagagtagactatgatacagagctggagaaagtttcctaagggaagacatgtttaaagttgtatctaaaattcagatgtaataagaaaaataaaataataataaaatttagatgcatatatcattaaggcagcatagcatagtgcttaaagccaggataaactctggaatcagactgcatgggttcaaatcacagttcaacttcctcttggtctgtgacctggggcaagttatttaaccctttcagactctgactctaggtgcttataataacctctgccatctatggatgcatcagccttggtccaatcaaccatacagcagagatcatatgtctgttgacttggctgactggctatatttcactctaactataatctagcagcaggcagggggcaggatctcactaactcttgaagatcttagtggtggtggatagattcctcttctgaagtgagcgacggctggatacaagctgctgctccattctgtttccctctgggtgggaaataacttaggaataaggaggacaatgtgctctcagtctgcctaactggcccttctgtctgggcatcttgtacctagctagttccccagggcagaagtgggactctagccagcctcctcttctgagatcagactgtacttccctccctgattaatgtcccagactctcacctgtcattcttggaacaccatgattactcagtttatttcaatgccattctctgtctactcctcttagaatgcctgggatgtaactttgaaattgtttgcccagcctaaactcagctcacaggtaaaggagctgctccctccctttcatattgctaagatttcctttatctctccacttgcttccccctccttcctgctaaatcccacacagtcccttctcctagtaagagctgccaacttgttgactggccaattcaactccatttatggcaaacatttgtagttgttctgattttaatggggctaccctttataataatgtttttaaaaagtaggtcacgaatagaaccaataaagataagaaataatttctggaggccaatttctcttaagacattctatatcaaataaaaactttatggtgggtttgaaacactgaaacagaccactcatgagtagttattagaacatggaggaaaaactgtttgccattttagcataggtaatttacaaaatgtcattcttttcaatgtactcagaggcacatgggcctatggtgggttctgccaatttcaaaggtgatgatctatgaaggagatttggatatgagtacacaggtgacttctatgttcagacatactctgtcatcatgttcaaaaacagcttccaaaaagcacagttggcatgttgtgagaaaaaatacacttatattcaatatatcccttttttataagtaacgcagggatctatacatctttgacaattttgctctcaccttaactagagaacatatctatgtcaactagcatatattttagcagttgtagaaggttggaaatcttaaaggaaaccagactttagccaagtctgggaggacctgcctttcaggggctgctaaagaattggtggagacatacatggtaagactgaaagcatttggattttcttcacaattcaacacaattctcctatagtagtcattaaactctgatcaggttaccagattggtagttttcagcacactgaaattcttagttgctgagatttatgaaagccatattgaaagacattgaggtatggatttgcctatagagcaattattaatatatggagatttctcttatagtaggcctgagtcctcttctgacgcacagagagggccatgttttatgattttggtgcatttactctctaagctctccaaatcctcacagccatctctaaatgttcttttatggtatttgctttatggccaagatgttattaagtatgagaaatgaggcatttagcaacatatttgaataagggaataagatgggagtggtgattctagtaaaggagcagaaagcttacttatacctcctctcctttatacgataccacctcctctttctggtcatactgagtctagagagaaaaagggagccctggccgggcactgtggctcatgcctgtagtcccagcactttgggaggccaaggcgggtggatcacgaggtcaggagttggagaccagcctgaccaacatggtgaaaacctgtctctactaaaaatacaaaaattagccgggcatgatggcgtgtgcgtgtaatctcaactactcaggaggctgaggcaggaaaatcgcttgagtctgggaggcggagtttgcagtgagccaagatcgtgccactgcactccagcttgggtgacagagcaagactccatctgaaaaaaaaaaaaaaaaggggagcccctatgtcaatatttcctatgagcccttttgatcctctgaccctaaacaaatgctgcatttttatcattcatttttttctccaccagaaatcataacagccattatgtgcaattctgtggtgagaaaaggagacaggaattctgaatattgctccttaatctgttccttgttttctcagacatttacttttggagtcagatgtatatgaacattcctgatttgccacagctgagcagtatggctttaggaaagttacttaacctctctgattctcaagtgtccacattgatgaaatgggcatggtaatatctactttacagaattactgtgagaattaaaatgagatattatatggaaaacagccagtacagtgcttagcacataaagggctctcaataaatgattgcaacagtaatttctgatagcagtgactcagcttggggaaaagtcttaaacaggttggggaggctacctcaaatgcttgatgaaaggagaaaacatagaaacaaacaagaagacaaatgaggtgtcattcattttaccttacagagaagatctgctgtataagactaaattttaggtgtttctgaatgtgggattattgttagaccacagcaggaaggctgtttcaatcatatagggatgcatataagaaatgtgaagcctggaatatataacaagatttatttttataaccttcagtgagaggtattgtgcaagtataaattatatattttcacttttgtaattatacctaaaccacatactcccagaagatttcattatgtaattcctcaaacttaacttcaagtttcctttataaagcaatgttctataaaattgcaattttctataatattgccattgcaattgctatatgtaacacttcaaatagtatatgtgggatctctaggtatttgaactagaaaagcaaaaataaaggttatgaattcagccagaggcaaacaaccaactaggaattactgagtggatctaagttatataagcattcaacaggcaaattaacatctacaacatcccataacaaacacacacacactcgacttcttcctcaagagcaagagttcttttggctttgaaatcagcttactagttgcttccccactttcttataactcctcttcatattgctcatcttaatcatctagataattttcgctgggcgcggtggctcatgcctgtaatccagcactttgagaggccaaggcgggtggatcacgaggtcaggaggtcgagaccagcctggccaacatagtgaaaccctgtctctactaataacacaaaaattggcggggcttgctggcgcacgcctgtaatcccagctactcgggaggctgggacaggagaattgcttgaacccgggaggtggaggttgcagtgagccaagatcgtgtcactgcactccagctctgggcgacagagcaagactccgtctcaaaaataaataaataaataaataaataaataaataaataaaataaaaatcatctagataattttaatttctttatcaaagttatttggcaaattgtgccagtgccacagctagaacacaggagtgactcttaccacctggttcgacattttcattacctatagtcagcaacatccctcaaacctacaaaattcacaataataatagaaaatgaaaaatatatctaataagcaacctaggctttaagagaatatcagggtaattacatttttttttagtagaaccaaaggtaaaactattatatatcgttccaagattctaactaaaagagtgtacacaaaatattaaactcgaaggtgtgaaaggaagtgatatatgattcctaataacacggaataatggtataattcaaagcagaaacatagttcctactaggcacagaaatttttggtaagaaagaaaaaaaaggaggcatttctgaaaaataaaaatgccaatataaagcatacttttataaaaacttctcagtactaatttttatttgctctctgactattaagtactaaaacagggttaaattgattagtttgcttgctattatttatcagttagttaaatgctgctcagactctagagttcattagcttatcagtcaaatacccgtcagctgtacataaggtctcatataccagcttgcttatcaacacatatatacaaacgcaagtggaaaagaaagcctatttaaaatgtatatttagaattgttcacagtaaatatttgacacagttaaccaaaatgtcttagcactctcttacgtcttacatagcatcataataaaaacacgtaacagaattcaaagcagatggagctcaaagctaagccataaacttgtgttttttaaaaaagagaaaaattggtaaaaacatggactgactcaagaggaacttggtatatctttaatttaattactgtatatttagtaacagtgttacttaatttgacaaatattgaattctctaattgattatttgctagtctgatttctatgaattcatgggagagtttaagacaagtggtaacatttaatgaaggcgtgttctgattaattatctctcagtgatctgtctgacatacagtgagttatgaaagtcatcaataatttccccttatttttaaatagcaataattctctctctataagaagttatatcttaagggttttttaagctataattcatcaaaaacaatgaagcactggctaagaatctatcaaaatagtggctgactaccagattgaaaataaatttacgctgggtgcagtggctcacacctgtaatcccagcaatttgggaggccaacgtgggtggatcatctggggtcaggagttcaaggccatcctggccaatatggtgaaaccccgtctctactaaaaacacaaaaattagccgggtatggtggcgtgcacctgtagtcccagctactcgggaggctgaggcagaaggctcgcttgaacccaggagatggaggttgcagtgagccgagactgagccactgcactccagcctgggcgacaaagtgagaccatctcaaaaaaaaccaaagcaaagaaaagaaatttaaacattttagtactggaggcagactgctaggaatcttagccaacttgttatcataaccgtgtctacctaaaggcaagcaagagaaatgctgggaaatagcacaaaacagtgattttgagaaaatacaagaatgatatatacatataaaataaaagtatataaacttgtgcagtgtatagcaaaatagctacttgtaatataacatgaatagtgtggcttcaggcaattgaacagagaagtgaagctgaacgctgctatgccaaccaaatggcaaatgtgacacctgataatgtaaaacagaggcatccccagggcaccatgtaaaattattataaagtggtgaaataacaatataaagttaattttattaaaattaacaatacttcccatcagcacaagacaatctatattcaaaattaaaacagtaggaatgtttatctattcaagcattctgataggctaaatattgttgactgctaaaagaaataaagttttcaagactctttttcctatatattcataaatactcatgcttatgagtaatatcatattcaaaggcctgaaattaaaaacatgtttccttatgaaatttggtatatttggcatgtcattaaaaaaattcctgcctactttttaaaaaaaaatttgatatcttggaaataaaagaagggataaactgatcaaattttgcactgtactgtttaactacaataaatagaaataggtaaaattagtaatttcacagcattatttaaatattaatgtttgctgatttctactactttctgatatttgaaaaactgatctgcattcacttgccagctgtgaggtgttgtgttaaacagaagtataaatttttaggctctgttagctttcataaaataatactgagtgttttttcttgattacaaaaagaatgcaagttcattacagaaaaaaatgaaaatacagaaaagtacaaggaaaaaagaaatattagccctattatgttgtaatctgtagtcattattaacactttagaacacatcctttcagtatttttatctatgcaccaataagtatatatatatatttaaaaattaatatttaatcaaaagtaagcctgaatgaagactacgtcatattacaaaatgaattttattttttcatctaaactaaaggagtatttcagaacatgtaccatgtttcacctaaagagtggctgcagttatataataaactacatctgctgaagaactgaacattagtttaaaatccaggagttaagcagtcaatagtaccctgaagtgggtgatggaaatattctcagaattagtatgaattttattattaagggacagatggatttataagatctcaaaattttgaggcacattctctattttagatacttgaaaaatctgtttcatatgtttggatatcaaagtccactaaatctactatgataacaattcgtctatgaggccagtttcatgtccttgatgattagaaactaaacatgggttacaaggtagagaaaggggcaattcaagaattatttgtaactaaagatggtatgttttttaatgttattatcagaggaaagaaacaaaaccattaaaaaattatgtaacattattaaatttaattcaagccaataatctaagcttacactgaacactcattccaactatttaaccctggctgctgagctgaggctataacagcaggtgggttatcagacaatgcactagaatttcacaagatcgattaagtcagaagataaacaagaacttccccagcctcttttattcttcccggataatctgttttatgttcttgaggaaggaaaggcaaatcttaagctttacactgtaccttagcacactttgtctctcttccctattttatttctcacatagtttacattacatcatgtcatttcatttattgccccctgaggaatgcaaactatgtgaaggcagggttttccactgacatatctccagtgcctagaacagtacctggcacatagtaggtgcccagtaaatatctgttgaataaatgaatgagatttctgtaactggataattagggttagcagaagtcaattttaaatattcaaagaaaagaaaaatattttacaaaaaattaaagacacttctgacctggtgtggtgactcacacctgtaatctcaacactttgggaggcaaaggcaggagggtcgcttgaggccaggagtttgagaccagcctgggcaacatggtgagaatgtttcaaaagacaaaaaattagctggctgtggtggcatgcgcctgtaatcccagctactcaggaggctgaggcaggaggggtttgaggctgcaatgagttatgatggcaccactgcactccagcctgggtgacagagtagaccctgtcttaaacaaaaacaaaaacaaaaacaaaatcataaacttttgctcagaacttgcatttctctaactttgcaagcacaaatttttatacctgttgaccaccttcatggggttactttgaaaatagtaattactaaagcccacttcactgaaaatttgagagttaatttttaaaatttctgaattttggggccactggtgctggaaaaaaaaattactctctctgttctctttcttgtaaaaaattcagtgctaacccacacaaatccagacagctgcctcatctattctgcttcatctattctcttgctgaggacattctatattcttaggttcctattgaacaacagcaccattctgaaaaatttgcgtactggcaatcaaatcattctgcaaacagtaacgcagattccaatgataagatgagtgagcaggatgcaagaacatcttaaagatcacctgccacacttgtgtttgaggtgctcaatggctgtttacaccaagtgccatctggctctatagatataataacaattattccattgaggtgtgtagctccctaaatcatattaatatacaatgattccgctagtcttataggagttgatgtctttgtgcgctctcatttaacctgggtaatgcgctaaaacaagtctgcctcatcattaagaattgattttttatttatgtgaatgtcactggcaatcccatgatatccctttgtaattcagttgaacaggactgcatactagcgttaatctatttttatggcatatctttaaaaatttgcaacatcttgctacatttggatatttatatagagatttgtgttcctgcagaaagctgttgttagctttggagatccacttcatatagcaatagggcaagtatctaatatacttcattagctatcttatatcagataagggtttatttctttaaattatttaaccttggtataacctactaaaatcacataaatcacaaatacactaatgaaaatcattagtttagcctattcaaaaaaaaaaaaaagaaagaaagaaagaaaagaaaaaagaaaacttccaacagggataaaattaaaacattttaaaatcagccctctggaagcatttcatgaaagtaacttggtgaatttgtcatgatcactcatttcttaatgttgtcattggtcaatcgtttagtcattgatgttaacaactattctgatgtgctaacatttgtaaaaaaaaccaaaaaaacaaaaacacatcgctttttttctggctgattcaaaatctgattttaaaagtcatagttacaactatttataaatatgccttcatgagttttgctaatttaaaatgagataaacacaataagcaacaataaaaagaaaaaatacatattttaagataccaagaaaaaatactacatcacaaaattatactttaaatctagtcttcccaacagtatttacaagattattaaataattaccttatggggaagttctgtcagaacacctctcatatttggatgagtattatagactttgaacctgttcataaagcaatagcaagcttcttcagaaagtcactgaattttgggcatggggagatatggtaagttatactgcaggtcttgaccatttcatgctgctgctttaaaggcagaattactcttatgctgttgaatttatcatacacaattactgatactgcaactcataaggaagttaagcaaagtttcagaacaaataaatgaggtaacaatttttcaaatctaaaggattttgaagaggattgtcactgcaaactataaactactgtaagattcttggtctagaacaatctcttgtggattatttagacaatttttaaaaaagcacactggggcaagttcatttttctaacttgaaaatatacgtcgtaaaacttaattaaaggctcaaacttaagaaagacacattcataaaaaatctacatttgagttagattgtgaaatctatgtagttttcaatataatatattaatatctgtaatccttaagctgtaatttttacaaatatgttttccaagagctgcataaattaacttctttatgtattgtatatgttataaataactagaaggaattacgtacttttatattcaataaataaatacatttaaagctcagatactttcactaaaatagatccacaaagaagcttggaatgttcttctgtggtcttcagaactatgtgtggtgagcaattatcaggaataatacatgtgtctgtttttgaattcagtaagccttctaaacattattttaaaactactccacagagatgataaaaggtgtattaatcacctaaatgcctataaattgagatttaaggtcagagatattcccttagtttacttaagatattccttggatatcccttagatatttccctagttgtcccacacgggcttgcttgatcacacatcatatcctggtacatacgaggttctgagttagcactgtggaattggtgtacaaggcttacaagtcagcttttaaaacgtaataatgatagcatctataatactattctagtgattctatgcttttctttttgttaaaatcatcccttattttaggaataagctaagtaaagagggaacatggagtcagactgaaatctacttcagggctcacctttgtcggatgaacagtgaacgctctgacattgacattcacagcagcattgctgccgggtattgctataatttgctctctatgattgttcctttaaacaaaaagctctgcgctcagcatgcaaagaagttagaagtgcgggaaggagggggaaccacacatataagaggagagagaggaaaaaactgcagatcaatcatttataattaacaaaaatccgattggtgctttaaatagagatcaatgtgttccaggctgcctggattgtggggatgtattcaccttctggtaactctccaagcaagctgtcacacctacagaatcaccatttgttttcttaacaaagcttcagggggcgccaggctctcattgaaatttcattaatctaatggagtaaagtcctatagaaaaaaatcaaattctcgttggacgagatgctacctgggaaagataacctctgtttgaactctcagactcggatctctctgctattagtctgaggaaacagacagcaacaacgctgattacagccaccggcctcaacaatttttttttctaactagcaatttcgagtgcaagtgccacagtgtcagctaaagaaacacaactgcgggttttctgcagagcaaaatggttctgaaatgtcactgaatagctcacaaaggacgccaatctacgacaacagagacataagcatataggagaaagggtccacacatcctcctttcaaaggtatgttgtttacatgcatgtaatttgtgaaacccacagctattcaattcagggttttcgcagaagtctaaaccaaaatctgtgtagaaagcaattatcaagattcctccaaaagtcacagaaatttgggtgtggggaaattatgacatgttatacacataaatagatgccctacatagtacatgacctatatagtatagtcttcaagttcccaagacatcaattatggctgttacgtggtgatgatacttcagcatcacctccatgtgatttgactcacaagttttcaaaagtggcctaaatctggacatgtcaatatatagtagcaacagttactttgagaggaaaatatggaatgttgattccttaaagttctttccaggaatgtccccatggctcatctgacacatggtaagggtatatgatggtacacctatgtgacaaaaagagccagcatgacaaaggctgcatctatgccaaagtaaaatagcttttggtactgcttattttttcccaacttaaatggctatttgtaaaaatttaaatgactaacagaccagtagttttaggcacaaaagtctaaaacagagaatgaaacaacctgtagaaagccctctgctagactcttatatgatcactatgttttgcacgaagcaactgggcaaaggaagttgacttcaatcgggcaagatcacagtcaagttcagcactgctttctgattccatagacgtctaaatctggaagtgacagtgcaaaccttacttgtgttaaggaagaagacttattgtactttaaactaaaaagagaaactagtaatttgaacataaactacaacttgtatttcctttctttttaaagcagggacctaaaaattgtagcatatgataaggagaaaaaagtcatactttgaaaaaagaaaaggaaggtcatgacatcctaggcaagcaattgaaaggattcaaaaaattctgagtccatctttaaagatactttttttcttttacaataagcttgccgtttttcacctaggtcacagaaagcttgctgcagatcaggaaatgtcttcagtttccaaagcctctcatagcagtgagtcacttcctcttttttttttttttccattttcgctgtttatgggtaaacattgctctatttggatatatttaatatttttgtgtctggcacaaatttatccataaggatctagcttcttttcatacgtaattcctttaatttcctgtctgagatccacctgtagaattatacttccggtctccatctacatcctgtttaaagatatcaccgagagtgatataccaattttttaaaattctaagcattaggaaaatgagtacataacacatttatgtgtctatgtgtatatactatttatgtaaacatataatatatgcaaaacatatatgcatatacacatacgatatatgcaaatctgtatatagaaaaacttagtttactcaagattattaaaattgatcctgggaacaaaacaatacaccttttctaggcatttatccctactatagagacagagaaagaaagattgtgagagggagacacacacattcagatgagccttcagggaattgtatgaacttttgaaccagagatggagagccagagcccagcctgttcccactttaataaacatttttttcttcaattaattaaggtttggaaagaaaaaaaaaccacagaagagaagtaatttagcatgcaatgcatactttacagatggatcctaccttcggatgcttattaaatctatgcatgactgcgctggagaaaattaattgcattgtttctcactattggaaaataggttgcaaacagctcaaaaataaaaaggaaaatgaagcaaggtggttgttgttgtttaaaaaaacagctatagtataaaagaaatactttcaaagtcctaaaacaagtaatacccacgactggcataagagcatagatttctttaaaattgttttgatgtttcaaaataccatatatgctgccagaatacatgtatctactttaagtttgcaaatattctggtctaactaaaatttcctactcagtagcatttgaactattcagttaagtggtaagtttttgttcaaatcctgctgtgaggaaagatttacgtgagcagctgggagtagacactggcacacattcactgcatcatggttggctggtattctctccattccagtcttgggaaaaagtgataacttcctcattttttcagagaaaaatagaaaatattattataaaatattcagaatacaggtaatcatttgcattttatcatctttaattaggaaaaaaaaaagcactacagcttcagaaactgaagccatttttccttttctgaaggcctgctggtggaagttgaactgtaacctctcttagactgtcctgaaaatgacctttatcaaacttgaaaggagcattctctgtctaaggagttagacattaattttcctaactcacatatttctagatttaaaaaaaatccttgtgttacttccttatagacactccttttggtaggccttaccctgttgttgactgactaaaaacatttcacttaagaacttctaaacttacttgattccatgacctaaatagatggtggttttattttactctttcacctactctaagtctataaatcagtctctctaatccctggttaacatggttattttaaactatttatcatgacacaaattttgctaaaagtaacaaactaagtacatataaataaatgaatcagtcctgtgtacaacaagttttgtagatacgggtaaatatatacatttactaacattgagatttatttatatagtgcctttcaccagcagatcttgaagaacaatataaatgaccttataaccttataaatagttacagctattatcattcttagttaggaatggggcaaaacaagatcatagatagtacaaaacttctaaaacaagtgttcacttttattcccttgctttaacttttaaatcagacctaccacccttttagggtattaaccaattaaaagtagagtctcatcaatgattaaaaatatatatggttcagttcaggcacgattcaaaagaaaaaaagccatgctgccatgagaaactaaagtcaaaaccaagccaatgccttgagctgctagagtttttgtaaatgtgacataaaaatgtgtggttcttattttattggttattaaaaagaacaaaagggcctataagggaatggacctatgtaactttaccatttcaaagaaccattgaaggtataaaaacagggctggcttcagaaattttggcagtcgcagtcttacttaagccaaaccactctgataggtataaaatgcctgaataatataagcgggaaaaggtccaagaagggagatttcttagtttaaggcacctgaacctgtttcctgttttcagaaagatctcttctgtttgctgcactccaaccttgagcagccactcccacagggctgactgcagcctatacctgcacatttgacctgcctcttgattccagactctttccagatgttccagcgtttatcttttaaaagtttcccttgcagttgacaccatcttccccaccttaaatatttattggaaatgacagttctgtatgtcatccttagctattggtcatctaaagtttccggacttctataaagaacctgtcacattagagtattttattatctttctgcataagtcagagtgagcgtcaacaaacaactagtcagaagctgcgggcaaagcagttttggtagcatggataactcaggctctccttggactgattctgattgactatgtggaaggggttaccctggattcccaattctagaaaagtagatgattgaattcactttcaggaatccaagagtttagaataagtttcagattttgagatactgactataaaataagaatagttaaaagacaaaaattaaaaactcttaactgttttagactttattttatatttcttatgcatcttacactgagtagtacactattcccttggagcaaaaagctccctgatgactacgtaattcgcttcaagacactatgttttgatttagcaaatccctgtattcatttatttcatgagatcctgttttcatgaaagagttaaactccttctataaggtaaagagcttaatcactatgggatgagatattttttctattttccagtgcaattactctttttcttaaatctaattgaattcactttccatgttagtgggggaagggaagtgggtaggagggatgcagcatatgttagaagacaaatagtgtaaactgtagaccttttaatacagtggatttttgtaaagataaaaaattgtgatctgataaaaatgtttaatattcagtggtatggcaggcgtgggggaaattttgaccatcagaaactggattttgtgtatggagaatatcagggacattgcataaggaacattcgtatttataatttataaagcaccttgggattctctagacgaaaagcaccatataaatatgagcattttcatttcatgtgggtgatcacagaatgttggcatttcagcataaaccatatttcagtagtgaaagggatataaactcttatgtagatttggttttgctgccattttctcttccctgagttgtaacatacacaatggagcatgcccttattggctgcctcctttaccttttctaaagttcctgtctatttcgttttgtctttgtggtgtcaatgtactgtccagcatttggctttatactcataagctagactactgaaggaagtaaacatttatcttggatctatctggtatagtgttttccatccttcagtatttctgatgtctaagggaggaaaacctccagatatcattgaagggggaagagggggaggctgtcactctgtggcacattaagacacagtatagaacaggagactactattatttcaaggttctttgaaagttctttaggatatgacagaatatatatgtatgtgtgtgtgtgtgtgatttgaaaatctggatcatacaatcacattttaggggatcaatctgacaaacatttattgaatgtctaatatgtgctgacagcccacaatcctttggagatgccagtgtatgtaatacaatgcaggtaaatggtggtaggcaacagctatgataactgatcaagtaaaatgcaagacaggaaggggttgagtccaacctggggcaactaggaagccagctagagaagagggagtttgagcatggcctggaaggatgagtgggtggatgggaggatgggaaaggcactccaggtggaaggcacagggctgggtttgcggaatgatgatgaataatcctgtgaggctggggtttggggcatgagtttcacatgtaggaggtaagatgaaaggtaggctcagtatttcaggtcatggtttcaaatcctcttcaaaataagtgtaggtcatgaagctgcagtgttatgagaaaactgtttttaactatgagtgttcctagcttattatttcccctgtgtgctcaagagtttctggcttcactagttcaggtccttcccaggctcaccatcatccaaggagggctctgccattctcagtcaagtgttttggccttgtgatgcagcatggggagaatgtggagaataagatacttaggttgacagtagaagacagggagcaaagaagcagtctccaccccatatcttcaaggattaagagagacagggcagaatggcatgggactgtgagagagttctgggacaggagagtgagaggctccagggagttctggggattttgaaaaaggaggagaagttgccttgtaaaatgggctacaggtatttttgaggacagaaattcctacttttgttgtgcttctgtgaatgtgatacttcttcaggactgggtcctggtgtcaaagggatagacagctcagtgtgagattgcatgtgattttccatggtctggaggctatattatatttattaaccacatattataccaagagagagtgatgaggggtgagcctaaaaatgaagtggatcagaatcttttagcattttgctcctccatgaattctctatttaatgattaatgtttgttgaatagattgagatggttctcactgtatatattaattactgcttaacaataatgtgttttctcttaatcctgtcacatctctttaatggctgccttaaacttccactttccagtctccctaagctctaggccagtccctgctccatggctttttactcttagtaaatggctttgccttctcctcccttcaagtaaaaatatctccgtatcttcattctcttctatcctttaactcctttctctaaggaatgagtcccctgcctgttagccaggactgattcttgtatagtattgactgacccatttctacctttccaggacctgattctacccattatcttctcttttagactggttctttctcatatgctggaaaatcagctcagatctcccctctcctaaaactaaaacaaaataaccaaaaagctcctctctcctcctaccatttatccctttcattcttttcaccaaacaactttttttaggtaacatatacccacagcctctagtttctgagtactcactcactctaagatcactaataactaggcttgtttttagtagactactgaaactgctccttggaagatgagcaaagatcttcttgttttgtttcctctctattcccaccaacccttcccatcagcccaatatccaacaaattataaattttcagggagattcccaattacctatctttatattccttcagcacctagcattatgcattgcacatggtagagactccatgagtatttgaattgaatctagatttctttctttctttcttttttgagatggagtctcgctctgtcacccaggctggagtgcagtggcgtgatctcggctcactgcaacctccgtctcctgggttcaagaattgcttgaacccagcaattcttctacttcagcctcccaagtagctgggattacaggcacccaccaccatgcccagctaatttttgcagttttaatagacatggggtttcaccacattggccagggtggtcttgaactcctgacctcagctgatccgcccaccttggcctcccaaagtgctgggattacaggcgtgagctaccgcacccagtctgaatctacatttcttagaccttccttatggtcccctggctcctgattttcttccaccatgttaggaaccttgcagtagtctcagtgctacaactggcatcagggcacatagctttctttaatgagcttacagaaataggaaatatctcatcctcagttgtacacaacaaaatttttaaaaaattatcatttatcaaaaaatataatgaagactatgttattttgattttctgttgagattataggaaaccaacaataaataatccaacgtaaaatagcgtatcataatgatcaatggtagtgatcaacaacttaaaaatgaattcaaaacatgctaattagccaaacttatcaagtgagtctcccactgacccaaacataaaccactttttatattatttgatagcctatatttcttgagcattttcccagaaagtgcttcaggtggctgatatgatatatactaaactatatccaggaattgagccaatcactactataataatatattgataggacatctttaataaatatgattttttttttctgcagagggtagaagaacacatattcttacttcaaatccaaacacttaaagataatcaatgagatgtagggacttttgtactactatgttgctcttgcgtgtcttatattgctatggaatttcactaacaggaagtgaagtttccttctcccctccatttcatggaaaacctttaagagtggtgaggagcagctgaagtgccactcaacttctttcacatgtatatatgctgaagttactccgccaattctctaccctaccttgctgtccaccttattgcaagcaatatgaaatgcccaaggaagtcaatactagcttactatagttgtttacttgtagcattcctttagaatgggcctaaccaccaaaaatacaaagaatccatgagtttctgtggtgcattctaatgctcagttaaaatccatcctctttgtcactatttggttcaacagtttaggtcaacaaacactctgggagcacttacttggggacaggcattgtgctagggctgcaaaaagccagaatccagtgagggatagagatttgtaagcacagaatttccatataagactggtagtgatttgaagaagtcaaatcacagtgaataataattttaaaagagtgagctgtgttttgggcaattatatattttaaactttatcttaaaatatagaattgctcaaatttaaaagttgaaatttaagtttttaaagatcaatgaaatgctacaaaaataatatataaacaagtacaaagtgaaaaaacaagacaaaaacattgactagcttagtcactgaacagattgttctcaaaataaagatctttaaaggtagcaaacttggccaaagaaatattggagagtcttacttcacaagcaactttaaatttgctttctggttatgctaagacattaccaggtgatgagcattccaaggccactgtcctgtgatactgtggtgggaaagggggtctcctggtcacagtatggttttctcttttgaaggctctctatccctagatattctagttcaaatcatttctcatctcaaccacttcaaataaactatgaatagtcttttaccttaatgcctatgcaattcatcaaatactactcagtagtcttggaaatataaatagatgagcattttactcttaagaagcactttattcacctggtctcactacagctctatgaccaaagttgttgagtgagtatgctaagaccatattgaacacacataaaggaggcagactttaaagggaccgctttccttcaggctcctcaatttttgtggctatagaaccatcttatgtcagaaaactatatatgtgcaaaatattagttttctgacaaaatatctgtagaatacacaggcttggggaaaaaccttcaaaaatttgactccaatgggtatttccaagatgaaatacagtcctctgaatttatcatacctaggacacatagaaggttgctagataataaggggatattttcttgctatctatgaaataaactgtcaatgtttgggaaaccctaaggcgtacaggtcactagactattcaggagtgtgaatgctaaggttataactggggattatacacagaaacatcataatatgtgtgagatttcatattttgtttttatcacatcacctcaatagacactaaggaaacagaagtaaacttgggaatggctgtgagttttcaagttaaaagaaaaaatgaaagagttttaaattcacaatcagctatattacttgattttaaaagaagggatgatttgctacatctaatgtaataccaaagtattatataactaaagtaactataaattaagcataatggacctctataaaaaacacttattttatgtaataatgacacttacagacatttttgtatatgcatttttggaaaatccaacttttaaatacagataaggaaaggaagtctctaacctgtctaattcctggttctatcatacaagaggataaagacattttggagtagattcctttgaaagttacaataatagctggaagaacagaaagcaatgtagataagcaaagaacaaaagtgtgggagaatgatgggaaattcttaatttcagctgcaggaggtgatgtagaagttatagaaggtagtgtagaattgtgtagaagacagagacaagctcatctccacttctaaaaattagagctaatgggcttctgctgtatcacgagagactcagactaaacatgagcaacacaacctgataggaacagccattaacataaagtggctttttaaaggatataatgaaacatctttctcaaaatatcaactaaacagaagtaattattcatctttctgagatactttagatgtagtatttgttttccaaagacaagctatgggaagtcttgttttccaaggcaggtttcaattctttagttacacagtattgaattcaaagtagtaaccctaccattggagctaggaagtcattgaattaaaaaatttctttaacaaaaagaattccctttactctgcattctcaccaatatctgttatcttttgtctttttaataaaatccattctgactgggaaaatttttttctttaatagtagtaatgaactagagaccatcaggttcaactccttattctgtatattgagaggcaatatagtatagtgcagggattgtcaaactatgacttgggcaaaatctcacccacaccattttttgtaggtcttagaagcttaaaatgatttttatatttctaaatggttggagaaaaatcatatcttgacatgtgaaaattatatggaattcaagtgtcagtgtcaagtttttgttgttgttgttgttatttatttgtttacttttaaagagacagggtctcactttgttgaccaggctgctggagtgcagtggtacaatcatggctcactgcagcctcaaccccctgtactcaagtgatcctcccaccttggcctcccaaagtgctggaatgacaagtgtgagccactgcacctggcctataataaaagttttaatggaacacagccacaatcatccatctacgtattgtctaaggccacttgcacactatgatatatttgcgcatttgctgctcttgagactgtatggaccacaaagcctaaagtacttactatctggccctttatagaaaatgtttactgacctctggtctagtggctgaaggacgtaaagtctaaagctagattagctgggagtgatgctggaaaagatggagtgcctcactttcctgttccctgagttccagttctgtcaactgggaacaataatggtacttatctgatagggttgttgtgagaattaaatgaaagtgtttagaacactagtgcctgctataaagtaaggattcagtaaatgtgagatatttttattattacacatgaagaaactctggcctacagagataaagtaacttcacaagttcatagaatttgctagaggcagactgggagaatttcctgattcttgcttacattatattgccttttttattttcaatatggcctgaccaaaaaaaaattgttgtggcttttttgttgctgtttttaaactacctcatgggctctctaaatgaaaactttagtttcaccagactcttctcctatcaatcctgttacctgtagttgcccaaagacaagttgtggaacatttgagattttcaagttatacataaagcttctagaagttaaaattttctttattctttctaaaacaggataatagaggcctctacaactcaaatctgacaaatgtgttaaaaatttttgttgctgcaaaaccttcagaaacaaataactgaagtatgtatagagaccccaggatctgaaaagatggcagattagtccatgagcattcaaagatacttgttattcccagtataacatatcccattttctctggtcattttttttctttattaactcttgtacattaccaacacaaccccagattttgcttattctatgaaacctcccacacctagaatgtctacttagtggtcctggacaaccacctttttcaaggctttgttcataagaggacttacttcattaaatccactcccagttggtcactccattacgccacatttccttgtcagttggtacacaattttaaacaattatgcatttgtcactgctgtctaattgttctctagtttttctctttctaaataatatatcttgcaacaaaactgtaattccttataaccagttacacaccttttttaaaaaaaatcacccatagtacttagttgaagttatttaccatagtaggtattcaacaaatgcttcttgcattaataaatgaagaaccacaaatacatcctatgaacagaatttcaattttagaatgaatcaataacacctttagactaccatcaagattgtgaaagtgataatttttggtacatgaatttaaagatcatctaaattaaaccaaaagtgtaaaagtaccttcattaaaatggagactacaacctataatagagaaattaactctagatccctaatgcttattactcctttcggatacatcattccatgacactggaaaatattagatctgatagggattttgcaggtagcggtaaaaccttatgtaagtatttttttaatccacccacgaaggattatgttgaattcccagacaagtataattttcatctgcatgtctaacatacctatagcaacattacttaatatatgagtatgtgaagtatattttattatagtagtagacaagcaaactgaatgtgtcccaggaaggggtcttttccattaacttttataaaggctttcatttcaaagtttcattaacatctgacaagcaagctgaaaaagctttgcttagagcttaggttaggggcaaaatgcattttggtagaactattccaagattacactgactgactgtgcgagaatatactaatttgttttgttttgttttgttttgtttggagtgtggagaaaagagagagaaagggagagaagagtcatggaccctactttatggttgccatggatgcaaggtcagccttccacacttggatctaccagcagagttcagacaggtcaacgtgtgaccggctcaggccctggggttaaaagttcaagcagctatggaaaaaccaatatgtccacgcagagtatgctgtacaatttatttcaatttacatcaagccatgcatataaaatttagataaattccattcagatctgatgttgcctgacacacaatgtatgcaaacagatgtctgtggggctttttctgtgctttagaaaacaacattaaatttaaaaatatgtctctgggatttctttattgaattacaaaatgaacataattttaacttaaatgttttcattcttttttccaatttttttgtgtgggggtcttaataatttctcagttctcaatctactctatgtcatattaaagaggataatgtatatttacaactacagcttcagtgttattgtagttatagattctatttatatcccttaccactttccgcaaatatttagtgattgatatttctgatttatctctggtttctagcctcatctccattcctttctactttgaacatagcaagtcctggaggctgctgggtcgtcttccagccacaaggtggctcccccaatcccttctctcaagccaatcgatgtacacctttgctgagttctccaggcggactacaattcagagctaattatgatctataaatgccattattttcattgtgaagtaaatggcttatgaccaagaccctggtacactaagatacaatgcaaaattagtctttaaaaataggagaaagaaaaatacctttgtatttgcctaatttctcttcacccatccttccaaaagtacaactgagctatccttagagtaaaataagaaaaataataaaaggctccagaggaacctaattttgttgtcaatgaacatagtcatagactagacaaggtcaaattttaagaaaagtatacaacttattctcacttaaactagacctacttttggatttgatattttaccacaagagagttttgatgagaagactttgcaaaactttcttagaagtcccacatcatgccatcattgaagaacagtgatctccaatactgcaaggctttaaaaggagtggaaatattacatatttcctttttgttgcttagcaaacatgttgcatatttcataaatgtgatttttatagaagacatcataattttctacagctgaaataggcatagaaagacaaatcattcatccaattacatggaaggtctttctaaaagtctgagtcctaatttctcacagtttttcattttctgttctggagagaagctatttaacctttgggcaagtttcgttttccttatctgtaaaatggagataaaaataggaactatgcctcatgggatttttgccaggattaaatgagttaatatacataaagcacttacaaaagtccttgttacataataaaagccatataaatgtttgttattattattattgtttatttgagctcagttcctccttgacaagtacttcatgacacaatcacttgagaaaaataaactttcatagatttcataaagacctgaaaagtatcattttttttgatacctgagagctctgatcggggtaactgacggtgtatgggctttttcttcctcaagaactttaaaaaattagcattttcatcccaattcatggtattactttcaatatgacactaaaaaaagaaactgctgatttccaaatctcaagcaggttttagataacactttaaaaaatgcatcattttactaaagcaaaaaacaaccataagtagtggttctaataacttggttccgatatttgtattgtaaatattttcatgttacttttccactatattaaaaaaaaagtctttaggagcttactcatgccagaatataactttgttaagcctcttgttaaacttagaacgtatgagtcccctgcttctaacataaataaatgttttgaattccccagtaagcatggccttgacaattctcaagtaaattttctaaggatataaataatatccttaacttaaggtggcctgtaataattcaaccatgagcaaaggcttatgtggacacaaaatcctgcattcacataaaaccttgtttgtataaggaagggtctctatgcacagatataaatatatacatatgtgttggtatatatatacatatatgtccacatatatactctcttgaaacctcccatctatttggaaatacatattcagagaccaagaaagataatcaaatccattttcaatagccaaggagaagagtatgacatttttaaatacctgctatactgtcatgcaactctttattctttattatgtctgtcagctactactaggtgcctagtagacaaatgctagttctagtcctgaccatttatttctatttggaataatttcaagcctaactctctagaactacttgaaaatgttgtcttggtatgttggccttgcacctttaatgaggcttggaataagggaaggtggaaaggaatctttgggcaatgacaatttggcaccatttttgagggaagcctgtcttggttttgcctgcacttgcacaaatactacttcgaaagaccctctttccattctgagcaatatggttgcattaccaaaagcaatatcttttatcagaagcagtttttgctgcatgcaccaactttcactatattcttagcaactctttcttttatgccagttccagacatcagttaacaaaaccctttaacgaacagatgtactgaagaaatgcatcaatttgttatttgctacagtttggggtgtctgtcctacgggttttctagccaaagccttatatgtttcccaagagaaatttactttcatgagagaagaaaattgaggcaaatcactgctgttagaccctgaagtcagagacactggtttgttgtccttctgtacatgtgaagaaaaactccacagttacagaaacaattgtggttccaattcatctctcattctctcccaatgtgaaaaattacaaatgaaactaaatttctgtcaatagaatgtgtatgattacagctgttcatattttcactctaatgaagggctgcacatttaattgtaagatttattagagactgtacattgctatatacatgcaaaacagttaatcgacatctaaaatgctggttgtttattctgacattaataatcatatttcttaatttgaaacaaaaagcatttggggaaaatgtattttgtttcctccaaatcggaaaataataatttcaatgtaagaaataaaaaggcaagagaaaaaaatattgatttatgtatgtaaggcaggggaacaattaaagatgcttaaaaaaaaaaagtccataatcccctattctgctggaaacaagagagttgattgccagctttgtttgatttcacagagatctcatacgaggctgggttcataaacaggtgaaatgatggagtttattgcaacacacatcaacactgaaactaaataactgtgttgccatctcagtcccactgaaagacggatggtaaacttgacctgccgctggtactatccgattgccattttttattcccccttcgccgcccccccaggctgagccacgttgagtaaatgcatgtgcacggtcaggtcagaccccgggatcgggtgaaactccgttcacatttgcatacaggcggagtctcacaatgaaagcccatctgttcccgtctcggagtacaaatcgagtgtcacccaactcactgcaaacgacagaagcatggccattagatggaggaacactcagctcaggttacggatatggaactgctgatttgggtttaaatacctgatcactgaagacttttcattatatgtgaacaaagaatgaactttgaactgctcaggagataccctctccccacattgggcatccccagttctatccattaccaatacgtaactgctatattttccactgactctattttttgtataaaaattagccaggctgagtgtcacaatgccctaaataattgcttttttgcgggggaggagggaaggataagggtaagaggtggagcagcaagggatgttgtaaatagaaaatgaactctgaactctatatgcccccaaaggtcattaatatcatggcagtgctattccttgaacttctaaattttaccagggtagaaattttagttgccagagtttaaccaaagtgtgaactgcccctgccctttaattcctccctcccaaacccattcagttaagcgaggcacctgcctcctaggatcttcactcacgggcctggttattccaaaatagtttatcaatcacgatctgtgtcagagattacttttctgttaaaattcggcaagtactttagagtttacagacagaaatcacatatattctgacacaaaaagatagagctgttcaagaagaaaccccaggataataagcctatccaagcaccagccatgataaatacaaggaaaatcatgagcaaaaatatgggtaggatttcatcaaatgctttcttgtcctattttatggcaagaatctatttctacaaaaatctttctaaggaagacacaagcatctggggtttggctacttgtgtttatatttgaagtacttctgtattctgttacatgaatcacatttaacattaacatacgattttagccattagcccagtttgggctccagtgcatgtgtggttacatgtccaaacacacaaactactgtagagaaagcagattgccagttttccttttaccggttatgcttcttgttttccaatcagtaatagtgtcactatatgaagtgcaaaggtaaaatctgattgggtgaaaaaaaacttttaatatctgcaagaattttcttgatttgttttaagtaattaagtaatttgttttcttgcatatacttctctttcttaaaacacttactagaacaattttatagaaaagaatgtattaggatgacgtagaatccagaatgtttaaaggcctttggtcttaaaggctgtgtctcctcagcaagggtttctataacactatgtgaaactatgttcttattgtttgtcctttaaaaataataccagggtaaagaaaagatttgagggctatttcttttttcatcccatgcaagagcttatggtcaaccttaatggaagttctacatgcattaaaagagagaatagaccctttgtttcagaagaatgaccaagacaagggtgaatttctgttccactttgtcaagtttaaggggaaactgaattcaggaaaagagagtgtgagagagagagacccccaaacaactttcttagctgtctcctcattgcctccaatcttaaacttataacgttttattgttattctgtaaacaagtcaggaatttgcattaggagacacttggccatatgatatcttggaggtgggctgtttatttgcattccatgcagctgggtgtcttctgtgtgatcagtaacaaagcagaagaaactaacaagccagaaatataataccagaggttttctttctgtctacatcaggagaaaatgctccattaaggaggtataactactttaattctatattcctaaagggatatggatgagaaaaaatcttcttgttccaaaatgataaaataacttgtttatagaaatatgggttgcttggtttcttgttatgcactattggtggcggggcggtgggggggtgggagggcgcggctggtgtgaacaggaaccgaaccttgaacttaatttcccctttgaactcatgacctttgacaagattccccatgcgttccccttcagacaaatttcatcacaattacagccccttccacttgagttaaagatatataatcattgatttgacctaattacctgatacatccctttctttgcaaggtgaaggctaaatgtgtgaacagaagctgacccgtgaagttctgatatccaatttttattctaattatcatagaacactttcagtcttactctatttttctcaagttttcttttggtcccttccctgaacccactattccttcaaattcaacaatgccccctaggtttcaagctgcttggcaacagaccttccaatgcattatgcactacatgttcaaagtgtcatttttaaacaaaaaaactaaagaccaactctgcattagaaagtcgtcactaatccctgtctttcatgaaaaagtcttctgaggagataaaagagtggaaactagaaagttcccacaaggttctgaaattttctgacttctcagcatcaatctattatgattcagactctctcctaataatttacaaacttcaggttataaagcaaacacaggcaatatcaatagagttagtataatcagtttaaaccatagggctctgtactttttaaagggactatgtgtgtgatggtggggaggtggggcatgtccgctaagtttggtacaacaaatcccaagcaaagactttaataagaaagtttaaataatgggatacatttttaaaaataaaatatgtgatttaaaagcaaaactaaggttgatggaaactttatgagttgactttaaaaaatgaatttgtgaatattcgtctctaattcaagttaatttttaaaaggaataaactgaaatcacagatagttttcattatcttgtcttagactgttgaaaaagaaagatgaattgcaaaaagttaaacagcaaagagtaaacaaagaagaaattgttctcacttctttatgtcatagtttatatacaggggcatcatgttctctcagaaacaaaatgacagtcgattttcctttatatcatttttgcatcatatccctactgcctccaaacattaacaggctttataggtagaagggacaaaagacttggaaagaaaacaccgataaagtcaaatcacctgtttattttggtggagcttcttgtgtcctcccttacaaaaattcaacaacattggaagaaaaaagtaatctttcatctgaccatcacagtggacctgtatcctgcattttattatcagcaattaattttaattatactttgaaaccaaaggcctcagcaaacagggagggaaaaaaaagtaggtggctaaactctttaagtaggaaattatcacagtgtacacagagggaaatctcttaaaaattaacattttatggtgtcaattgttactagggttggacagacataacaaaataggctggaaggttcccacaatgttgggccattaggtagtttctaaaaggcaggtaaaatctgctatgttccatcacttagaaaagtacaaaaattattttaaaaaaaatccgaggaatacttgaaaaatgcctgatctcaactcccacttctacccaagaacctgaggtgtaaccacgaaagtacagaggaatgtcagtttctttgatgaaagcaacacatagccagatggctgggatccatgttaaaaatcacatcatggattataaaaacattgtttctaattcctgttggctatcataagggcctttgttaatatatattaatattgacatcccaggcaacattccaggaaacagagagaaataggatgcctatactgtgagagaaatactggatttggcattattgttctaagcctcaagatagttcaatgacaaatggatggatagcaaaatataactaaaacaaactgccctcactagcaagtcagaattccaggtttaagaagtaaataaaaaattagtactcatataataattttaggattgacaaaaacagggatagaaatgctggaacattcagaaaaatggataaatgttatatctctggggttgagcatgctctgaaatgatcctctacagtcaagattcttaatgtggtatctgtgaacactctgaaattatatgcaaatatgcatgtgtgcttccctgtgcatgctcatttttatggcaatgaagaaccactgctacatagtgataagaaaaagaataacaggacaaaaataattatgacaatttccaaagaaaagacgttggaagccaatgaacagccagcatcatctctcatgtagaacagtgattttcaaacttttaaaaattgatttccccaactgtaaatttttattagacacaactatccatttactgtgtatacttacagatcttatatatgatactaataattcattaatattacaaaagcttaatttatttctcatattcaggttgagcatccctaatccaaaagcccaagattcaaaatgctccaaaacctgaaactttttgagcactgatatggtgccacaagtggaaacttctactcataagtacttaacacaaactttgttttatgtacaaaattatttaaaatcttgtataaagttaccttcagactatgcatataaagcatatatgaaacataaatggatttcatgtttagacttggatcccatccccaagatatttctttaggtatatggaaatattccaaaatctgaaatccaaaacccatctggtcccaagcatttgggataagggatactcaacctgtatatacatatatgctaatattttcctcccatcgcctatggatcatccagtatacctcaccctagtctctcccctcttccactcctatcccccttaaaatcaattctacaaagaatagttagagaattcttttagaaatgtaagttatattatgccagtctgttgcttaaaactcactagttgcttcccatgatatgcaaaataaaatccaaatatcttactatggcttcagtgacttagtcctttctgtctcttcaatctcatttcctaacactctgtctcactctagccacacaggtgtggctctagccacataagtttcttgattattccctgaagacactcaaagatgggttctacctcagagcctttgcatctgctattccctgtgtctggaatgctcgtcccttagatcaacccatggcttgatctctcatttcattcagttttctgctcagaggcctcctctgatcaccctgttctcaaagagatctactgtcaccctttttagtcattctctctctgcctttcagtcttttttgttgtgtttagtttcagaccatttaccatggcttgacattatataacatatcggccccagtaaaatatgagctctatgtggctaagggttttgtcaacttcgtctctgtgtccccagtactagtctaaggtcgtgcacatagtaggtcctcaatgataaatgaatagatgaagaatagtcaaagcaattggcagacattccacctaatgttcatttgaatatgaacctcaaaagaatgttcacatgacagagaccaccacgctaagatgagctattgatcagactgctaaaaatcagctctctctttccccaacttgcataacactgaaaccatatctgccttatggtatctatcactatttcttttataccattcttatttcatacagatcttatctcccctagtagcctttgtggaaaaaaatcccaatctgatccttcatcttctcccttatcacatccaacatgtggcaggtatccagcccctggatcatgggcagggctgacagtcacatcctggccatgacaatctgaggcccagatgctcatgcaggagcgaaaagtgccagcctctccgagccatactgaatgatgatccttgactctatgctcagacggatgttcatgggcattcatctgttgacaaggctgaatgaagagaagggactcccaatggaaataaacctatgaaaaatcaccaatcccttgtatgataattgaggaaaaaaagtatctcaatgttgatataaaaaagacgaacataaaataaagactaaacttaaatgatgatcagttgaccttcatttcttttttaggggtcaattcccaaacagaagtagaactatcacaaacatggcattaaacgttttaaaaattgaattaaattaagaaatcaagttatgtaataggaacaattttaaagatgaagaaatgaaagtgctcaaaggtttggactagcaaagcataattctatacttagaccagtaagctggtcatataaaatgttcataaaaatttccttttgaaataaatatacttggatatgaataattttcatgtaccaaaagttaaataaaacttgaaaacaaatgataataggcaagttgcttaacatttctacatcttagtatctttatctgtaaacaaaaggaactgaagtaacttcaggtcacttcgaggtctgaaataattcaaataagaatctagttgagtttttcaggatggatatgtgttttatgcttatcaatggctgaaactagaacaaatattaaactctcatgagacattaagttagaaggcatcatacaaaaatcagcaaaaacagagaagcaatcaaagggtagaggtagaaactgaagtacttcaagaataaaataaaatggagttaaatcaagaaaaaaatgcaatcaacaggtatgagagaaaaataatgcaaaacagaagtatcaataaaatgaaaagatttagaaagtgtaatactgtaaaaagacttaatgacaccagaaaagcgcaaataaactttcattatgacacatgaacaataccactgatttttagatttcatgtaaagcaccataattcataagcccataagcccctaggaagacattcatatttctacattcttttgcaagaattgccatgttgaaacagaccactggtccatcccttttgccatgctgccctgacagcaaacagatgtttcagagaaaagctctactctcaccaacccaaattcaataatacacctaatggtgcaatactatatcaagaacatcatttctttttgacctcagagggcaattatcttatacccaaagcaggaggctggctcactttgatttcacgctgggtggcccacttaagaggtcccacttataattacatcaagactgatattttcattcacttggcttttctgacacactaagctacttacacaatttgctgtcatcaccgtcacaattaggctctcatgtgtttggaataatgtagggataatacaaatggttgtatttgtatttgtaactgtccttttaaaaatctttgctttctgtgactgggcatggtggctcacatctgtaattccagcactttgggaggccacggcaggaagactgcttgaggccaggagttcaagaccagcctgggcaacatagtgagacttcatttctacaaaaaaaattaaaaattagccaggcatggcatgtgcctatagtcccagctagtctggaggctgaggtgggaggatcgcttggagcatgggaggttgaggctgcagtgagtcatgattgcaccactgtttagcctgggcaagacagagcaagaccttgcttcagggaaaaacaatatttgctttcttaaaaattaatatttctattattagcttcagtttattcaaaggctcgagaattcccaacttaatgtaaataaccttcttgaagtggaaacaaaaaggagaaatgaacctttaaagaagtacacataacagtaagaataacttttgaatacatgaggttttgggctttatgaggatggttttctgagagagtgaacaaaacagaagaaatagactggaatggcaaaaggaattgatcaggagtatgaaactggagctggatctcagttgtttctagtcccctacagatttaaaggtacattgcagaagcacttcagccataaatcccaaggtcttctcatctccagaggaatcctttttgggacaatcttcacctgccacaccctttctatagtcctggagtagacaatttaattagagcctctagcatgacatttaaattaatgtaaaagaatagggattgggaccagcctgggcaacacagagaaccctgtctctagttttaaaaagaaagaaagaattggagaagactttttcaactgggaacataatgacaaacttggagaaatcaattattttctccatcagagtattctggacataagaaacagcagtagatcatggtagtcaatgatgttgctccatagcttgactggaccagtaattttaaaattctgggccaggtgtggtggcacacacctgtaatcccagcaccttgggaggccaaggtgggtggatcactggagcccagtttgagaccagtctgggcaacatggtgaaaccccatttcttcaaaaaatacaaaaattagctgggtgtagtggtatgggcctgtagtccctgctacagaagaggctgaggtgggaggatcacctgagcctgggaggttgaggctgcagtgagcagtgatcacaccactgcattccagcctgggtgacagagtgagaccgtgtctcaaaaaacaaacaaacgaacaaacaaacaaataaatgaattcctctcttttaataaaaattttgaaggcttgataagaaagcttatgaccaagtatctaaaatatcccttatgtgataaccaatatgataaccatctattaaatggacaaataatctcatagtcttttagtaatccaaaggttaaaaaaaccctgaaaacaaaattaccaggatatttcatgaggcaagagatccaaaggcatgcaagataacccaggaataaaaatgaagctaaaaggaaaaaaggatgagtttcctattgatgatatctattattaccaagaaacagtctctcatgaaccacaaataacagagtaacaattcaagaacatgtcatcaggaaaaactcagccttaagtattaattaagtgatcttattggttctctgtacaccttaaaaagcccctaagtctattctgagaggtataataaatcagtaatattatcttaagattaaactgatacttctagacaaggatgtctttcaaaagtaaattttttctttactctcctggaaataagttgctataaaaacctataacatagtagaaactcatagtgcccagcacacttataaatgttaaataaaagtaaattatttggcctgaactttataactcctaaaaatactaatggttactgcaatataaaaaagaaagtaagtttctcttaaaaatcttactaaggcaaagaaaacgcaatcagagagaaaaaaatcatacaagtttttatcaaaagagagaggatttcttggctgggtgtggtggctcacacctgtaattccaatgctttgggagccgaggcagaaggattgcttgagcctaggagtttgagaccagcctgggcagcacagtgagatcccatctctacctccaccaatttttttttttaaagaaaaagcatttcttactatcagtaatagtggtaattaaaagaacaataatgaataaaattcctagatacttcaaaactctcatttaactgttatgctgggcaaggagcagcagaaggctgtgattattgaatacattacacgtcaaattctttctgtttctggtggaaatctatgcttccaggcctaggccagccaagccaatgacaggcatccagataatgagcacccttagcatgtgaggtcccagaatttctccaacattttttagaggatgtgatactaatcagtaacatggctagcagtctccaacagaatggagagaaacaagcaacactcagctaaccaagaatctcactggagtatagaaggaactacccatttgtatatgttttctaattacccaaaagcaaagaatgacccctcaagaaatcatttgggccaattccctacctctctagatataaatatgtaacttgttcaagatagagagatagttagccaccctattttaaaagattttcaggaacaatattccacaatgatcttttctatccagctcatccttctgtctcattattattattattattattattattattattattattattattattaagatagagtctcgctctgtcacccaggctggagtgcagtggcgcaatcttggctcactgcaagctccgtcttccgggttcacaccatcctcctgcctcagcctcccaagtagctgggactacaggcgcctgccgccacgcccggctaatttttttgtatttttagtagagatggggtttcaccgtgttagccaggatcgtctcgatctcctgaccttgtgatccgccagcctcggcctcccaaagtgctgggattacaggcgtgagccaccgcgctcggcctgtttcattatttttaaaggttaaatggtctctccagtccatctctccattgaaaggtccactgacattgaaaggtcctcagcactgctcaccaacaccatggcaagcatctcctaatcttctctctaatcaccctttcctcccaaaatatgaacctgactaagtcaatctgtgattttttaaaaaatacttcacagctgcctatcaccttcaaaataaaggttgaacataatcttcacaatccatacccaaattatttttccagttttatcttctcctgttcctacctgtgcagcctatggtctagccatagcctactactgaattctacccaagaaacccctttgaatgtctcctttcatatctttgcttatagttcattatctgcctggcattatctttccttatttttaactgctgactgtacttcaaagcctactaccaacttaaagtttttgtagaatttcccattcaagatggattttacattactttgttctcttgctacattataaaattagcatattctaccttcattacttttgcacataaatctatttataagccaccagagggcagggatagtcttgctctcctctttatttcttagcacagagcttgcacaggaagagactgaaatgtttgctgaattgtattctgcatatttgtgtatgcatatatatttagacccatttcatttgatatgtggttcatttgggggtgggaaaattactagaatctacaataaagggaagttcattgacagttacactcaaggtataacggaaagagtgggctggatatttatgttcttctagctttgctacttattgattgttgccatgggtaagacataatatctctgagcaagtggctgctgtatctataggcggcaagtctatattccaggcaggaggaaggtgacagaacaaaagcaaaggtgaagacaggaagggcaaagggctttctcaactttcttattttggagagacagttcttctagtgacttcactttacaccttgatgtcagaactgtgtctcatgtccttattagaaaaacctgccctctgcacttttcagctgggcacatagcccctgtgaaataagggttctataagtaagaaatatggtagaatggctgggcgtggcggctcacgcctgtaatcccagcacgttgggaggccaaggcgagcagatcacctgaggtcaggagtttgagaccagcctggccaacatggtgaaaacccgtctctactaaaaatacaaaaattagccaggcgtggtggcatgcacctgtaatcccagctacccaggaggctaaggcaggagaattgcttgaacccaggaggcagaggttgcagtgagccaagatcacaccaaagcactctagcctgggcaacagagtgagactctgtctcaaaaacaaaaacaaaaaagaaaaagaaataaggtagaatgaacgctggtagacaattagcagagcatgttacaacttggaagagggaaatagttaagttttcagacaacagtaaaaaaaaaaaaagcaagagaaaaagaagccaagttaatgtggacaaattgcagtaaaacctcagaagagtgtatcaatcaccagaaagagaaatggcagatgagctccagcatagctaatgtatttttagtactgggaaaatatacaagaaattttattcacagagtccaaattatatttaatggattatggaaactcaacaattaaaaccaaataaaaatttctcacttagatcattagaaagttatccttgaaaatgttagttaaatgggctgccctgggcaaacagggcacaaaatccaaggcattatgatagaaagcattgtgacctttagctttaaatttagttattttcaaatttatttaacaagtatttactagtaataatatgcattatactaagaataaatgcatttgttgagcatttctatgtgaaaagtaccatgccagatcctagaggctggaagagtgagaacacaaagttgaatcagacattagcattaccttcaaaaaagaacataacgaagagggagatacataggaaggcctggacaaaaaagagggacaagaggaacgatgctgagtggggtcaggttccaaataggccacagtgttgaggctggctactgttcctaacactgctccagggacagatcagggagtcttcccaggtctggttggcatattctaagggacactctgacctttacaaacacatgctgctgttttgctgtttgctcctcacacattctcatgttattgtggattctcatgtattctgagctgttaacactcaacacttatttaatgtcacaacttctagcatgcttatttgaaaaaacaaaaacaaccaatgacctttcattttaaaaagtaacatgttcaaacagcaaacttagaaaatatagaaaagcacaaaggggaaaaaaaagcaacccataatcttataacacagaaaaacccactggtaacattttggtatatgtcctttccatatgttttgtatcctgccttttccctttaatatatcatgaacattttcctatgataatatgactcttctactgacaacatgatttttaatggctgcactgcattccatcacatggatgtactataatttattaaaccaatcccatgtaattagacatttaggttgtttctaattacttgatgttccaggaactatattatttccaagctttctgaaaagtaactttcattgcttatttttaattataaaaattatacatgttttggtgaagagaattatagtcttttttctttgcacacatatacataagcttcaaaaagtgggagctcactgtatgtactgtcttataacctaattttttcacttaacaattaacatctttccatagtcattatataaatattattctacaaacaccacttttagtggttgcacatattctgttgcatggtagtagctcaggtatttctcctgtttccaatttttgtaaacatctacaatgaacattattaaatgttattgtgtatacttattttcttgaattacattcctaaaagttgaactggtaagtccaaagggcatttacatttaaggtttttgttacattttgcccaatttcgactataccaaactatttacccacctgcagcgtgtggtcactccctatacttttaccaaacagtgagtattttcacctactgccacccaaccatggtcagcctgatacatttctattgctcttttaagacataattaaatatcattgccaggcgcggtggctcatgcctgtaatcccagcactttgggaggccgaggcgggcggatcacgaggtcaggagatcgagaccatcctggctaacacggtgaaaccccgtctctactaacaaatacaaaaaattagccaggcaaggtggcgggcgcctgtagtcccagctactcgggaggctgaggcaggagaatggcgtgaacccgggaggcggagcttgcagtgagcggagagcaggccactgcactgcagcctgggcgacagagtgagactccgtctcaaaaaaaaaaaaaaaaaaaaaaaaaaaagacataattaaatatcttttcttcagagaggctttccctcatctccagttttctttccaagtgtagttactgctccttccactatgctctcatatgaccatttatgctcctcatttttggtgcttactactctgtagtcaaattactgttcgaatattatctttccaactagactgtgtgcctgtttttggaggtaagggtcatgttttattcactgctgtagtcccagtgcctggctatgtctgacacacaacaggcacaataaatgttggatgaaggtgcagattagtgtcagaactccctgttttcctaaagaaaatgctccaagctggtttatggatttcaatttcttttaaaaaattttagattttcaagatttatttaataaagtatctaatgtcagacagttagtttatacttattttcttttggatttcaattctagatataatgtgctgtacaagaatccataggtgttaaataaaaataggaagtgtccgggattaccaaagtacaatctagagagaagcattcattagtagagtaatctttatggaagggaaaacaatgtatatctttccagactttgaccttcttctatttcagaatccatgacaaaagtgctctaccagatatttacaagcaaaagtcttcatactataagtagctttcattttaaagggaaaactgttcattaattcacacaaacacactttgtattgtcaaaaatgtacacacacatcatcatcattatctttgtgtgcaaacaacgtaaatctacaagttataaccaagtagaatatagggaaatttaaaaatagttatgttatattaatgttataacactttgtaatccttccaggggtgtaaagcataaataatttgacctttattataaacaatctggtaatgaacatccttgtacatacatcctgctctttgccagaactgtctccataaatgggggaaatgcatttgtttgttttagtatgggccagactaattaaaacttctgtcaaaatcttcctgcctcatattattcttaaaatcatgataagttcatttgtttcaaagctacagaaatagagatgataaaaacaaaagaaactatagagcttgtgggaagctctataggtcaaatggctcaggcgcctcaatcttctggtgcttcagaattgattggaaatagcatgtacaaggttgtctgtcattggaacacttttttctgcaaactcagcatccctgtaagtgaagaagtgatttcgttttgaatggcttatctagatcaaattcaaacacttggacattatagctcaccttataagtgctttccttttatgtttgaaaactgtcttaaatgtttgtttttattcctaggttgattgtggatcagaattcagagcaggacattaatacatatctaataatccccccactggtttttctagattattccccattctgatgaccacagaactttaaacttgagtattatcaagatttacagaatactgggaatttattataaagctctccaatctaaaatgctttcttcctaaagagccattttaagtgtcgaccacaaggtgtgtgacaagaaatttctttctttcttttttttttttttttttttgagatggagtcttgctatgtcccccaggctggagtgcagtggcgtgaccttggctcactgcaacctctgtctcccacttcaagtgattctcatgcctcagcctcccaagtagctgggactataggcgtgcgccaccatgccttgctaatttttgtatttttagtagagacggggttttgccatgttggccaggctggtctcaaactcctgatatcaggtgatctgtccgcctcggcctcccaaagtactgggattacaggcgtgagccaccgtgcccagcataataagaaaattgcgtaggcaaaaggtttatggtcattcagaagggacactaggatcaacacactaaagagcaacaactgctatttatttttaaaaattttaaatatgtattttccaaagtgatcactgaatattaagctaatggaacattctgtcagtttcgctacagaaaggtataaagttcgagactaagtgatagagcagaaaataaatcacggttttcagaccagggttccaatacatctgcactttaatttctcttttcttttgaaaaaattcttgcccatgtaagacattttattatgtttttaaaatctcttttaatctacatgttgcccttcatccctttcttttccttataatttatccatttaagtacaggaatatttgactctggagtttcccactgtctgcattttgctaattgcctactaggaaggcaattcaacatgttattctaaggtctcactcttaacacccagactggagcacagtggtgcaatcttggctcactgcagcctcaacctcctgggctcaagccgtcctccctcagcctcccaagtagctgggactacaggtgcgtgccaccacacctggctaatatttttttcttcattattttcagagacggggttttgccatgttgcccaggctggtctcaaactcctgagctcaagtgagctgcccgtcttggcctcccaaagtgctgggattataagtatgaaccactgtgccccgccgtgcctctgtttcttaatcagaaaaatggatactcatgcacgaaagtgttacagctcactgcgatgtccataattatcaccacaaagagttgaatactgagaaacaacaatggcaagagtgagatcagagaacccatactctgcaactgtctggctttcatctgggttccatctctgctacatgtgagatgtgtgatcccagatgaatctcatgctcggtttcctcacctatcaaacaaggatactactcgcctcatgagactgctgtgagggttaaatgtggtgatgcatttgaacaaggtttttaaagtgtaaagtgctataaagtgtacaaattcgtgacagcattacttattatcaggggcttaaatacttttataatgaaaaaatattttaatgtgttggaaaaatctatctcttgagaaagattagatatgacactgacttgaaacaagagggcctatatgacttaatgaatacttgtgaaggaataaatgatacccccgtactgaggaaacttacagccttatgacccaggagctctgtgatttctataggatgatagcagtgtaagtttctgtcctacacaaacatctcagtaccatttaaacaacttactccaaagccaccaatcaaaatgtcaagtaatgatttacagtgggtgaatactgaaaaaaaaaagtgctgatttttatttacctttcaatctgtgcaaatccattaactatggatgctaatgctcttcttcaaagcactttgccaggtcacttcctttcttccactccacatcctgttttctctgggcttctcacataaatttatttgagggctctcctgcctactcacctaccttgcccctctgaccttctcctcaaccagcctatatctgagccttcctttctactttccctcgcccaccaaacttccattccatctgtttttaaagaaatttctgaaatactattttcaggtactcttgactatttagtttggaagtcatttttctagagctgtggtcttcaatttggtagccacttgctacatatggctatttaagggtatatttaaattaactaaaaaattacattttaaatagtttcttagtcttccagccacatttcaagtgctcaatagttacaaatgttagtgactgctctactagaaaatgcaaatattatagaccatttgcatcactacagaaagttctattggacagtgctagagcccccttttctctacaatagtggaagacaatgtggtgtagtgggaaaggtatgaattttgaaattagatgccctttgtcttttttaatactggacttaaaagataactataagaaattatataagtgcctagcacaatgcctgccagagtaggtgctcaattcatggtagccattattaatgtgctactgctttttaaagtaactccggagtctctgttttccttttaccagggcacacaaaaatctggaggagtaacaatcaacgtggctgggcgcggtggctcacgcctataatcccagaactttgggaggccaaggcgggaggatcacttgaagtcaggagttcgagatcagcctggccaacatggtgaaaccctgtctctactaaaaaaatacaaaaattagccgggcgtggcggcaggcgcctgtaatcccagctacttgggaggctgaggcaggagaatcgcttgaacccgggaggcggaggttgcagtgagccgagatcgggccattgcactccagcctgggggacaagagagagactttgtctaaaaaaaacaaaaaaacaaaaaacaatcaatgctacttccttttctgtgaggcagtgtggcatactagaaataatatgggttttggaactacagagacttgatcaaatcctgcctctgcccccttattagtggaggaacttgggcaggttaatttttctgatactcgaatttcttcatctgtgataaggaaatgataatacctacaatgcacagtagtaatgatgattagaggtaatgtgtgtaaatactatgtctggcatgtggtaggcattcaataaatttattatagaaagcaggtactattaattcaccttatagagtgccatgcattcagcatagttatgtgctaagtaagtggttgctgttgttggtaatgaaggccaggctaataaatcttttgcaggatggtagtatttatgcttttgtttaaacacttctccctgtacagggctttctcttgtactcctagaatgcaggtaaacttaagtttttctctatggtattatcgattccagttaattatttttttaatttaaaagttttaaaaattttatatgagaggggaaaaaattgagtattcacaattcatcagaaagcctttaatttaccattatttgggagtttttactattataaagacatttatggagtggtatgtggattggaactgcagattggcataaaggactgctactatcactgtcaccaacaaaggttgcagcttaaaattttgcctggacagcaagtctaaaatttctgccatcagagcataatccaagtcacaactctaaaaagaaaaaccaaaaccaaacaaaccaccagaggttaaacatatgcatgagacattggaaggctgggggaaggagaagggaagcattctgcaacccgccctcttcattcatgctgccagaagggcaaataagaattgtgtccctcttgcttctggcagttggcacaccctaagtgacagcacatttcaagaagctgttttatttgcttgagttgtctcgttctttcaactgctatagtgttgtgggtcctgctaaaatatctttgggggtgtgggtgaagagtggcgaatcacaaatttagtagccagtttttccccagggggcggaaaaaaaaaaacaaagagtgaccaagtaaccaagtaaagagagctatgagttcaataaccaggattatcccatggcaaggattctgttatcgttgagcatgattcctttatctctcagagacaatcaaccttcagccagaggagtgtaaccttaaaacctcataactcaatttaacatagtgttaaagtttggggggatatttatcagtgctgaggctgatataatcagtctgagggaccctagaacaaagagcagtgggtgaagaacatgtcacctccgtgcacattcgtttccttgatgaacaaggggctattagctgcagagaaagcattatctaggtgaagaatgatgccgattgttttagctacttcttttgaaattgtggaatagaacacagaatcttagtgagttaagggagcagtttttgttaatatgatgtggattttttaaaaaaaaataagtttaatttggcagaatatatagacacattcttctatagcaaccaggaattaatttgaaacatacatctcttttaacctctgctcttaggctcttacctcattaaatcaaaaagtttaaagataatcacataggctgggcgtggtggctcacacctgtaatcacagcactttgggaggccaaggtgggcggatcacctgaggtcgggagttggagaccagcctgaccaacatggagatatcccgtctctactaaaaatacaaaattagccgggcgtggtggcgcatgcctgtaatctcagctactcaaaaggctgaggcaggagaaccgcttgaacccgggaggcggaggttgctgtgatctgagatcgcgccattgtactccagcctggtaaaaagagcgaaactccgtctcaaggaaaaaaaaaaaaagataatcatataaggcttttaaaaaatctagttttcatgcaaaatactagctttcatgcaaaatttaagaagaaaggccatatatggcttttttagtaataagctagttaataaagcatctaaggaaggagaaaatatgttcattgaacatctgactttttaaagggctaggcatcatcttcaaaatttaattctcaataaattataaactttaattgtgaatttttatacaaaatattatttcttaacataccttcccaataaaattttgtcactctcttcacattatgttgtaaattaatcattgtccttactgattctaagtagaaaagtaacttgtaatgcctttttaaaaactacctcatgattttagtttgttttttaaaagcacttttaaaaaataattacattcttgttttaaaatacattttctttaattttacctttcagcatagtttattatattattacagctttaaataactcgataacatttatacaagaataatcatattaacttctctgtatgcaggttttctgatttaaaatataaaattttattatttttgttgaataggcttactttttataatttctttttacatgctctctggatatgctggactatgaaatgataatttaagttaacatcttggaaatccaggaacttgcatataacaaacttattaaaatatatttcagaaactaaactttagacgataacataaaatatctgcttttatcatttaaaaaatgacgagcatatttcattttaaaaggatagtaaaagtttcttaatcaaaaacttctcagggatttttaaccacaaggatttactgcaaacctgctgcatctgccaggccagtaaaacttgccagcccacctcagtcaatacctcatatcaagatgccacattttaaaaatcttcctgatcaggtaaatattatagaatatatccttttctaactctgcagatatagctttcatggagacatttatgagcgctgaaagaattgagggaaaaataaaacccacactactttttagggttttaaaaaaattctttattggaatttcaataattcatttagcagagtgtgcaaaaaatttcatagaaatctttccttaatttcacacttttgccatatattgaaaatcatacccagcatggtcttatatcacttggactgaaaaatataatatgttagaattattatgagtgataacatgggtaagagtttaaagaacattataactaaatcggacagaattcaatttttgcctattctagataggaaaagtaaacttaaagttgtgaaaccttttacctaggttgtggcttctgcattgccagaccaggacctctgcaatgttctgtacagtgattcatactgtaacagccataatttcaatatacagtatctcaccctgtaacaatcataagcaaactatgaaatgtgtcacaattacttactcaactggcagaattaaccaaatcaccacttgtgcaatttcagctgtttgccttaaataacttcttaaaaacaaaaagaaacaacaaaatgtaataatgtaagaaataacataagtatgtaagaagcaacaaaaaggctgacagaaggccagcattaaataaaaatgtaaacgctctgaaagcttatgatttatgtgccttcacaagttagtcctcatttatttttgccagatctagttagtggagtaacctagccttcctaactgcactggaattgataggaacttttccaccatttgtcctaaatttctttgcatctgataggcaaagtcattattctttcatatacctttttatctcaattagacaaagctgagacgttttatattgctggaaaatgtttttctgctggtaagacaagccatatatattgcctcttaacactgaatgaaacatatctaaccaaattaatatatttagagttagggaattacattaaaatttaaaattttatccatggaacaaatatgaaagcagtaaaaagttttccctgtttagctccttctaatgtatctcatcccaaacaaatagggaattttaatgaatccaaattagggggaaaacatttaaaatactaatactgtcaaatttaagtaaatttgctatttttgagaaagcaaacatgtaatagattccacatgaagagctccttgaatcatcctgatgtttcctaggaaaattaaggcagatgtttgctttatagatgaaagcatttgcacacacagagctagaaagcaaagaaggtagaagtaaactgccttactttcagtttcaattatatgataaaaaagttatatttaaaataagatacttaacaggtactcagatgcagtttcctaggaaattcccttctatcctacactttgacaaatattctgataccccaagagaccctgacaccttcttatagctacacaagttaaacttctgcaaacaatttctatattatactgttatcaactttaatattcaaaaaaattagtcattgtaatttccctaatagtgctaaaagaaagagcacaaaatattaagctaattaataaattctgttttaaaaataagtattctagaatgaaccttttcccaatagccaagtaaagacagatcccttcagagagctttgtgaaaatatatcaagtaacttaaaaacaataaagaatgtatacccaagaacaatcacaactttttggtgaccaaagcaattgaaatatgcatagtagtaaatagcacaggtataactaaaggccatcttctgcttctctactcagataagaatgttccagagtttttataaaaatccacaattttatctgtctcatgaaagcacggcctttacattaaaaaaaaatcaggcccagcaggtatctaagaaatctgacacagatcaagaaatcaaggtaagattgcctaacctgattatagttaaatctcaaaaatgttatatcaaattattattttttaaaaatacatacaaattagatcattcctatgtagatccataaatgttttgctattaagatgtttgatctgtaggttggttaaattttgtcttcaggtgctcataggaatgttaatactaaaaattaatattaataaatagctgagattaaaattttattcacatatcttaagggagaagcacatagtttaataaaagtaaattgatttccttatttaaaaaaataatcataatctcttaaagttggggagaaagaagaaaaattagtcaaaattatgagtttcctaattaatatttgatcattgtatattctcactcacttcacctgcgactgaccccttttcattttgttctgctatgtctatatcattcttctcttacaattcctcaattagtataatattcagtactcccttttgaggaaaaaagggcaatatttaatattaaaaatcatggtctcaaatttattcctagagttcccagaataactaaataggaccccatattttcatcagaatgtgatttgagcataaaggcaatctaccttaaccattactcaagtttctgaatagcctgaaacaaaacaaaacaaaacaaactaagggatagtgtctaattttaatcactttttgcattgccatctaagacacattaatagcaacttttcattgattcttgtctagagatcaactatttcaaggcagaagggttacttttagtagtctcctagaaaacaaacataattttttgctacctgtaaaaatttattccataggcaattcacatgaagacatttgcacaccagttcagtgtcttcttcagctatttgctacttacttagaacttcaatatctgaaatgtgtccaccatagaaggaatgctacaataataagttgtaaaataattgtaaaactggtaaaattaatatgttgtaggagacagaggagatctgattaaatatgttagaaatgctaaccacatccatttgtaattggcaaagaaaaaaatatctgtgaatttggcttaaaattcatatttaacacactccctttatttatctgtttaggaatacaaaccctcaagattatagttttatttgtcctccctttaacttgtgtaataataagaacatatgaaatgattttaagaaagtaatatttttgaggttttaaggaattaataaaagaacaggaatttctcatatctgagtatgcgtatgcgtacgcacagatacatataacagttttaatttttgaattcactacgtaagctcacatgttgagaacttacatatcttagccttcctcttcactaaagcaaaacaaaataaaaatccagaaaagcccaaaagtagtatttccttttaccacgagagggagctagagaattctgatctctttcaaggtctataaaaccctcttaactgctactttatagacattcaattacaacaggccataatacattaaagcattaaaatacacatatatcccaacatatgccaaagcaagcactacactggtgtgctctccagatgatcaccaataccaacatctaataaacacttaggcatcttctagtggtttatatgagattttactcttgagcactcccctccccatagggcagctctcttggttaggtgatccccttggaatggaaaatatcaagcagtgtgataaaatacctaagcactggaagtatgacaggggcagagtgaggtaaggattaagagaactgaaatttatgtagtttggaaaagtgaagactctggggataaatgttcagtctttaatactttctaaaggtaacaatataaatgaattaggggaattattcagtctcagaagatggtatagaaaagagcaatggcctgaaactaaggaaggaaaagtttaggttagacatgaagaataaattaggaataatagttgggcaggaaagatgtccggcaaagggaggacccaaagcgtaatcactatatttgataattaaatgagatattagtaagaatgatgtgaattcattagaagggctagattagataactcaaagtaatttttttcccctaagctctgacaatctctaggttcaactgtattcttgggcattcacaaatgtctttcattgatgataatgatcacttgtagagagaagagctagtaattctagttaaccctatgttttgttgattaaaataaaatctggggtattataatgagacaacataataataaaattaaccaagacaacaatgtatatctttcagattattctgtgaaaatatactataccatataagctatattctaacaaaatgggtcagcaaattggaaaaggcttctataagtgaaaacttcccataaaggaacaattcctctctaaatcccaatcttttacaagccagagaatccattccatataatctttctttcctgctagaccagtgtatccggatttaagctacttagggcccaacataaaaaaggctgtcactcaaagttagaaaggcagcctagagcagaagtataatatagtttatgaattcaacaatctttccctagtaagccataatattctagactaagacgtggttcagcattgtgttaaatagtgttattaacctttcttttttacttgaaaagtcagacttctatgttaggccaaaataaattatgactagtagaaaaacaaaaactatcaaagcaggaagattcaggaagattcctttgctcactaaggaatcacatcttattcctttttcatatcctctacatagcatccaaactcgtgatggaataaggacattcaatattggtattcaataatgaactcttcattagtagtgtattaaaatctataacatggacaaaaaggccaaaaaagataattaattagttctatgtcaaatcaattcaggggcttaatgcacgttattcataactataattgttggcatttatggagcctttttgaaattctttataaactataccacttccaaatcatcctaggaaaatagtaagaacatatataggcaagagagacacatgtgtctgaagaacttgactgaaacttgcaagaaatcatctaggagccaagatcagaccttctacaaagccatttggaggctgcattgaaaagcatgctgagatcatgcaggtgagggaatgcatgcagtgtaagccaggagaggtcactctcagagaggtggtcttgggtatgatactggttctatcacttgctagttgtaggatggagacacttagtatcttccttccttccttcctaccttccttccttctttcttcacttagttccttctttccttccttccttccttcttcacttagttccttctttctttcttttcttccttcctttctttctttttctttctttctttcttttcttccttccttctttcctttctttctttttctttctttctttcttttcagacagagtttcactcttgtcacccaggctggagtgcagtggcacaatcttggctcactgcaacctctgcctcccaggttcaagcgattttcctgcctcagcctcctgagtagctgggattacaggcacccgccaccacgccaagctaattttttcatatttttagtagagatggggtttcatcatgttggccaagctggtctcgaactcctgacctcaagtgatccactcaccttggcctctcaaagttctgggattacaggcatgagtcaccgcgcctgaccacttaccatctttaaaatttagttttctctttgttaaaacagagactagattaggttattgccaactctcttccagctcttaaattccatgattttatgtagaatttaacccaaatgtatgggttaaattcgcaaggagtttgttttagtgaaagaagcattatggaagatgtccagctatcaacacatgtgagagcactttactgggtactggatgaaaagttagagtttaaacacacaccaacagcccaaaatgctgggttgaaaatgaaaaacgggtcattcatagacagataattgttactgttttttaattcttcatgaaaacatgtataatccttggtaaccatttgtttaagtaatataaattactgtcaacttggaagcccagtttgtcatcttcatctgtgatttataccagactatataaacgacatgatttcttagatctaataagacatttatcttcatgaaggaagccactgtgatcctgagtgacagtttacttacccttatcacagtaaactcaacaccaagtccttaatttctcccaatgatctgaaatctgatggactcacctaaagccaacacaaacttgtttagaaatccaccaggttcatgaaagtgtgtgttctactgtagaattcattatttggctccaaaaacacagacatggatataagtttttatgttcttccacagtatgtgcctctaaacacacatacataacttccattagctttgacaggagtcatgtgcctttattaaagaaaaatataccttctagctaacaacaaagatcaaagcagttgtctgaagaataaaaagaaaatgagaaaaatgcttgcttgaatatatgtatgtatgcatatatgtttatttacagacttatttatggaaagagactatattgaatcattttcattatcttcatatcatagaataaaaaggaactaaaaactccaaatatgttcacatagcttacatagttttaaaaaaatacacacgaagaaagttaacaagcctaaccccatcagtgagaaggaagcaaatggcttgctgtttttaagccattaattttttcaatctactagggtcctattggtgctagaatactatgtattattggtgctagggtaccagtgactgaacctacataggtttctaacactccaagtaaagcagccctaaattatgcacattttactccaaagttgtcagcaagattccacctaagatttatcctgatcagtgaggtcatttacctctaatccctgcatcattaattcacatacctcagtaaacattgtaagaagctcaggttatttactctgtgaaacaatataatttatacactaaaatcaggccttacccctgactcacaataatggggatctcaaactggcttatgaacattttttatactcactgagtataaagtctaccagtggccgggcgcggtggctcatgcctgtaatccttgcactttgggaggctgaggcgggtggatcacgaggtcgggagttcgagaccagcctgaccaacatgatgaaaccctgtctttactgaaaatacaaaaattagccagtcgtgtggcatgcgcctataatcccagctactcaggaggctgaggcaagagaatcgcttgaacccaggaggtggaggttgcagtgggctgaggtcatgccactgcactccagcctgggcaacagagctagactccgtctcaaataaataaataaataaataaaataaagtctatcgagggtgctgtcatagatttagaggcgaaactaacttaataagtggaagttctaggaataggatttcagttcattaagagggggtctttttaatcaattagagctctttttaagtacctaataatatgaccctgaaaacaaaacaaacaaaacatggaaaaaaatgaatatatctacaattgtaattggagatttcacacagtcctctcaggagagaaaagaaaatctaggaatataaaagatttaaagagtattatttataaaaataaaaagagtaagagtgtaatcaatgaatgtttctgaagcacacatagcacataagcaaaacctgatcattacagctacaaaggaagtctcaacaaagtccaaagaatcaaaataatatacactgtgctcttacattataaagtaataaaatctgaagtcaataataaaagagtaggttttaaaattcttgaaactacaacaaaacaaactaaaataaaaactagaacgtaaacacaaaaaatgcttctaagtagcatgtaagttaaaaagaatatcataaaggaaatgataaaacacttagaataattatgaatgaaattttgtgggatgcagtaaaagcatttagaggataatttttagctatgaacacatttattttaaaaatcaacattatatccagtgaaaaaagcaataaggaaaatgagttggaaagcccgtaagagtagatgtctacagaggaacaaacatccacctcagcagaactcttcaaaaagcaatggctttgaaatctattggaactctattccctcatgtggattagatgtgtcatccttggtcaagtcaattaatttctctaagcctgaatactttacctgtaaaatgggtaacagtgtcttcctctctgagctggtttgagaattaaatgagataacccatggaaagcacttagtaaagaatagtaaacactcgataaatggttcctattactagatgactttatcatcccttccaactcccagattccatgatactaactttggcaccatgaaatttaagacaaacttgaactctggctacaataatttaatcagtaaattaaaccttcattttaatttcagaatactaaaacagttttgtttaaaatagattcatatctaatgctttctccccactattataaaaataaaacccacaatgatcaacaaaatctagtctattattattcataatcttaaatgcaaaattgacttgtatttcagaactaaaatgaaaacagagaaatgtcttaaaagtgctaaaaatagcactgtaaaaaaagggttctttttatttccagaatattctctatatttttaaatgttcttttcagaaatggcatggagttgaaaatagctactattggtactttaacatgtttgcagttccttttaaatcaacaagtatgtaataaaatcaatcaacaacagtctcttcagttattcattactactcttttccagtgatagttacaggtctttccttttccagttgtttctcattttgctgaagaataagaatcttctctaaccttcaacatcctgatgcacaaagaagctctaaaatattctcacttctatccagatttaattgttcaatatccattcacccattctttaattagaacgtaaacatatataacaaataaatacattatcatagattttaggtttcttctaaaataattttattttttctttttcttccagaaggagtcactatatcctgcttacagaatgatcactttccccaatccactttaaaaaataatgtaggtatgcagggattcttcattatactaacaaagtaagtttataaatacattaaaatccactgtatatttggacgctgaaaacaatcagatcttgagctttgtagttgcctggctcttgtactaagtattgtggtcagtgtttcctactacatttttttccttccatatggtaaaaactatgcttttagttcagaaatctaaatgttattacttgttagcaagtttttgttcccgatggtggggctgtgctcttgtgggtgtctctctctgccttcaaattgtgggcatttacaaaggaaaaggagaaggaattgtaattaggtagcaacaggctctcatttttatgcatgggttagcctgtaaccttggttttcattttttgctgtgtacctggccaggtttctatattcttctagcactctttgtagttttcacaaagtcatgacctaaacacaatatgcagcatgcttctatattcttctagcactctttgtagttttcacaaagtcatgacctaaacacaatatgcagcatggttactgcccctcatcactaaaattatgggtggatgggcccgactgtgtatccttttataatggcaagtctaggatactactctagctgacagtggaagacaaaatatctgaaatattttcacattttctaatgaagacaaaattcgagaagcctaaaataactgtcattacaaagaatgttaaagaggaatatctgggaggccaaggcgggtggatcacgaagtcaggagatcgagaccatcctggctaacacggtgaaaccccgtctctactaaaaatacaaaaaattagccaggcgcggtggccggcgcctatagtcccagctacttgggaggctgaggcaggagaatggcgtgaacccaggaggcagagtttgcagtgagccgagatcccaccactgcactctagcctgggtgacagagcgaaactctgtctcaaaaaaaataataataaaaaataaagaggaatattttttcttcataaataattgacttagctatctataaagacactaactttatatttttttatttgtctacttattaatagttttcccagtgagatggtaagctccatgagggcagggactgtatctgctttctcactgcatttttcacctgcagcttaacacagtgtcttggtgttaactaggaatctttaaacaaacatttgtttaaaaaaatgaataagtagcatatcaagtgttaccattctctataatggtaaaaactaattaaataggatatagagattgctaaaaattttgacacctttataactttctctttaatttcacaggaaatgtatgtatctttaattttcaggggatgaaaatgaacatttattgtgcctgttatgtattaggcactcaggcactgtgctagattcaatgctttgcagaaactcacatttaaacagtatcacatcatcttacaatcaagtttttaacatagaaataggtctattcctacctctaccattgactatgtcactttgggaattctttaatttcatgcatagaactaaaaacaaaaatttattaagtaagaatttaatattactaatataattaactcctcttatgagttttgcactttggagttttccagatttacctctttcaacacaaatgtttttcctaaatttcaactattttaatgaaaatatttttaagcatagtatttttatctgtatggtcttagccaaaatgtttggagtatgaatctgccaaaatgtttggagtatgaatctatttttttggatatctcagataaggatagtggtaaggatagtagagtggttaagagcagaggttttagaaccagactatgtatgtgtaaatcctggcactactacgtaccagctgtgtgattttagataagttaacttccctgagtctgtttccttgtctgtaaaataagggtaaacctaatatccacattttagggcagtcttgaggatcaaatgatgacatatgcagagtgcttaccatacagatgatgcaaggcaaatagtaagtgctcaataaacaataaatgctggctaaagaagttttaatttattaaggtactgagcacttaggtgagcatgcactctttttctctatcatagaaaatgaccccaaactgctatttaaaaaaaattattcttagataaattttatttatagattttgttttctatataaagttttgttcttgtttcttaccttaatcttattgttaattgatgcctttatagtaccccttcttctaatttgaagctctactgtgggctgagaaaccaaaacactgtattggttagaaacttgtaagaagattcctcagcaaagggccttaggggttcttccaagagcaaggtacataagtcacatctatttccacttagaggcctttctggattacttattgtgttctcagttgtgtttgggaaagttggaaataccaaataagtgacctaaggattaatgaggcattattgttctaattctgtcaagcattagaataatcaaaaacaaatgaaaagttgatttcttcctgttttgcactgttaattttctacaattattaatcagctaccaatgtaattattaaactttcaatccaaacaatgtttttagtgtaatacctgaatcaatacacagatcctatattacaaaccccattttaaaacttgggtattactaattgtgctattatacaaaataaaatgtttctgtgtgattcaacccccagttcttatgtggaggttatcaagtcagtgaaagggaaaaaaaacatgaattgtcaaaagggctaaatgaaataacaatcaatggataaagtaaaaagagagagtaaaacagaaattataagctcttgaaatctaaataaaaagaaatggaaagattgcagactaacaaagaaaagtaaggaataatttaccaactttattcccaatccctaagcgaataatgtgtttccaatttgatgttcaatttagtagcacctctacctttttaaccctactgggaaggcatgagagagactctgataagaaaaccatgcgcatccatgatgatgaaaccttctgctcaggtggccacatgacagaagaggcacagcggatccccacacttgggaaatctaggcctgagccagaaactggcagccatcaggccaaaatatttatattttatgtcttatcttaaaaattcatgtatattttgcatttcattatgttatatactgtggaattttgaatataaaaataatgtttctaacaattgaattatttaactcctctcattcccaaatattcaagtaaaattgatgctctaggaagattcacactgtggttcttgtggctttcccttccccttgagcaataccaatatggtcaggggtatgtgagaagtacaggtgaaatggtatcttattatatactatgatgagctcaagggtctcaaatgatccacagaaaattaataatccaacaatcattaaataaaagcttcaattctcatgtaaatcagtgaagctaaaaaatccaaaagaatggtataaactaggccctgaaatcttaaaatgccctcttagctattgagctacggtttttataaaaagatcaataatgatgtcttcctgttccaatatggaattagtgtctccctaagtacattaacttcagaagtattgaattaccaaggaggatcagcaccacaatgaaacaaatagttgttctttgcaaactagtgattaccagtacagaaaacccaccaaaggctgctagatacaaaaatgacaaaaggcaaagatgtcaggccagaagataatgaagtatggtagtcacccaaaatccagaaggataacactcaccctcatcctgataatctgacaaaaagggtgcatcggatgtgagggacaggccaagagtcccgctgtgattatcatcagagctgtcctgtccaatgtctccccctgagggacaaaaaagacagaaaataaggttaatctttgggcatccttataaaaggatacatccttataaaaggatctatgtatgatctcttccagtattcgaaaaaaaagtgtatcttttactggatgatgaacatggccactatccattaacatataggaaacagttaaataggttcaagaactgacttacctggatgaaaaattttccactcaagtaactctctcactaaaacttaggaactgttagcttatagtgggaatacctcttgccaccagaaagaaatttctctatcatacttaaaataaaaacatagctatataaatttatattcagccaggcatggtgggtcacgcctgtaatcctagcactttgggaggcccaggcaggcggatcacctgagggcaggagttcaagatcagcctggccaatatggtgaaaccctctctccactaaaaatacaaaaattagcagggtgtggtggtgggcgcctgtaatcccagctacttgggaggctagggcaggagaatcgcttgaacccggggggtagaggttgcagtgagccaagattgcaccattgcactccggcctgggtgacaacagcgagactccatctaaaaaaaaaaagaattaaatttatattcatatatactatgtctccaataattacaacctttaccctgcatgcctctatttcaaatgaaataggactgacccaaaggtttaaccttctatacataatataatatagcaaggtcaatagtctttctctgaaaagtaagagaagtattataaaaatagagaaaacctagactttgctggactgtattcctatttgttctgcaacgttaacaaagttctttctttgtaattctagtttacagcctaggcaaccgacctcttaggaattctaaaagccctaagaagataatatttgtcctgtaaaatggctttgataaaaggtaatgtatatacaatactgaattatgcaattaatgctaatctcttttgtgtgttttcaatatacattggattgtattctgtagaagtgactgatgttattatgatactttaaaaggttcagacagaagatgttagctcattcagaaaccggaagaaaaggctctgtattgcaaatggctttccttaaaatcccccaaatagaggtacagtctgctaataaaaggacactgacagctgcttatttcatttcacaaacatgaaaataggattttcaactgaatttaatattatctcaaatactaatttccaaaggaaatcaccaatgctaatctcagtaaatactgtagagttttggccttggatttcaactagggagctgtgaaaccaaacaacctacatagaatctgtattgcctcactttaaaggtttatttcctacaattaaactagaaagccagggaggttataaaatgataaaaagagaatggctgtagctttctctttccataaattagatgatcatatctagactcttcttcaaatgctgtatggtaggtagatgtccataactgagttgaacacctacaaatataggactttagaaataaactataaagtttattatgaaaaagagaaataaaaattgtagaaaactcacacaatagtcattggccaaagccagaagaaatactctcttttattagtttacttatcagtatacaaagtttatagctatgcttaaagcatcactgtgtaatttccatagtaaccagaaaaattctcaaatactggactgaggattaaaatgctcaaattttacatcactggaagtccactaaaattatattatcaacacaatctaaatggactgcctggctagtaacctgaaagtgagctgcaaggttaaatggaatttttattttaagccaaataaaaatccttaaaaataaaaaaagtactggaattgccaagcaaaatttaacttttgtaggatatactgaacattatgtataaactattattctggacttaaagttctctgcttgcttcaaaaatgtggcaaatccaccattaaagaaaaagaacctagccaggcacagtggctcacacctataatcccagcactttgggaggccaaggcaggtggatggcttgagcctaggagttcaagaccagcctgggcaacatgacaataccccatctctacaaaaagtagaaaaattagccaggcatggtggcttgtgcctgtggtcctagctacttgagaggctgagacatggggggatcgtttgagccaaggaggtaaaagctgcagtgagccatgactgtgccactgcactccaacctagacaacagagtgagccctgcctcaaaaaaaaaaaaaaagaaaagaaagaaaagaagaaagaaaaaaagtacatgctcacattctaagtgttttaaaaaacatgcagatcaggaagggcttttttttttagtgaactttttattttggaataattttagatttatgtaagtgttgcaaagatagtacagagttcctacatacccttcacccagtttcccccaatgtcaacttcttacataattgaggtctatctgccaaaaccaataaattaacattggtatattgctattaactaaactacagactctatttggatttcacaagttttccattaatgtactttttctgttttgggatccaatccagggtatcacattgccttcacagtctcagtttttaaagtcttacccaaaacacctgcctggatttggcacttgctttcctaacttcagatggaaaagtcacttccacgtgattcctatggtttctgagtatagtcacccaaggtgtgctttcaacagccacccctggtgtcaaacatgagacagttcctctgtaaagtacacaacgacatagatatacaactcaatgcagcaaaacagagcctaggtcagtagtacaaatggttgtggtgcgggaacatttagaaataagctttacacccaagtgcaattagttcctgatgatggagatgttgttataagtgtttttagtgtcatatcaagtgacccagttcccttgggcacacacagaaacaaggctataataccatataaatatacactcccatgtaattgaaatgattacaactactgaggatgcatgggtgaaaagttttatagaagaacagcaattattgtggtcattttggatttgtttaagaacatcatttttctttaaaacataactgtacgtgttctctggatttgtctatagctctgacaattgcagttctaaatggccacaactgtagtccagtgggatcagacataaatgatcacaaactatagtgacagacatttccactcagcagctctacaattagggcttagaactctatctgcttagagtggatttctcacaagcaagaccccttgccactggagacacattttcccactgcaactccctcagaatcaatatatttctatacagatatatattctaacacatcatatctccattaatcacatccactaccttcagtcctttctctttgtatttctaaacaagatctagtggaactatatcaagggttcacctgctattagcaggtaatttgctcctgtagcctaagtgtcataagaattgggcgttagatacactccttggtatattcaatggcaggttctccacccagtacatgttgaggggcccataagcaggatgatttctctattcttttctgagagtcaaactcaatttcattcatgctccacagagtgataagttgtgaatttctgagggttggagcagaaagataaagcagctttgtgtcaggtgtaaggtaattatttcctagggtttctgtgctatttgtttttattccctgtgttttcattaacagttaatgagttttcccccttaattctgaaacaatagtcttggccactagaagttggctttttctgccacagattcaaccagctgttgctgctccataaactttatggagaagtgaattaaactgctaaaacttcatttactaattcaattccaaataaaacagggagaaaaatgaaccatgatgatgttccccttgtaactattttagttcacagcaaatccgtttagtcctgaatttgcagatactattttgagacaaaaacaggccataatgacaattttaccagagaaatgagaaagaaatttaaaaagacagaaaatggtttaagcattaaaaaaagtgagaaaataacaaataacagagaaaacatatatgtttgcttattcaatatgtaaagtctcgattttttttgttagtctacatcatcgtcttttatttctcttcaaattaattgtgagctatattataaagactctattcatatttgcaaccaactgtttatatggcgtggttaaaaactaaggtttgcagccgggcgtggtggctcatgcctgtaatcccagcactttgggaggccgaggcaggcagatcacctgagtttcgggtttgagaccagcctgaccaacatggaaaaccctgtctctactaaaaatacaaaaaaattagccaggaatggtggtgcatgcctgtaatcccagctacttgggaggctgaggcaggagaatcgcttgaacccgggaggcagaggttgcggtgagccgagattgtgccattgcactccggcctgggcaacaagagtgaaactccatctcaaaaacaaacaaacaaaaaagaacaacaacaacaacaacaacaaaacactagggtttgctattacttcaccaagtatctctggattatataaggaaatttagattaatttaaaattgaaaaattttaaattattgttgttgttggaaggaaacacatgacttcctattctatttaatatttaagatcccataagaaatacagctccctctttaaactaataaattctcactaaaatgctataaataaagctccctgatccaagtccagttagttttcatgcttgatagcattaatattgccagattttcatgggccaatttaatagtaatacagctcccaaagctgaactatagtaaggttagcaaaactgcagcttattggtccttattataaccattcaactaagttattgaatctaataccaactaaagatatatgttgggtacagatgtgaccatatatgaaatgttactcacacataagtatattatagagcacatttgctgcaccaaaactaaaattctgtcaacacttccattataaattacataccattttgcacatattcatgcattagaaaatgtactgtgttttccagagaacatcctagaggcttcaccaatttctaaatatccatttggatctgtgtggttagttcttgtgattaatccatgtatagtgaaggactcaaattcttctctgttctatacagtcggactttctgcctatctctcttttttttttcctttactacacctatctataattcaatgtataaatattccttttttccccccaaagccctggcagtgagtgtaatggtactgaatgtcattaagtctacagaataaatgataggtcaggtaaagaaagtttccatttatcattcttttaaaaagttgctccaactggatctcaaatgtacaagaagtaaattgaacctaagactacagtttttagcttagcttagtaaaaaactacagttttttactgtttgctaattatgtaatcatgctaagaataacagccttcttaagaacctttagagataacatttgaggagagtggcacagtctaaataatcacaaatggagccaaattgattagacactcttagtataatcactataacaacacctgtgaatccaacaaccgaaagggcagcatagcttaatgatattctcagaatgaactatatctgtcagtggtggattggacaggaaaatgtcagtgggagctaattgaaaagttctttttttctttttttccctcaagaaaatggtcctttgtaatgcagtttttaattttgaccagtagggtgagctgtagtgtgtagcatcatcctagttcttaaaaaaagaaaagaaaaagaaacaagaaaagagaaaaaaaaaaaaaaagcagccactgtcttctcctctcccaccctgtaagaaaatgctgggatttttaacccttcttaggtttcacataaaggcataactcctggatgttaacaaactgtagggctggcagcaacaaatataaaccagataattgtatatgtgacaacccacacttcataaagcaaattacagcctgtcagcagtcattccagcttcacactaacacattccatctaccactggtattgttcaactggtactaaaatggaacctgctgagtgggaatattttcaacagtaatgagattttgacataattcaaaatatataaacctaggtatttggtagtatgtggataaatatattgtaaaatgaatgcacttatcatatggcaaccaggcaatcataatctggaattattggctcatagttctgttttctttgggccactgtattctcagtccttaattcttattacaaagctatccaactgaattttcagtatcttttgacatataggagaaagttagctataataataataattatataatagctagctaaactcttactgggtacaagctctgggtcaagactttttgtggactatctcatttaatcctcaaaacaatcctgagatgtattattatcccaaagatgaagataaagaaattgagacacaaagatgaaataacttacccaaagtcatataggtgactcataagtggcagggccaggctttcaccccaacttgtctgattactaagctcttgttctaatccactgaactatatagcctgaaaatctgcatgtttaataaatcatgatcattactcaaaggcaaggcatattgaatgacagccagtgagttgactttatggtatatactatcaattagtattttaactttaataaagtaaatctataaattatgattattagtgataatagcagtagtcacgttaggtatggagagtagaactgacagacaaaacaaaatttggtcaatgatttggtcaagaaagaagtggtccaattcatagttgaaatttattatcgagtaatgtagtaattttttcaaaatatcactttttggtatgaatttcatgcttgcaaaatttagaacagccacctcaggcttagtgaaatcaatatactgatttttttccagcaccttctgtttgattctgttggatacttaaatatagcattgacctggcttggttaaagaatgtgtttcctttctggcaccatcatgctttaagtctcagagcaggaaaagcctttgaaaaatatataatgccacataaatgtagcaattttattactattggttcatcttgctttcttgtcccatctttcctttctcccaaacagcaagttgtagtaggccttagcacttatttacaatcctgatacattttggggtctactatgccccaattggtaagccaacattacttaagaaacttcttgagagaaactacaaggctagttggattccaatatcttccattaaagaagaatgagatggccgggtgcagtggctcatgcctataattgcagcactttgggaggccgaggcaggtgaatcacctgaggtcaggagttcaagatcagcctggccaacatggcaaaaccccatttctactaaaaatacaaaaattagctgggcgtggtggcaggtgcctgtaatcccagctacttgggaggctgaggcagagagaattgcttaaaacccaggaggcagaggttgcagtgagccgagatcgcgccattgcactccagcctgggtgacagagcaagactctgtctcaaaaaaaaaaaaaaagaaaagaaaagaagaaagaagaagaggaagaagaagaagaagaagaagaggaagaaaaagaagaagaagaagaagacatgttgtacaggctacaggtagatataagaaatgtttttcaaaagtccaaggagtaaaaataaaataatacatagtaaagaatggattatgggtaagattagcaggcctaaacatgtgagccagcttttaacatactgaagaaagggtaagttttctttgtgataacataaacctccaataccactaaagctgtaatggcaaatggtgacaagattcaacctccccatgccacatcccactccaaacagggattctcattcacatatttgacaacatgtatgtaacatcattatcaacagccaaaacctctcactgtcaagaattcagttcaatatttggttccttggaaaaaaagtttcacatgaaaaagtatctctttatttaaaaaaattactttttaattgaggcatcactaacacaagtaaagtgcataaatcttaagggtaagtggtatcactttttaagtttaggaaaatacattttagagattaatcatgatcaataacttttccaggatggcaaatgtgtgttaaattcacatcagctgacaaggaccgatagggttcacaagattggttcttccactacttgcctcacaagagtcagcagaaactggaatctttattttatatgtcatataaatccccttgcctataacttagcagtccctttcctgtgctagtgatacttagccatcttcataaacaagtttctgagagaagcatgtgttgatgagaagccaaatgaaaaataaatgctttctaatagaattgggtccacctattacattatttagcctcaaaatatcaagcaaattcattgggtttcaggtctgaagtcttaacctacttactcacaaaaaagttttaagcaaaaaaaacaaaaaagcttgtattcaaatggactacacttttctctcaatattttgtgtttagaacatgaaagtttgttagaggcacaagtcttgatgaacactaattcttatgtaaaaattctatgctcagaaactgtactcctcacctgattttctgtgttagtccaggaataataccttctaagagaaatcatttataagttgtttttttcctcaaccaaagtcccctgggctaatcaaacaaacttaaagcagtcattaattttcagtgacttgattttccttgacatctatgtgaagacgaaaatctgaagttctgtgaacttctaaaaagactaagatggggtaagaaaagatatcattatcagtcaccatgagtattatacaatactaatttaaaattgttattatttttgttttgtttttgttttgagacagggtctcactcagtcacccaggccagagtgcagtggtgcaattgcagctccctgcagccttgacctctcaggctcaagtgatcctcccaccccaacctccaaagtagctgggaccacaggtgcacacccccatgcttggctaatttttgtatcttctataaagatggggtctctctgtattgcccaggctggtctggaactcccaggctcaagcaatcagcctccctcggcttcccaaagggctgagattacagatgtgacccaccatgactggccatataatttatttttaaattcactttttcacttgaggccaggagtacgagaccagcctggccaacatggcaaaaccccatctctactaaaaatacaaaaattagccgggcatggtggcacatgcctgtaatctcaactacttgggtggctgaggcataagaattggttgaacctattggtgggggttgcagtaaactgagatcgtgccactgcactccagcctgggtgacagagcgagactctgtctaaaaaaaaaaaaaaattcacttttaagtgataagtaaactcaacacacctatatataccaacgttctcaaacattaaacaacagagaatgctgctgttttataccatcatcagggcctttcccattaattaacatttcaaaataaataggccaggagcagtggctcatgcctataatcccagcactttgggagactgaggtgggcaaatctcttgagcccaaaatttcgataccagcctggtaacatggtgagaccttatgtctacaaaaaatacaaaaattagctgcgcatggtggctcatgcctgtagtcccagctactggggaggccaaagtgagaggatcacttgatcttgggagatggaagctgcagtgagtgagtcgagatcaagccactgcactccagcctaggtgacagagcgagattctgtctcaaaaactaaaataaataaataaataaatagatagatagatagatgaaaacttgagtgggtaagaaactgctaatcatgattctactgaaaaatagattactaccatgctgtttttttgtttgttttggaaagcttctttattaaataaaaaaagttaagtatgcccagagcaaaaccttcaaatgttacaggaaggcatataatgaaagttcatctatcctctcttctcttgatccttctctccagagacaaccattgtgagatttcttgggtgttctatgaatttttgtatctaatataacaagggtctctgtgtgtgtggcatatgtatttttttcctctttttaaacaaatggtaacatttgttctgttctgtatccagcttttcttcctaaccatttatcttgacaactgctccatatcagcaatatagatttatctcattttttattttaaccagtttttaacattaaaaaataatacatgcacatggtgaaaattcaaatagtaccaaagaatattctctctttcattcatatcagtatccccctcaacagtgattaccactgttaatagatacatatgtatccttccaaaaatattctatatacaaataaaaacacgtgtgcttgtgccacacacacacacagaaacaaactatacacactagtttgctcaaattacccttttcatctaacaatactccttggagaaccttccatattacgtattacatacatattacatatatatgtatcattttcttttaactctatatagcattccattaaatgggtgtatgtttatttaactagtccccaattgctgggcatttaggctgtctgtttgctattccaaacaatgctatcatgaacatccttgtacataatacattgtatagggaatacagaaggcagcattacctgattccaatgatttcttttacctgcataaaatttagttctttttttatatcttaatatcatctactacagaataggaaggacttttagaaaggacataaaaatcttgggaaatgttaactttagaaaggaaaaaagtgagtctttttgttaaaaaaaaaatcttttggccgggtgcagtggctcacgcctataatcccagcactttgggaggctgaggcggatggatcatgaggtcaggagatcgagaccatcctggctaatacggtgaaaccctgtctttactaaaaatacaaaaaattagccgggcgtggtggcgggcgcctgtagtcccagctgctcgggaggctgaggcaggagaattgcttgaacccaggaggcagagcttgcagtgagccaagatcgtgccactgcactccagcctgggtgacagagcgagactctgtctcagaaaaaaagaaaaaagaagaatctttgatagtcattgcaaaacaattgctgcattaattttgaaatgcattattctgcccttttaaaaatgcattattccactaaaaaaaccaccctaccagtagatgtataggaagtaaattatttgaaaaggtatcaaaattagtaattaacttcaaaaacagtttgtgtgtgtgtccacttgctacagattaatttgtataaaatgtagcaaataagaaaaagggggaaaatgcctgaaggaagtcaagccacaaaagcagctgtcaagactgttgatgttaaaaggttgagtcaaagccaaaggcaggagtattcagcctgggttcatttcccccttattaaatccccaaaagacatgaaaaacatgctggaatatttctttttttaaaaagtagtataggttgagatagtctaggttcaaaaccagtgcttgtgtttataaaatatcagcattccaggaatagtggtggaaagatacttaacaataaattataaatattgtaaatttagactttttcttacatttgcaaacacgtcataaatttgggctgtgtttctttgtataaatcctacttatgactgtgctaaaaccttttggcatgaatgcaaagagtattttcataaataaaatttagtaaaatcactgtacactccattaattcaaaaacacttctcttcaacttcaaaggaaatttccttcctcttttttttaaagtgtaaagatggtgtttctttgctgctttaatgttttgcttcttgtagttgtcataactacatgctccaagtatgtgaccataagggacaagaagttaagcaacatttgttcttccattcaacatgtctcagacaccatatagcaaaaagcttgtaaatctagcctctgaagtggctaccaccaataaaaatgctctctataaatacaaaccttacaaatatatacatggtgagtttcatggccctacaccagtgttcagctataatgaatgaatgaattttatgaaaagatacatgaaaattttattatcaaggttttatacatgtatgtacttgcctcgccctactttgagacataatatttgttaccactttagtaagtgcctaccatgtggcaagcactccttatgagttataatctcattaaaactcattacaactcatagtaactgtgaagtagatattattagtgagattttatacatgaggaaactgaagcttcgagaattgatgtaatttgccgtagctaacaaagtttctaagtagaggagctgggattcgaattcaggtatgatttcaaagcttaggctctttctatcataaaacattaacttgaacaacaatttaaaaaatcagttcactattctatgtactttatatccagatgcataaagcaatatatgcattaatatactagatctcatgatagagataaaagaaaaatgttacatttttaatcaatctcaacctttttcttttacctttacattatggagaagtttaaacatgtataaaagtagacaaaacagtgtaataaactcccatatatacatcattcagcttcaacaagtgtcaacttatggccgatctcatctcatctatatttaccctgtttctttctcctctcccatattatttgtcagacattatatatttaaatatcatggcacacctctctctgaaataaagaactgtttttaaaaaaattaaccataataccactgctacacctaaaaaaatccagtagtttcctaataacataaaataaccagtgttcaaatttctaattctctcatagatgtcattttttaatagtttgcttgactcagaatgcacaaagtttatacattcgttggtaaacctcttaaatctcttaatttacagttaacatggctttataatttccttattcacttagcactatttgtttttgccaggctatatttttatttgtttatttctttgtttgtgtgtttgggacaaggtctcgctcggtctcctatgctgaagtgcagtggcgcgatctcggctcactgcagtctcaacctgccaggcttgagtgatcctcccacctcagcctcccaagcagctaggactacaggcctgtgccaccatgcccagctaattttgttttttttgtagacacagggtctcaccatgttgcccagattgatctcaaactcctgggctcaagcaatctacctgctcagcctcccaaagtgctgggactacaggcatgagccactgtgcctggcctgccaggctatattattaggcatcgatttactttgacgtgaatataggcttgccatttcaaaatgagatttttaagcttcacaaagtagaattttttcataatgaaatatactgaataattttctcagaaaccttttacaccactcatagagatactcaaagaatctttaagttggcaagagattccactggcccatgtttaccactaccacaaatgtaatgtgagtgaccactggataaaaaaaagatattattctatataatattcccatggtcttccctagatttttatttaaatattatgtcatttgttttagattctgggtctatggtgggaaattcaatctaatattcatgaagatttttttatagcaaataaattttgaattataaacattataccttataatcaaattttttattaaaactatcactaactcattttataaaaggggaaactgaagcaaaatgaaggaaatcagtttgctcaataactttaagtgatattgccatcaaatctaagggcaaaattaatattcccttatcgatatcaccttttagatattgattactgaaattataaaaattccatggcaaaaactccgctggcttttctttgtaactttaagtaaaaaattaagtagaaattttttttgagtaagcaggacatgaattattaaagcaatattatgtcttattgtcaagtaaaaataaaaagcctctttcatgttctccaattatgtttaagctcattaaaagtgcccttccatttatatcccctctacattaaagtaatgtattctttggatcatgttttattttccctgtttcctttttaaaataaatatcattcaggaagttgacagtggaccaataaaaaaacgcaggtggaaatgtgagagaaagaattaccattaatgtcccattatgataaatagaaactactggctttttttttcccactatgtcaaggtactaagctcgatgcttacacacattactactaatcttcaacaaccttgcaatgagacagtgaaaaacagtcacgaagagtatgggctctcgacctctggagataatgggctctagaatccatacagggtttcttattggggtgatgaaacgttctgaaattagatagtggtgatggttgcacaacttgtactgtactatactatactatactatactatactatactatactatactatactatactgtacaccactaacttgtaccttttaaatgggtaaattttatggtatgtgaattatatcttgataaggctgccttggtttttttttttttttctttttgagacagagttttgctcgtgttgcccaggcttgagtgcaatgacacaatctcggctcactgcaacctccgtctcccaggttcaagcgactctcctgcctcagcctcccaagtggctgggactacaggcatgcaccaccactcccagctaattttttgtatgtagtagagacagggtttcaccatgttggtcaggctggtctcgaactcctgacctcaggtgatccacctgcctgcctcagcctcccaaagtactgggattataggcatgagccaccgcacccggccaaggctgctatttttaaaatgtgtgctactaaaaggatatacaaataatggatcttttataattaaagactattttccttccaggcaccagacctggtttagttcaaatatcttgaagaactcaagtgtgtttttaggcagatgcagagttaataaaattcatcccatcatcttcttgtacagagggtcctgtcacagataaaaatgctcagaaagtttggggccagcatttctgttctttctcactcccatcccaacaccacccagttttccagggcttttaagattcttctgctagttgttctctttcttacatatttctaatcttttcataatcttaaattgtcctgttgtaccttatctaaaccacttactcctcctacccatcccaccagcttctgaagcacataatcagctaaggtctgatcaaaagggcaaggtaaaagataccctctcactaactcctcctacccctgaaaatatctgtgagaagtcatgagactgggggctagggcatgagtttttctatgtcatctttccttacatttacttccaaatgcactaagactttgccacatatatttaatcattgtcaagaagcaaatacagttttctgttctaaataaactattttcacttgtctccttggctgctctacctctgtcctctctccaagagagaaaggatgggtagaagctgctttatgttgaaagatgactgcaatgccagcatttcaagaatctggtaagatgtgccttttgtcttttttagtcccatatagtctcttgtgttaagctccaaaattattttctcttctcaacctattcctataccacatctctgacactaactctttatttctcctttaggtaattaattctaccctcacagttccattcatttctgccagttcacaatcatgtgcttccccctgtggattttggttaacatctgttaaaccctgaactatagggccatcccctgaatagtgcaattcacattttgcgaagcaaattgctacattattacataaaattatccactgctcaatctatgttttcagctataaatgctttaggacagtgagatatgtagtaacagcacatcacattacgtaaaatagtgtaagtgctccaactttaacttatgagagtcaagaagctttgaaaatgtatggtttttatttcttaaagatggctttaaaataaagctttataaaaacttgaaatacactaaaagcatgagccagaaaaataaaaattttaataaaacttataatcactcacaattttaatttatttaaggtattactattcactgaggttggatacagtgacaacattaagagaataaaaagtacttaaaaagtttacaattggttaagaaagttatagagcaaaatagtttataaagctatttgtaagtttgatctaaaactctgtgattatctgagaaaataaagcccctccatttataataaattaagataatattcaggttgatgtttctgacattctcaaccagagtactaaaaagaaggaaggcaaatactttaaaagatatcccctcaaactgtttgaattcggaaaaaaatatttcaattctgaaccttttaaaaatgtgttttaatcctggcctttttctttttttaattttgcacacagctgtctgtagtactttttagaatcatgccagatgctgggttcatcaagcaaaagcaggaaaacaatggtttgaaagcaattagaagcactgaggctgcagcaaggctcatattaaaatgtgataacactgttctagtgggaatttcaacactgctccatttctgacatttctctgctgccagacaggcaggctgtgtggaagggcactgtgatcgaggaggtaacatactggaatttatttctggagcaaatgaaggattagctgagttggaaccctcccaaggtttttattatggacttggctaccattttatttgaatgctactggatcctgttggcacctaacaaagctcaaggaattaaagcatattatagccttggttttataaaataatctagcaacagtccactcagaaggaggaagcatagagcttcttgttgctaaaaagcagggcaggggagcgcagcagggtgaaggttaattaaacactccactaactttccttggaaatggttaatgccactctgtggagaagcttgtagagaagagacaggaataaacaatcccatttacacatttttagcataaaaccatacgtggtcaaagaggactcaccttggggctgaaaatcccaatagtacctgaaatacaagggggaaaaaaaaagggaataagtcaaacttgtatttctcaattttggttggcctaccatagctatagcacctggtccaaaaagcttgctaaagtctataaccagccaaagtcactactaattttgagaaaaacaaaaggttatccctgagatttgaaagagtctcaatggcttaaaagatgcatttaattcactgaaattcctcacgtaattttgactttagagctggaaaggtcctaaaagggaacctagcggtggcctggggtttctcatcaagagctctacgggctttcagcaggatggttctttgttgtgacaatctggcctgtgtattacaggactgtgtattacactggtcctaggtaccaaataccagaggcattcccagttgttataacagtcaaaccccaccaccaacaccaacacatctcaaatgcctctgaagcctaattttttttttctctgttacccaggctggagtacagtgacacaatcatagctcactgcagcctcgaactcctgggctttgccttttaaacctaaattcttaattttacaagtgaaacatgggccgggtgtggtggctcacgcctgtaatcccagcactttgggaggccaaagcaggcagatcatgaggtcagcagttcgagaccagtctgaccaacatggtgaaaccctgtctctactaaaaatataaaaattagctgggcatggtggcgtgtgcctgtaatcccagctactcaggaggctgaggcaggagaatcgcttgaacccaggaggcggaggttgcagtgagctaagatcgcgccattgcactccagcctgggtgacagagcgagactccatctcaacaaaacaaaacaaacaacaacaacaacaagtgaaacatgaacaattgacttaaggttgtctaacgttttagtgcaattgacttaaggttgtctaacattttagtgtctgagccaagaatggggctcttgcagttcattgtaccatcctatctcctctattattttgggaaataattggcaaaactgacaacccttgaagtcttttatttatctatttttttttctgagactaggccttgctctatcacccaagctggaatgcaatggcatgaacgtcactcactgcaaccttgacctgctgggctcaagggatcctcctacctcagcctcccatgtagctggggccacaggcacacgccaccacacctagatgcttacacacattactactaattctcaacaaccttgcaatgagagactgaaaaacagttactgtttttttgtttttgtttttgtttttgttttgtagcgatggggtctcactttgttgcccaggctggggcttaagcaatcctcccactttggcatcccaaagtgttgggattgcagggatgagccactgcatccagcaacccttgaagtcttaaactaacaaaatagcagtggtggaaaggatcatttgtaagtcacttatttggaaactaaattgcatttctttccccacaaaaacaatgttatatatgatggttacccaagaaaggctactgtattttggatcccatttcctcctgccttcacaggaactttacattattctttatcaatttttctcttgtctgtattcaacctcttcctctcagtttggccctttccatcagcatttatgctcatataaaaataaagcaaatcctccctcaccccttcacatccctccacctgctgtcctgtttcccgtcacatcacagtgacattttcaaaagcactgtctacacttggctcattttattccctcactgcccactcactcaacatcctccagtcaggctcagagccattgcatattaactcttgctatagacataataaccttcacaccaccaaatataagggatgcttttctatcctcattttgacctctcaggagtgtagatgtgcgtcggagctttttttttttttttttaacctagggagggagtccacagttttttatagaattcttttgcaggggtgcccaagggagagaatacattcatgggttcttagtttctgtttctggtgggccactaaagccccttcctcatccctcttttccacttatcactagaggtagaaactaaaaatcatggcttcaccctgctaaaagcctaaaacaaaaacaaaagaaaaacaacaacaaaataaggcaggttggacaagcttgcagtttaaagggtccataaaccccccaaaaagatgcagaaaaggtgataggtgataatggtgtgtcttctagtacatacattactaaaattaggcttagcttcttcagggaagagtatcagcccagtgagtatattggttatttctttagtgtgtgacaaattttcagaaaataaagacagaagaggtcagtggagaataagtatgttgccataattcacagtttaatttggggaacattatcagacataagaaagtggagaagaaacctgacaatttgtccttccttgttcctttccttttccagaacagttcctgggttggcaatcaggtgaagagaaatgtaagatacttgggttagagggtgaggaaattccaggacagctttgacatctgcagtagcaaaggggagaggaaggggcagaggacggggtaggaaggggcagaggacggggtgggaagtggaacacttcaaaacctgggaagaaggagtgtccatatcaatgcaggggcatatgtaagctgaaactggctgaaacttaaatacattgtgaataatagtatgatgggtcaatctccacctagcagacagtgcacctgtacctggccaccacgaagaattttccataaaactcctttctgtaaaacatagctaatcaagcaaatcatcaaatggctgagcaattttccatctactcttgctattttccatcttctcttgaggcacttccctaacccccaattcctatcattacccaacttctaatttaatataaatagaaattagggttcgagtatgtgcatacatgtatgtgcacatgtgtacgtacactctctctcttctttccaaaatattgatgatggcaacagcaggaactttgctgttgctctcatttattggcccagaaaaaatcctagtcatgcagtggcagttaaaaggtgctctaggtaaattgttaaataggcaaagtatgttattgatgatctcagccacttctgtgtctccctgtcccatgatgcccactccaactaacacagattttcagtccttttctctacctactttaaagtgccctggcttcctggtttctcttgtcagtcgagaagaaatatgatcttataagtcatatatactaagagtattgcttctgccaatagtagttataccttaagaactcagcagtatcaaataaagtagtaggtccatctagttgatgttaaatagcagaacctgctttattcctggtaatactataattaagtatttctgtcaaactttcaattataagatgaataaattctgaggatctaatgtacagcatggtgactatagttaataatactgtattacatacttgaaatttggtaagagagtagattttaagcattctcaccaaaaaaaaggtaaccatgtaagccatgtaaggtgatgaatgtattaattagtatgactatggtaatcctttcaccatgtatatgtgtgtgtatatgtatgtgtgtgtatatatatatatggatatatatccatatatatatatatataatcatactgtacattttaaatatatttcactgcatttgtcaatttaaaaaaatctgaggtcaggtgtggtggctcacacctgtaatcccagcactttgggagaccaaggcaggaggattgcccaagcccaggagttcaagaccagcttgggaaacatggcgaaacttcatctctacaaaaggtataaaaattagccgggcgtggtggcacatgctagtcctagctactcgggaggctgaggtgggaggatcgcttgaacccaggatgttgaggttgcagtaagctgtgatcacgccactggactccagcttgggtaacagaacgagatcctgtctcaaaaaaaaaaaaaagaaaattctgacaataaaaattatatgtagaatttgatgtggaacagtatgaagtggaatgttagttcccttctttttcagaaggtatcttgctatcctaccttttctccctgtcttctttctctaaatattatttatggattaaccctatagggagtttgttttttaaaaaagccacacctctattccaaagctcacaaagaacacttctaaaaggaaagcccaaaaggtgagcaatcacatccctcactggagggcaccacagattagtccctgctggacacctttaagatcttggtcttgtcttgttaaagatattccctgggtggccttcatcatgttctctagaaatataattccacaatagagaattctatactcttcaggagggatttagtaaaatcctgccaacatcttccaattcttaccctttttctgaaaacaattctctgttagccagagagtccaacaagtctgagactagaaattttaaaccaaaatacaaagaccacaatagaagtatacataagaaaaagcatataaatgcacacatacagagttgtgtttatcctaaaagcctctgagaatttcatatcaggcctgtgcagatagataacaaacacttctttaatcttctctttgaagcttcagcttcaataggaaagggaagctatcactcctctgcaatatccatactcaatatcatcaggacgatgcaaatgatatttggaactgaaaaatgatgagtacagaacgagcagagagagaatgttgcaaccatattgatgatgatcatttttacattcagtaaaaataaacccatcttcacttatgcctccaaaagtgaaaatggaagaataaaatttcacaatattttctctaagctacagaacagtcttaaaattttagtattaaattgtagagtatgctatttgtgttttcaaattaaagatgttttggccaggcactgtggcttgcgcctgtaatcccagcactttcggaggtcataagttcaagagcagcctgaccaacatggtgaaaccctgtttctactaaaaatacaaaaaaattagctgggcgtagtggcgcatgcctgtaatctcagctacttgggagtcggaggcaggaggatcacttgaactcaggaggcagaggttgcagtgagccgagatcgcgccatgcactccagccttggcaacagagacagactccatctcaaaataaataaataaataaataaataaataaatataaaataaagatgttttaactgaactttaggtcagatgcagtggctcacacctgtaatccaagcactaagagaggccaaggtgggtatattgcttgagccctggagtttgagtccagcctagacaacatggcaaaaccctgtctctacaaaaagtacaaagattagctgggtgtggtggtgtgcacctgcagtcccagttactgaggaggctgaggtgggaggattgcatgagcctgcgaggttgaggctacagtgagccatgattgcaccactgcactccagcctgggcaacagagtgagaccctctctcaaaaaaaaaaaaaagtaaaaaataaaaaatgaactttagtttggagaaaggtacaaataaattgaacccacagtattgagggaatcttgataagcagcagtcactgtagtagtaataacagtagtgctaataacaatgctaagatttattgaacattttgttggatgttgctctaagcacttttcttacattaacccatttcctcacactctaaccctattattatgcccattttctaaataagaaaactgaggcatcaaggattaaataacttacccatcataagaaagctaatggacaagtggacaagtttccaccaccaacaatcagtttcagaacaggacctctaatgagaaactaaggaggaaagtcttgaaaatataatctaacaattaaaacaatcatcaaaattaactgagtctttctctaaagatattttactattctaaaataattcagtgactcagtcaaccaattcaatatttattgaatgtcttctatgacaagccctttgcccaggtactatggatgaaatgatgactataatagatatgattcgtctacagatatatttcagtatctttcatactgcaaacacacagttctaggttgccaccccaaattcacagagtctataaagaacttaatcggacaagtaaaaaacaacgccattaaaaagtttgcaaaaagcatgaacagacacttcttaagagaagacacacaagtggccaacgaatatattaaaatgctcaacattactaatcatcagagaaatgcaaatcaaaaccatctcacaccaatcagaatggctatcattattattatatttttttgaaacagggtctcgccctgtcacctatgctggagtgctgtggcgtgatcatggcttactgcagcctcaacttcctgggctcaagcaatcctccccacctcagcctcccagtagctgggagcagcacgtgccatcacacctggctaattattgtattttttgtagagacaaggtttctcaatgttgccctaggctggtctcaaactgctgagctcaagcccgcctcagccacccaaagtgctcggattacaagcgtgagccaccacacctggccagaatggttattattaagaagtcaagaaacaacaggtgctggtgaggctgtggagaaaaggaacacttatacattgttggtgggaatgtaaattagtttagctgctgtggaaagcagtttggagatttatcaaagaacttaaaacagaactaccattcaaccccgtaatcccattactgggtatatatccaaaagaaaataaatcattctaccaaaaagacatatgcacttgtaggttcatcacagtgctattcataatagcaaagacatggaatcaacctaggtgtccatcaacagtggattagatttttttaaatatggcatatatacaccatggactatgatgcagccataataaacaatgaaatcacgtccttttcaacaagatggatgcagctggaggccattattctaagcaaattaatgcagaaacagaaaaccaaatactgcatgttctcacttataagcgggagctaaacattaggtacttatgaacataaaggtgtgagcaatagatactagggactaatagagatggggaaagagaaagaggggtaggagttgaaaaattattgggtactatgctcactatttgggtgatgggatcatttgtatcccaagcttcagcatcacactatataccctgtaacaaacctgcacatgtaccccctgtgtccaaaataaaagttgaaattgtaaaaaataaacaattcacagaaaacattgtcaggcttctgctgaaaatagggctactgaatctaaatcaacagattgcaagggagagaatatcagattcttggccatggagctaaccaaagaacatagttattgagattaaagtactcagagctttattccctcagtcagctaattagatagatcctgatgaaacaggtcagacaaacaactgtagctatcctcatattattagaaatactggtcaggtgtggtggctcacacctgtaatcccagcactttgggaggccaaggcaggtaggttgcttggatccaggagttcgggaccagccatgggtaacatggtgaaaccttgtctccacaaaaaaaaaaaaaaaaaaaaaaaaaaaaaaaagccaggcatggtggtgcatgcatgcctgtagtcccagctacttgggaggctgaagtgggaggatcccttgagcctgtgaggttgaggcagcagtgagccatgatcataccactgcactccagcctgggtaacacagcaagaccctgtctcaaaaaaaaaaagaaaagaaaaagaaaaaaagaaaggaaaaataattctatttcccaattataaaaaaatgattaacatttattagcacttacatgttaggcattgtgctagatatacacatatacatatgcatatacatcatatatatttttttgagacagagtctcactctgtcacccaggctggagtgcagtgcacaatctccattcactgcaacctctgcctcctgggttcacgcgattctcgtacctcagcctcctgagtagctaggattacaaacgtgtgccaccatacccagttaattttttatcttttagtagagatggggttttcccatgttggcaaggttggtcttgagctccttgcctcaagtgatttacccacctcagcctcccaaagtgctgggattacaggcatgagccaccacgtctggccctgtgctaggtatatgttttacatgtgttattttatttatttattcatttttgagacggagttttgctcttgttgcccaggctggagtgtaatggtgcagtcttggctcaccgcaacctccgcctcccaggttcaagtgattctcctgcctcagcctcccgagtagctgggattacagtcatgtgccaccatgcccggctaattttgtatttttagtagacaggggtttctccatgttggttaggctggtctcgaactcctgacctcaggtgatttgcctgccttggcctcccaaagtgctgggattacaggcgtgagccaccatgcccggcacatgtattattttatttaatcttcataaaaaccctaggaggtcagtatttttttaagacaaggttgcattctgtcacataggctggaatgcagtggtgcaatcatagcttattgtaaacttgaactcctgggctcaagcaatcttcctgcctcagcctccgaagtagctgggactataggtgtgcaccaccacacctggctaatttcctttatttttcattttagtagatacaaattctcactatgttgcccagactggtctcgaacttctggcctcaagtgatcctcctgctttggcctccccaaagcactgggattacaggcatgagccactatgcccagcccaggactactattatcctcattttacacatgaggaaactcaaactcaggaaggtcaaacaacttggccaagatcacatagctactaagtggcagaaccaagatttgtatccaggttgtattagtccattttcacactgctataaagatactacctgagactgggtaatttataaataaaagaggtttaactgactcacacttccacatggctgcggaggcctcaggaaacttaaaaccatggtggaaggtgaaagggaagcaagcaccttcttcacagggtggcaggagagagagagaacatgagagaagtgggaagcactagacacttatcaaacaaccagatcttgtgagaacccactcactatcatgagagcagcaaggggcaaatctgctcccacgatctaatcacctcccaccaggtccctcccttgacatgtggggtttataattcaagatgagatttgggtggggggacagagccaaaccatatcacaggtctacttggttccagagcccaagctcttaaattccatattaactgctttcctattggctgtaatatataaaaaaaaataaatctggtacttaagagaagatacagttgttttgttagatagcctatgggcatgaatcaaccctaatatgaatattagggagtggttagacagaggtctttaacctgaagtccatagtttaggcttcaggggatttcctaaactctctaaaattgtgggtgaaatgtaacacttgttttcttttctcttggagaagagtctatagacctcattagtgtcaataactcacccttgccccacacccaccaaaaatgatatgacccactgaattaggtgaatagagttgtaatggcattataaaactagctacccagaaaggccaacatctgtgatgttataactctagaacatctagatgaatttttttttgcaactgaagtattaaaagtgttattttacctgtgacttatggaaatttaaaacacatcatatactctctgccttggtaaactcctgctgaacaaaatcaaatctcttcttaatgacttaaggacatccaaatttgaacttctcttttttgttgtttttgagacagggtcttgctctgctgcccatgctggagcgtagtgacacaatctcagctcactgcaacttctgcctcccaggctcaagccatcgttccaccttagcttcttgagtatctgggactacaggcacgctccaccatgcctggctaatttttgttttttttttttttgtacagacagggtttcaccatgttgcccagactggtcttgaactcctggactcaagcaatctgcctgcttggcctcccaaagtgctgagattacagatgtgagccattgcattcagcctgaacttcctttttgtactaaaacagcaatgccttctgaatgcataggctgtctgcaatactcagtgtccaaagacttctatctctctcttgaccatctctgttctctgataatggctgtctccaaacagactgcaaaggctaacactgaagagttatcctgcattgaaaatggaatcttaggattcagacggacacctagttgggcatggattccatgcaagttgataaggctaggaaaaccccttgcaactgatcttgagcagtcagccacatggtagaagtttatttatgcccaaggaaatggctttgctgagcaatgctaagagtctgtacactaaatatttcctataattctttttctcacttggaaagattcacattgcttccaaattatcttctgaaagtgtcccatctactaccttgcagaaggtatggactagtggcaaagagtaacatggccagtgacacccaacaacagaaatgggaaaacagcaccatctggtggaagtccccagtggaggcatccaaggcctgggacccaggggtccaggtaccagccttagaaacaactgggcagcaaaaggaaggtctttggtggaagagctggtgatccttctagtcccaattccttaatctcaccaaaagtacaagacctaatgcctacctacaaggagcttacaatctagtccaaaatattagctctttgtatataatgagatgacaatctaatatgataaatactactgtaacaacagacaataggcatataactcaattatgtaatagaagaacatatcacaagaaggtcccgggttcttttgggggatgtaatatttctgtggtcttgagtctatatttacaagcccatctaggtagataatacaatgttcacctacctactaaatacaatgatcacaatcaaacttatattaaataataaacaacattatctgagattgacagtataactcatcacctgctcccccaccacaatttttaagtccattcctggacagcaaaaaagaaattaaattttgaaaagaaattaaagtactatttaacactagagtctcctataacacttttgctacatggaatcattgctatggtcaatgaaacacccaccatgagtataaacattaagaaacctaagaactctttttgatcagtgagtgattaagctttctgattgcaacactggaaacccacattctaacattccttcccctactttctagcatgaggactgttttttcaccagcaaatctcactagtatgtctacacaatccccatacttcctccatgtaataggcaacaaactataattcgatgaactaataaaggaaaaatgctagccaaatacattatggcaaaataaaaacactaaacaacaggtcagagttggagggtttttttctgtaaataaaaaggagtcattgaaaggtctgtttctttgtttgtttgtttgtctttaaggataaagaatgatgtccacatcaaatccagcagagatgtgtagcatggatgggagggagaaaagtggggagatagtttaggaagctacttgagagcaagagaaaagacaagacattagataacagacttagagactggctaggaggagagcatcaagaggaaagtcagagacgcctttcggttccaaacttgtgtattggagaaaacaaggtactgcttatgtacaaataactccagctgattactgtattctaaactgttgtctctttggcccttgctctgtcatttttgtcactgttgacgcttaaaaacctaattttgttttattttttgcttgcttcaggttaacagctactcttcgaccactgagacgccattatctgattagtgaataactggtagctgagtgaatgtgtgactgtggcccatatactcactgaattttacagctggaaggacacttaaaatcatttactctagccttcactttacggatgagaacaatgaagcatggagaggttatctgatcgcaccataggagtttaaaagtccacactgtggggccaccacagtttatcttgtacagaatcaggggcaagttcaaaaatgtgatattcatttaaaaatgagacaatttctacaaaaacatttaaaacctccttggaaaaactcggctatcatgcctttgatattttccttgttatgaacatggacatattattcacctgaaggcaaatgttatgtaaaaaatttttaagctggattagttattagagttcatctaggcaaggtggatatctcagcattaacatgccaacacagtctctgtatctcaagttacgaatactgcatttgttctctcagtagtagagatgaataaatttccactatttgccagacactctgtgagggactaagagcacagaaaacccaactgtggaccagtttggccgaaataatcaaattgtgtagaagtgatgtaattggcccagaacatgcaaatggtaaaaactgggaccagaagaacccatgtctgactaatgccagaatgtcttactgcctgcacataagagttgctaagggaggattcgagatcagagagaagcctggaaggggagggtcgggtcacagagaggccaggcccaagatgcagagggaggtcaggcagaggggccaggtccagaagaagagaaggtggcaaaggaccagcctagcaccccaaagcagttatgttgagtaagggacagggtaggatactgagtaggttccaacctgagagcctctcttttctcttgtgaagtaggctgtgacgtcatggaaagagtgagaagcaatatgatgaggtaaagactgacaagggtttgcggaggaaaaaaaattaaggaaaaaggttgctgatgtggagcatgtgaaataactaccagttatcactaagggttcgactgaggttgaagactaaactttactgtagtgcagccaggatggagactcatgcctataattccagcattttaggaggccaaggtgggcagatcacttgagtccaggaatttcagaccagtctgggcaacattgtgagaccccatctctagaaaaaataaaaaaaaaaattagccatgtgtagtggcttgtacctgtggtcccagctacctaagaggctgaggtgggaggactgctttagcccaggaggttgaggctgcagtgaaccatgattgtgccactacactccagcatgggtgacagagcaagaccctgtctcaaaaaaaaaaaaaaaaattaaataaaaacatttactatggcacaatccaattgtgcaatttttctccagaactgaatagctttccagatatacaaacagagaagatgaacagttgaactgatgatccaagattaggatttttctaggcttgtgggatgaaaagacaagagaatcagagaagactagaggactagagggataggtaatagagctcaggctgaccagagaagaaaccaattgccaaagacttcactatagtgcctgcatatattaaatactttagtccattaaaacattcaaaagcaggagatatcattactcttctctttcaggagtagaactgtcctttgtcccacaggtcccaaacttctcctacccctgtgttccctatttcaatggatgatattactatccacccagctgaaacttgggaatcatccctatacctctttttctattactatatatatcccattagtcaccaagacctgtagattctactcccttaataaccttttaatcaatctcctctccatctctgcagacactgagttcatctgagctttcaaaaggcctcacccacatccatgtaaccacatcgcaaacggtccatctgccctcatcctcctccctttgacctactctcctcagtgctgatgaaaaagggaatggaatgagcatgaagagcaaagtctttgcagacaggtctgggttgaagtcccagctcctccatcttctagctgagacttttgctgcagccttagtttcctcatctttaaaacagaaataataaccacatctgcctcatttggttcttgggaggactaacagaggtaatgcacgtaaagaacctggtaaacctccaataaatgtcagctgttagtcattagcaccttcattatcttaatgacctaaaaggccagcttggtcctatcattctcctgcttgaaatccttccatggctcacctcagctctcaggtcctccccggctcccgttcacactcctgcctacttgttcaagcaccctctgccagcaaacctttcctttcatgcctccttcttctcctagcggaccctccatgatcctttgaggctcagctaagtgtcctatgttagggttcccacagcacatctgtgcatgcctctcagtagcacctataatactgtattagcatcttcttgtctctctgtcactgagccctcaaggggcagtggcatagagcttgtgctcaataaatgtttgctaaatcagcgaatggaggtaagaagcaggaagggctgtctgagttcagtatgagactcattcagtataagagagcatttcagggaggggtagggacaagcttggagaggcaggcaaagggcaaggcacttccaggcaatgctatgaagtatggattttattccaaaaaggtggggctggggtgccttcattttcctctaaatcactcacacaaagtcaagaggggaaaaaagaaagaaaatcaaagtaagggatgaaaaagaagagagacaaaaataagaaagctttgttaaattgaaaccttcatccaaatgaagaattttttcccccaaagcctggcttcaaagacaaaccacaaaatgaccagtaaaaatatacttcaaaagacacgactgaatacacattgcggtggcaagaatccaatatataaatacaatcaatttgtttcctcattagaagctttcatgaagaaaatgatttaatacaaatgctaaagttactgacatagattaattgaaaaataacaacagaatcctaattaaagatataacattatttcactcattcacactacaccaaaatgtgaatcaataaataacagaatttagaaagccagcttctactggtaaccactctaagaactacaatgaattactgacattttcataaaatgcctatccttatgtgtacactttcttctatttaagaactgagatgtatacagaaatccagaaatcattttaaaattatttcacacttttcctaaattcgtaccattttacttaatccagattattgcttttgccctcaagttgatttttttccctaattgtaaagattctatactaaagtatcttcttctttttttttttttttttgagacagagtcttactctgttgcccaggctggagtgcagtggcataatctcagttcactgcaacctctgcctcccgggttcaagcaattctcctgcctcggcctcctgagtagctgggattacaggtgcccgccaccatgcacagctaattcttttgtatttttagtagagatggagtttcaccgtattggccaggctggtctcgaacacctgacctcgtcatccgcccgccttggcctcccaaagtgctgggattacaggcatgagccaccgtgcccggcctaaagtatcattcttacccatttactactttgtcataattaaacccttacataaagtacccaattatccaagccataaaaaaatggaatggactttgatctaaaagctaatgactacgtgaccagctctgtggctatatcagtacaggtcaggggtcctcagagtttcgattacaatcaaccagtcaatcccaggctttacctggctcatcttgggaccagggctttcagttctgtctcactttgagggattctccagcatcagaaacatcttgagatgttgccagttcacaaggaagcacagagcagcatatgaacatatccccatctcctcaccccaggagctaatcaggctgaaatgttgtcagctactgacagttcttaagccctgctggaaagattttcccttcattgttaaaattcagttgagaaccaaaatagtcacttacctcaaaaacaaaaaacaaaaaacagggtattctgataaagatttgtacacactttcctgatcttaagaatcccttggaccttttattgaagcacaaattctcagggtccaccccagacctagtgaattagcatctccagggtaggggcctagaaatctatatattttaacaaaatccccaggtttttgttaaaaaacctgatgatggggcagttttggaaaatacgataaaggaaacagatatttaccagtggttgcccattaaggaaattctagacaggcagctctcaattcaagtattgactgtattctaaaagttcatttccagttgtttggaccttggaatacattttcctaatgaaacaaagttgaaagttgtctgggccagctttgaaaatctattaaatcttgttaacagatctgaaaatttgtgaatacagtctttaattttcagaccaatcatatttcgaaagttgaagcatatatccatagaatgtattttcccattgacataacattctgaaaagtggttagggcaccaaattgtatgcattccttatttacagtgctttgtatacaaattatacccaatgatactgaaaaataaaatcaagtatggcaaaggagatttgtcttccttctctgggtacagggaacataggcaacctttgacattcttatgctctttctttgcaaccattttctgccttccagtggcctcagcccttgtgccaaagacccaaatgttatccactactaaagcatccctcctcagcttacctatcactgcctcatgctttactcttccaaactacctatctgtcctcttcaaacccaatcaaaactcttatttccaggagttggttccattttgtcttttcagccatacctcccattactctcttttacctaatcaacagaatcaccctttggttcccaaaaatgcctaaactttatcacctctgtgtcttagcacatggtatttctgcatgcaatgtgtcttaccaaaaacctatcccattcaccccacggccaagtcatgatgccaactcatccatgaaggcttctcaagcccaccagaagggatttccttctctgggcttttacagtattatgtatgtgcagtgttttgtatacctcaataaaactggaaaataaaataaaatatggcctcttctaaaaccttgccacaatatatcttgaattacagttatttgtgcaggatttttttatctttcccatgaggttataaatttcttgggaatatttgttggctatccactatgtgacatgtttgtgttaggcacttttatgtacataacaacaaccctacaaggtaagtgtattgtataatgatttggtttattctgctcaaaaataagttacagaaggactgggacctatgttgtgttcaccacaaaaatgctttgcacatagtatatgttcaataaacatttgtagaaactatgagtgaatgaatgaagttgcattattcactttctatgacaaggttgagcctcaataagagtgctttcccaatagtcatactagctgggttcaaattccaattctagaacctaatagctatgtaaccttgagcaagttgattacctttctgaacctcagttttctcatctgctatatagggattataacagtatcaacctcacacacctgttgtaaggaaagctcttgacactgagcctggcacatggtatgtgtgtgatgaatgttagctgtgactattattcttaaaaaaaaaaaaaaacccacatggggggaggggaagggatagcattaggagatatacctaacgtaaatgacgagttaatgtgtgcagcacaccaacatggcacatgtatacatatgtaacaaacctgcacgttgtgcacgtgtaccctagaacttaaagtataattttaaaaaacccacataaatgggaaccactcagactgtgtcctctcctccttactctcccagaggaagagaagaatgattgtcaatggcaaatggcaggtgcagcgaagcaacaccaagagccagcttcatgctccggagagaacactacatctccttctcatggtttctggtgctccacatgtccagagaaacttctctagcaactaactatagaaatgatccctgaaagtatagtctttatgactgttattcttaagctgcagagataacgaacctctaaagtcctcattctgtctgagaaaaggcatcctctgttacttctataaccctcagtatacctagcactgtgcattgcctgtaatagtggttcaaaaaaccacttcactgaatgtcctcagtgaagccatcttaaccaaaagttggaaggaaaccattgaacaggtctagtacacatgactgaacaaccaaaagtatcttcaccctccaggtgaatttgtattttaaaaaaggacgttgaacccaaatgaatctctaaggggtgaaactgcaggcatgtaataaattgaaaacaaaccttcaaaccttctagagcagattatctgggggtagtgggctccatgctggtctatggaggagctaagatgactctagccgctcactggcccaagaactgcttgaaaaacaagaatatgtcttatctgacactgtcttgatcacctggcatagtgcctgacataaacaaatagccaatacatatttgttaagtaaattatctgcttccggtctataatcctcacccggcttttagttgattccatttctctttattaccaacataaaaatcaatcatggtgactgatgttttgagaaggaggaagtgaatggtttactcaagcaccctcactttggaaaagtagtctgacaaatacaaatgttttactaaatagtcacacagagtgtagataatcctcttctaatgaaggattcatcctgtgtcagttcagtgcagctcaaagggataacatctgaaaaatggaagttgttcccagtcagtgatacctcatctaatgaaggccttgagagtcaacttccttaattaaaaaaaaaattttagaaaaataatcacaaaataaaactcaaagtactgctatattttacaaggctcaaaaataatttcattttcatgtgtatgtatttaagcacagagtaaaacacttcggaagacagctgtttatttgcacagaagtgacccaaggccaggctgcacaattaaagcctaattttctcttcctacatctctccctgtcagtcccaactcctttcccacctggaaactgaatatccttcaactcttaaatctctgcccttttttttttttttttttttgagatggagtctcgctctgttgcccaggctggagtgcagtggagcaatctcggctcactgcaacctctgcctcccaggttcaaatgattctcctgcctcagcctcccgagtagctaggattacaggcgcccgccatcatcatgcccggctaatttttttgtatttttttttagcagagatggggtttcactatgttggccaggctggtctcaaactcctgacctcaagtgctctacctgcctcagcctctcaaagtgctgcgattacaggtgtgagccaccatgccagcgaataaattaccctttttaaaaagtttgctctttcaacatggaatggaggagcagaataaactggaacagggagagactggaggcagagaaccagaaaggagaattctgcagtgcttgagtacgactttatgaagactaaagtttagctagtgacaaagggaagagaaagaggaggacatttagaacgaagaatcaacaggccttgttgatggtttggggagtgaagggggagcaatcaggaatgactcccaggattttgccttgggagcccaggcctagagaaagcagaagtagacttcaggggtgagcagaatgtaagataatgagttcagttccggacattcaagcagttaggattcttctagccacaaataacagaaaacctgactgacaagggcctaaacaagtggaagttaatttttcccacaaaacaaaaggtctgaagacaggagattctagagttgtgcagggcccaacgatgacatgaaggagccaggctcttcccatatttctgctctaacaccttagagcagagtaacgtcctactgcatttcagtgtattactatctcccaactataagactatcctgtgagaatctatcagaagtcttcttacatttatttggccataacaatattttatgtaaactctagaccaagcactggcaaagcagaatggcttatagatcatgattctgttgtcaaggaagaagggatggtggctgctgagtaggcatccagcagggtatgcccagctttgtgaagtttgaggaacacccagaaggaggtatgcaatatgctgtctggtgccttggagggagaactgcagctgagctgtagaattgggagtctcccatgcacaggggaagctgtggagctatggacatgcatgtaactgcctcctaaggagaacgtggtgaggaaagagaaaaccctgaggaacaagagcaaagagggcagggtagaaaaatgagctcaagggcctaaaaaagagcataaacacaaggaagaagaaaaccaggagaattcatgagaatcaatggagagttttttacatttatgagaaaaaggatgtgatcagcagtgtcaaatgctacagaaagaccaaataagacaaagacttaacagtagcacctggctgtggcaattggagacctgggtacattggagaaagttgctcaataggagcagaagctggattaaaggggactgaatagtgactgggaagtgactagagaccaggaagccagaaatagctactctaggcttctatttcaagaagtttgcctgcacaaaataaaaaaaaaaaatagatgcaaagacagtagctaaagagggaatcactgtgtaggacacaatgattttattaatattaggagaaatttgagtatatttatataattattggagagacataatgaagaaggaaaagctaaatttaagaaagaggaagtctctacatcaagaatggagtgaagataacaactatgagccaatgcttcagtcctcaaatactgtgtggggggactctgaactcaaaagatgaaaaaaggacagggtactgtaaagccacaaagacaaactttaaaaggggagaggtctgaagcaagattgaatagtgaaagtccagaagtagcagcagggagcttgaagaatgccaacagcactttgggaaaacgagcagattctatttaaaaaggctgcaagcaaagagggtcctgtgggagaaccatcctttaggatgcagaaaagaggtggaggatattgtggggtttggttataacaggacgtagattctagggaacacaggggaaagagttagaaaagaggtcttcaagaaagaggagaaatggtagagacaaggaagtgcaaagctgaatagggatgctgccggccaaatgtagagggctgtcgataggtctcaaagatggctggaatgcctggcatccatgctgtgatagaactccaatacatggtcagtagccctgtaaccttttgtcacagttccaattagaatattagagatatgttattagaggagacacgtgaagagatggatgccttggttctgtctctcctaacactcagtaaaaagaaagcatccttatttctaggaaagaatatgtagggttggctactaaatagtaagtttcctaataaagagggtcttttgttgttctcaggtctagtctaggacctaaaaatacatttataacagtttttcaccatgcattttactcacatcattgaactcatgcaacatgccagcaccatgctagaccttttttttttttttttttggtgactataagaccattcatgcctttaaggagcttatgatctccagaaatatgtattctaagttctgagaaactgaatttaaaatgaatctgatgtgtgaaaaccgtgcttctcaaatgttaatgtgcatactgtacaaataaacttaggatcctattaaaatgagattatgattaagtaggtctcattcaatggagcctgagagtctgcattgctaacaagtttccaggttgctgttccatgttgatacttggagtatcgaggatctaaagactagcgaaagcaatttattgtctgatcttttcttgtctcccctataaagtcgtgataatctttcttcctttccttgctaacccttctatccagtgtccatttttctaattaaaacaagttaggggatgggggcaggagcagggaagggaagctagaaaacctcatgaggggctttttcttctaagcaactattagctacatacactgctttcatgaacatgtcaaacatctatctcatgtgattaaatacttctgtggaaccactaatatttcaaacagggcacctaaatattcagtagaagaacaagagactgagaacagcaattaattctagttatgccatatggcagcatagaacactggctggaacctgaaaactcaatttcacaagagtcttacttattctgaattttaaccattttaggatcagcaaacatatgcctaccaacctgctccatttatgcaaaattctgaagcataatcacactgcacactcaaaaatgattggtttttcccaaatggacttaacatttttctcctacaagattcgcaaaataaagtagctgctgagagccccagtttaatctccctgttaaatataatcttcacacaattcttttaaagaatagtatcacttgcttccttaccattttcatcatcagctcacaatattgcatgagtataattttttgtggtcttggatttctcagctctgtgttggttcatgaaccctcctatccctgtgcactctcttccctccaccgtgcctgtaactgctaagacacccatgccactatctcttctctccatctcacctctccagaatggaaatattatcactttcaacatatacttcatctccagtcctcttagaactaagataccttcatgtctcctgtacatttaataatttcaagataaggacagaaaaatcagttcttgctttgtgaacttttgtctctggtgcttgagagactgtcctaatatcccctgaacatgttttagtgataacatttactgcactagggccaaaatgattttgtgccactttcaattctagttcaataaaagaataagagctttgtttctaacctctgtcatttttaataccataaaatgatttttaaattataaaattgagttccatttcctgctggactaccaatctcatattagctttccttttatcaaatttatgagaaaagtcagaaattacctttcctttttttaaaaaaaatcaaaatttcaggatatcccaggtagaatgttcgaattgaattttagctcctaataattgctggtttagaagttttaaagaagtacaaaagttagctacttcctgttacttatgtcagaaataacaaactggaggattatcccctagttcagtattacccaaaaataataagattattcctagaaaattatcatctttaaaaaccatatcccatatggaggcagtctatgattttctgaaaccagagtgaataaaatccatggttcctgaaatgcaaagtcaaaccaatcaaatattttttataacattatattatggggctgggcttggtggctcacatctgtaatcccagcactttgggatgccgaggcaggcggatcatgaggtcaggagtttgagaccagcctggccaacatggtgaaaccctgtctgtactaaagatacaaaaattagccgggcatggtggcatgtgcctgtaatcccagctactcacgaggctgaggcaggagaatcacttgaacccgggaggcagaggttgcagtaagccgagatcacgccactgcactccagcctgggtgacagagtgagactctgtctcaggaaacaaacaaacaaacaaacaacaataaaaaacctttatattatgaaaattttcaactttgcacaaaagttgaaagaacacacatgtacacccacaatctagtggatatatgctgtgattcacattttatttgctttgtcatatatccttccatccatattattttttatacattccaaaacaaactgctcaaattagaacactccatccccaaacaattcagcatgcatataattaactagacttcaatatttgtttacagttttttaaaaccaataatctttgaaagatgccacttcatttttttgatggcttggctagataaaattctaaattctaaatcctaatatttaaacaaattctgctactttgagtaatttctcatataccagttctctcatcaacaaaagaacaaaggcacttggtaaacgtgatagaaggtctaaattaccaaattgtttgggccttgtggttatggtagaatttacaaatgagagtcactcactaatataacttggagaaatagctaattggagattatgtggccataaagttttctgtaaattataatgagaacctcaacaaggctcacaaactcaagagggagctttgagtttcagcatttaattataacatatcttttataaaccacactgtgataaaaactaccagaagctggacgatttaagaatggctcactacaagtggggattttgtaacaacaacaaggcaccagcatcaaattggaattttcttggctttgccatgctgtagtactactggtttgtaaactctattaattgtctgactacagtaagagctgccacagggatagcacctcttttatgagctgtttgttcccctacactattttttttttctttcctaagatgggccctggaagggacacccttcgaagcccaaagaatcaaagctactgcaaagcactgctgagagttttgaaagaaatatgaagaaactacatcacgcctggggcgataggctgagatcttcccaaacaggtcagcagttggtctctaaaatattcctgttgccaaggaggcaatgacatcttgtgtaaatcaaaaactaaaaccctaagatatctcatttccattttaaatgcttgggggctaaatatggatgtctagcactcgagaagttcctgtgggattgatttttttcccatcttctctgagccctttgctgagtgtgataagcaggactgcatttcattatcaaccctgctagcactgtacttcagggagactagaggaggctacacactaggagagaagatccagaatccaaagaagaaatgattcacatggtgtgattataaaaacccactttatgctcaactcattttcaacagaatcatgaaataaaataaaatcccaagaaatgaaatttcctgcatcacattccaaattttttaaaaagtcatgggggtaccataaaagaaatcaaatagaagttttaaggtttggttggtaatgtgtgcatttttggaacatttatttaaaaaaataattccaaacaacattttgggtaagcaacctaaaaagaaaacataagattatcattaggggaatcttcaagtgactcagtgttacagaagtaacatcagaacaaagggcttggctcctgacacttggcccagtgctcttgcatttccctcccctctgttccagtttccctgtaacacagaaagtggatacaggctgggtccatatcagaaacaagagaaaacatgcaaattagagaaaaccatcatcagtaaggtcccaagccacaggttcctggaatccacaaacagataaatacagagaggcctttttcattggctttccttaaacagagaaaatagcatagctctgggacaaaaggctagctccagatcaaatgagacttaaaatcaaagccaaagcaaatggtgataaaaatgaaggcagtaatttcatacagatgatcttttcacacaatgtatgaattaagtccatctacagacagtgaggcttcacgtattaaaaaaaaaggacacaggattttctgaaaccaagacaaatccatattgagtagctaataggaatgtgcccaagtgataacgatggctaaaattctatcaggagtaaagcaaatttcagtgacctaactatacagttaaagagtacggctcagcttattattctaatgggttagtcagactgtaagggtgcaagttcagttacctgcctgtgttctagctcacaatcccaaactccttttcactcttgattgaggagctcagtactgggaagaattatacatgatctagttttgcaagtgatctaaaaactctcttaaaaatacattgtcctaggtgcggtggctcacgcctgtaatcccagcactttgggaggccaaggtgggtggactgcttgaggccaggagttcaagatcagcctggccaacatggtgaaaccccgtcttcactaaaaatacaaaaattagccaggtatggtggtgcacgcctgtagtcccagctactcgggtggctgaggcacaagaattgcttgaatttgcggaggttgcagtgagccaagatcatgccactgcactccagtctgggtgacagaatgagactctgtctcaaaaaaacaaaaaactaactaactaacaacaacaacaacaacatcaaaaacatttttctgaacttcaatctaaaatcttaaagatataaaatgaaaatataaaaggtatggtttattctgaaccaccaaggactatggtcattattacattaaaaaatgttatttaagaaaaattgttctacttccagatagcctcacatatgaaagaataaacaaaataatcattatgataaaattataaggagagttatacatttcaaagctattttgaaaggacagagacttgccataaaaaacacataagatgatcttccttaccaggtcttaaaagttaagccaagagatcaacagtaagtaatattctatctttctcacctgtagggcattccagattaaaacagcaataaatacaacctctcattcctagagaagtagattcacaaaactctttaactcagttgtgaaatctcaacattcatccactgaataacagagaactaagcaaaaatttgactgatataactgatgagttgagtaataatgttgaagttgttgtgggtttgttttttcttcctttaaggatgggagggagggataagactgaaaaaggaagaaatgagttattaaccttccagatgtggtcaaattattgctatgacttttgagccttttcagagctatttaaacttagacggatcattcaactacctcttcctttttttttttttttttttctgcattggcactgaagctccagtacaagtagcaaaattaaaaaacagaaaaagatgttatgagtaaatcttgaaacttgtgaataacataaatgtattaatagcacattatacattagttcttttgataagcatacttcatttgaatgtgttttgttttggggatttttaagctcaataattaacatttaagaaaagtaaaactctctatataattaatggtaattatatttacagtatactacttcaaaactcttgctcccaagagttttatcaggctaactccttgtctttcttcctataatacaaaaatatcagaattatacattcttaagctaaatcttgttttaaagctaaatccacgttaagctgaaaagaaaacatgaaattcccaaagaaagtcagaattatttttatgagattttactagtatatcatgtttcacacagagctataggttagccacccacaaatgagacacgttcaagatattctttcagcctgtagtttaaatgtcctgagttttgtgccataaccctgttacacaaaatgtatttctttatttctttccatctcaatatgatataaatctactggtctctttttggaactccttcagcattactaagtttcacagaaggaaacaatactccaagtttgcttccattggctctgtccttcacttccaacagggagcataaatgactacttatccaagaagggccattgagagagaaattaagccatatctcaataataaaaatattctatttttggctgggcgtggtagctcactcctgtaatcctagcactttgggaggccaaggtgagtggatcacctgaggtcaggagagaccagcctggccaacatggtaaaaccccatctctaccaaaaatacaaaaacctttagccaggtgtggtggctcatgcctgtaatcccagctacttgggaggctgaggcacaagaatcgccagaacctgggaggtggaggttgcaatgaaccaagatcgcaccactgcactctagcctgggcaacagagactcggtctcaaaaaaaatatatatatatatattttttttttctttacccctcccccactctcaacgtattcttgcagtcagatggcctccactgaatcaaacatttaaaaaatgctctactgtttctcccaatgcgttagaatgccatcaagtgtctgagcacagatcacaactgcttcattccaggtgtctcacatctggtgctaatcctgcagtgaccatcgtaataaagcaggaagtgcctttgcctggctttcatactagccactctccaaagggctcaatgaaaacttagacttggaatgtgaaagctgtttagtttttaagaaaagcaatgaaaatcacagcttaggacaacaaataccacaatagggcttcatttccttggaatcacagaaattgctatccgtttttattttgtgttacatggaaaatattagccttcattggtaacactttcaaacaaaaagaaaagagtatgtaaatatagataggattttattttttgtttctaagtctaaaaaaagatagctattttttgtttctaagtctaaaaacagaatagctaaagtgatttgtactgaaaaacatgagcacttggagaacacccaggattcttgacacaattgtcttttcctgtggtcattcactctagacaacaaaaaatagcaaaaagcacattataatagctgtgatagagtcagatgcttccatttacagcaagtccacaaccatggcaaataccagtgaatgccaagccagccataaaaataagagctaagcccctaaagtttaccaagaatcacagacagtgctacttttatttctctccacccttttgtttctagagcaatacacgttgaggaaagaattaaaggaagcaaggaaacaacaaagagactaggaagttgtaaaatatatatatatgtgtgtgtaaatatataatttacatttatctagtagtggcttttccagattatcttgctagagatttatctaccttccaaataagacttgaagtgctaaattatagttttagataggttaccaccccccccaaatttatcaaactcctaaaatattattgttttaatctgactaaaaataggccaggcacagagactcaggcctgtaatctcagcattttgggaagccaagacaggagaactgcttgagtgcaagagttccagaccagcctgggcaacacagtgacaccctgtctctacaaaaagtaaaaaattagccaggcatggtgatgtgcagctactcaggaggctgaggtcgggggatcgcttgagcccaggaggtcgaggctgcagcaagctgtgattgtgccactgcactccagcctgggccacagagtgagactctgtctaaaaaagcgaaaaacaaacaaacaaaaaaatgactaaaaagaaacccttttaaatgatcttcattaattttaattatttttgtgttactgtatggttcatgtatttgccgtatgtttattttttactcttttttttttgagacagagtctcacttggtcgcccaggctgaagtgcaatgtaatgatcatggcccactgcagcctcaacctgctaggctcaagtgatcctcctacctcagcctcccaaatggctgggaccacaggcatataccaccacacctggctaactttttattttttgtagagagagagttttgttatgttgcccaggctggtctcaaactcctggcctcaagcgatcttctggcctcagcctcccaaagtgctgggattataggagtaagccactgcgtttagcctgccatacatgtttaactctcaagtttgatgacttctaaatttctttttatgccaagctttttgggggacatataactgccacacaacataagtaaatgtggcagctataaatggcacaatagaggtgatatggctgaagaagaggattcaggaaaacaagggttacattaacagaatgatgattgaatgggtggatgtaaggcaatttcaaacagcttgccaaaggaaagcctcgtttttctattttcttgtacagtatctaatttctggctcctcatttcctcagtgatctgataattatgaaattctaaataaagtgtcatctttcttgcaacaagtcaatgaacagaaagctcccatcaacaatgcagatatttcctaaagttcccgctgatgatttcctgaatgtctaccccacaaaccacacacaaagttctttgagaacaagaatttgagaacaagaaactgactctatcccatgacaaattcagcttgcgtgtgtgttcatgcatgtgtgtgcatgtgtgtatgtattttaaaagaggattaagaagtataataatatgcagctgacagtaatgagttaccgtaatttgccttttattaccaacttaagattgaaatttagtcctttctcaatgctgtggtacaaatacaggaaagaattcctcctcattgtgtatttgtacccacagctgcagtaaaagtatttttgcattccttatcagagatttataccaacagaatcaccaaatacaccattatatttagggcattcctctcccaatttaaaataattccacctttattccgcaagccacccttagagtaatcataaaatacaaaggcaaacttgtgaaattaaaaaaaactataggttactaagtctccaggtatgtaactaagcctaaacttatctattaataaaataacattatggagaactttgttttaaacactctttcaacctaccaaaaattatagatattcccactttttcaaaaaactcccatcttttgcattctgtttgtttcaattattcagggcaacccaggctgataattacacagtccccagttgctgagtaaaagtgatgcttaattagccagcaggaaagatcgattaagatccagcagggcatctcatgaggttctctcacattcctgaatggaatagattctggctgtgcccttccgaaggataaaattctctgcttctatggagtttcaatgaggtttttagagcagatactaagaactgtcagccacgcaaattaaatcccaaccataaccctgcagatgctcttccttttctaagaatattcagtttaaacattctgaatcacattgccaccaggtttgaaaaggctaaaggaacactcacttatcccttgttctcattcagttacccatttcaagcaataggtggtcagaaaatatattataaaggaaaatttttattttttccccaagcaagtgtttgcatctctcagatgctcacattctaaaatgcacaaattacatcagggcctcttatttttaaaaaatgacataatatttcaacccagtccaggaataaaacatcccaatgtagtcaaagaatcaacttgataagtctcatttaagttttctatgaggtaaggagatgtggaagtaaaatcagtaccaaaaatcataatgaacattatctcatactgcctaacactttctcgttaataatttggacaagcataaatgtttagctttcaccatttttttagttaaatgcaaaagtggtcaataaaggctaacataaaaatccaaagctaaaagcagaataattacctcaagatacatacataattatcaaaacatttttattttggtaaactacactaactatgcttgcctgcctccagttcaattcagtaaatatttattaagtttctgccaagtataaagaactatgataggtatgtcttaccttgtgactttattttactgattataaattgttttaaagcttatgaagaagattaatggaaccagtttatacaaacctggctttgatttgctgaaagccccgtagaatatggtctctgtgatcccttgcaacagcgctgaggttctcattccgcaaaccttctgccagaaactcttcagcatctaaaagaaaaggaaagttgataaaacagaaaagatgtactaagggagaaaggaaaatcagaaggattaagaaatggcacatgtatacatatgtaactaacctgcacaatgtgcacatgtaccctaaaacttaaagtataataaaaaaaaaaaaactttatagttgtggcacaatgtgaatgtgcttaatgccacagaactgtatactttataatagttaagatggtaaaatttatattttgtatatgttaccagaataaataataactaaaattttatatatacctgtaggtaacatgttctaataatccaagaccttgctatgaatttagaaaactatgacatatattagccataagaaataactattttctaaatcattttaagtaaacatttacatattaattattactgatggcagagaatggactgtaaatttctttctttcttttaggggggggatggagtctcactctgttgcccaggttggagtgcagtggcgtcatcttggctcactgcaaccttcacctcccaagttcaagtgattctcctgcttcagcctcctgagtagctgggactacaggcgcatgccgccaagcccggctaatttttcgtattttagtagagatgggttttcatcatgttgcccaggctggtttcgaactcctgagctcagacaatcagcctgcctcggcctccccaactgctgggattacaggcgtgagccaccgcgcccggcctggactgtcaatttcataaacatgtaatattataaataagtcacagaaggtcacaggccaatagaagctagaaagaaataccaataaatagagccgaaataaaaaatagagctgaactgcaaaaatcaagaacaaaagggcaggcattcaaagaaatattaattagcagatgcatcatcaatgaaaatgacaatacaaccaagtgaaggaacccacatgagaaagacaaatgtctccaagagaagggaactgcaattaatgtgaacatatattataaaatagggacatgatagaaatacataatatgaaacaaatcatgttatgttgaaggaagaaattgcagagggggggtggttctacaaattttcaaagacaaaatacattgataatgattacaactgccagaaacactggctacacattttattctgcacaaaaggtttgtcatcccccaaaagcgtataaataatatagttaaaattttccacctccaaaaattgtgcgtgtaatatgaaactgtatcatatatatcaggagtccccaacccctgggccacacacaggaacctttatttcctcagtgatctgataattatgaaattttaaagaaagggccacatggcaggaggtgagcagcagatgagcaagtgaagcttcatctgtatttacagctggtccccatcacttgcattaccacctgagctccagctcctgtcagatcagtggcagcattagatccttataggagcacaaaccctattgtgaactgtgtatgtgagggatctaggttgtgtgctccttatgagaattaatgcctgacgatctgtcactgactcctgtcactcccagatgggaccatctagttgcagaaaaacaagctcaagcctcccactgattctacattatggtgagttgtataattttttcattatatattacaatgtaatcataatagaaataaagtgcataataaatctaatgctctttaatcatcgccaaaccatccccccacccccggtccatggaaaaattgtcttccatgaaaccagtccccagtgccaaaaaggttggggacccctgatacatactatcaaaatattgctatgaatttatatagttggataagcacacctaaaaatttgttttatattcacgtcatttaacaacgccaggccgggcgtggtggctcacgcctgtaatctcagcactttgggaggccaaggcgggtggctcacgcctgtaatcccagcactttgggaggccaaggcgggcggatcatgaggtcaggagattgagaccatcctggccaacatggtgaaaccccccgtctctctaaaaatacaaaaattagctgggcatgctggcacacccctgtagacccagctacttgggaggctgaggcaggagaatcacttgaaccagggagttggaggttgcagtgagctgagattgcatcactgcactacagcctggagacagagcaagactccgtctcaaaaagaaacaaacaaacaaacaaaaaaaaccaccaaacaaaaaatcctaaatagccatcgctaggacttttgatgagatacaaagtcctggaaattgaatatttcacaaaggaccaccatcaacatccaagctctgcattgtatctattgcatatgtgatttaatgggttccactagggtcctttgaatgctaacgaatgaggaaatgggaagctgaattaaaaggcaaaaataaatgacatctaagattcaatttatgtaatatatcataacaatagaataaaggaaaaaaaccacatgatcatctcactagacacagaagaagcatttaacaaaagtcaacagcctttcgtgataaaaattctcaacaaactaggaatagaaggaagcttcctcaaactaataaaaagcatcaacacaaacccacagctaacattgtacttaatgattaaagactggccagtcatggtggctcgtgcctgtaatcccaaccttttgggaggccgaggcaagaggatcacttaagggcagaagttttgagactagcctagatgatatagagagattccatctctacaaaagataatttttaaaaaattggctgggcattgtggtgcatgcctgtagtcctagctactcaagaggttcaagtgggaggatcacttgagcctggaaggttgaggctgcagtgagccatgactgtgccactccagcctgggtggcagagcaagactcttgtctcaaaaaaaaaaaaaaattaaaaagaaaataaatggtcaaagactgaacactttccccacgttccttagatcaggaataagataaggatgtctgttctcaccacttatactgaacattgtacaggtgatgccagccaggacaactaagcaagaaaatgaaataaaaagcattcaaactggaaaggaagaagtaaaactatttctatttgcagatgacatcctgtatatggaacaccctaaggaatctattaaaaaactattaaaactaataaaagagttcagcaactttgcaggatataagatcaatgtaaaaaaatcaactgtatttcttttttcttttctttttttttttttttgagacggagtctcactctgcctcccaggctggagtgtagtggcgcgatctcagctcactgcaacctctggctcctgggttcaagcaattctcttgcctcagcctcctgagtagctgggactacaggcacgcaccaccacacctggctaatttttgtatttttagtagagacagggtttctcctcgttagctaggctggtctcaaactcctgacctcaggtgatccacccgcctgggcctcccaaagtgctgggattacaggtgtgagccaccacgcccagccaatcaactgtatttctatatagtggcaatgaacaaacaaaaaggacattaataaaattccatttaagatagcatgtaggatgggcatggtggtccatgcttgggattattctcagcacttcgggaggccaaggcgggcagatcatttgagcccaggagttggtcaacatgatgaaaccccgcctctacaaaaaatacaaaaattagccaggcatggtggtgcacatctgtggtcccagctgctcaggaggctaaggtggcctcatttgagcccagggaggttgaggctgcagtgagctgagatcacatcactgcactccaggctgggtgacagagcaagaccttatctcaaaaataaaaattaaaaaaaaagaaaagaaataaagcaggtaaaagaattaagaattaagcacttacgaataaatagaacatattctatgttcatgatcagaagacttaatatcgttaaaatggcaatactccccaaactgatctaaagcttttatgtaacccctatcaaaatcccagctggctttttttgtagaaattgaaaagctaatcctaaaattaacttggaaatgtaaggaatccagatagccaaaacaattttgaaaaagagagacaatggccgggcgtgttggctcacactcgtaatcccagcactttgggaggctgagacgggtggatcacctgaggtcaggagttcaagaccagactggtcaacacggagaaaccctgtctctactaaaaatacaaaaattagctgagtgtggtggctagtgcctgtaatcccagccacttgggaggctgaggcagaataattgtttgaacctgggaggccgaggttgcagtgagccgagatcatgccactgcactccaacctaggcaacagagcaagactctgtctcaaaaaagaaaaaaaaaaggaaagaaaaagaaagacaaatttggaggactcacactttctgacttcaaaacttaccacaaaactacagcaattaggaaaatatggtactggcataaggacagagataaagttcaaaggaatagaattgggaatccagaaataaaccctcacacttatggtcaatttttgcaagagggtcaagacaattaaatgttgaaaaagttgttttttcaacaaatggtgctgagacaactgagtatacacatgcaaaagaatgaagttggattcctacctcacaccatataaaaaaattaactaaaaatggatcaaagacctaaatataagagctaaaactatgaaactcttagaaaaagacaggtgtaaatctttgggtccttggattaggtaatggtttcttagatatgacaccaagaaaaaaaaagcaaccaaatacaaaaatagacaaacaaggcatcatcaaatttaaaagctattgtgcttcaaagaaggccaacaagaaagcaaaaggataacccacagaatgagagaaaagcttttgcaaatcatatagctgatgaaagacttgtatgtagaatatattaaaactcttatatttcagtaataataagacaaatagcccaactgaaaaatgagaaaaggaactgaatagacatatctctaaagaagatacacaaatgaccaataagcacattaaaagatgttcaatatcactagccatcagggaaatgcaaatcaaaatcatgaaataccacttcacacccactagaatggttacaggcgaaaagaacaacaatgaatgttgttgaaaatgtagaaaaattggaaaccttatacattgctggtaggaatgtaaaacagtgcagccacttagaaaaataatctagcagttcctcaaaaggctaaacagagaattatcataggatccagaaattatattactaggaaatacccaaaagaaatgaaaacaggtgctgacacaaaaactttacacaaatattcatagcagcattttttttttttttgagacagagtctcgctctattgcccaggctggagggcagtggtgcgatctcagctcactgcaacctctgcctcccggattcaagtgattctcgtgcctcagccccccaagtagctgggattacaggtgcatgccaccatgctgggttaatttttgtatttttagtagagatggggtttcatcacttcgcccaggctggtcttgaactcctagactcaagcaaactgcctgccttggcttcccaaattgctgggattacaggcgtgagccaccatgcctggcatagcagcattattcttaatagctaaaaagtggaaacaacccaaatatccattaactgatgaatggatagataaaatgtagcatacaatggaatattattcagcaataaaaggaaatgaaatgctgatatgtgctacaacatggatgaatctttaaaatcattatgctaagtgaaaggagccagtcacaaaggaccacatatcgtatgattccatttacatgaaatgtatagaataggcagatctaaagagacagaaagtagataaagaaagtcaggaagagggattggagagtgaaggctaagaggttcaggttttctttcggtgtaatgaaaatgttctaaaatttactgtggtgatagttacacaattctgtgaatatactagaagccattgagttgtatgctttaaatgtgtgagttgtatagtatgtgaattatatctcaatgaagctgtttaaaaaaataaataaatacctgtaatctcagcattttgggaagccaaggtaggagaactgcttgagcccaggagttcaagacaagcctgggcaaaaatcaagaccctgtctctacaaaaaaaaaaaaaaaaagtttttaattaactggacatggtggtgcacgcctgtagctacttgggaggctgagacagtaggatccattgagcccaggagttcaaggttgcagagagcggtgattaacccactgcattccagctgggtgacagtgcaagactctgtctcaaaatactatattgaatattttttattacatttacactttgaaaatcatagttaaaatatatatacatatatatatatgtatcagtgtgtgtgtgtgtataaataacaacacctacacatatccttttgagctttcaaaatttcaaggaaagtgaaaacatctctcaagcacccagagagaaaaaataagacacctacagaacaacagcaacaagaacaacaaaatcaaaatggccttgctacaaaataagcatcagaagatgagacgtgtacaaagttttaaaggaaaaatggtgtgctctaagaattccaagcatagtcaagatgttggtttggccatatagaaggagaaaatcttctgaagtatatgttctgatccacaaagagaaagaggtggtgataaatgtcaaactgcaaaacaagttaaatctagatcacagccgggcacagtgggtaacgcctgtaatcccagcactttgggaggcagaggcgggcagaccacttgaggtcaggagtttgagaccagcctggccaatatggcgaaaacccatctctactaaaaatataaaaaaattagccaggcatgatggcggacacctgtaatccttgctacttgggaggctgaggcaggagaatcccttgaacctgggaggcggagagtgcagtgagctgagattgcgccactgcactccagcctgggagacagagtgagactctgtctcggaaaaaaaaaaaaaaaatagaaatcactgtggtctacatggtttaaaatttataaaaatattaatatcaaaaataattcttggctgggtgaggtggctgacacctgtaatcccagcactttgggtggccgaggcgggcggatcacctgaggttgggagttcaagaccagcctgaccaacatggagaaaccccatctctactaaaaatacaaaattagccgggcgtagtggcacatgcctgtaatcccagctactcccgaggctgaggcaggagaattgttggaacccaggaggtggaggttgcagtgagctaagatcatgccattgcactccagcctgggcaagaagggtgaaactctatagaaacaaaaccaaaacaaaaattcgtatggcgagacaatgtaaaaaatgtaaaaatagtctaattcctagttagaaaatgaatagagaggaaaatatatactaaattacacatttacatagggtcaatggatactacttcatccttgacagtgataattaaagacaatgggtttaattatgattttttgaagtgtaaatgtaataaaagtagaattaaaggtttttaaaatattcaatataataaaatatagaaaaaagaaaagcaaaatagcataaaagtggaactcataaaataagatgacaatagtgaaaagttagacttctgtattaaaagcaaaaatttttgtactgtatcaaaaaattacacaagtttaattactatttaaaagatatccgaaataaatgaagctgaaaataaaagaagagaggtgtacaaaacatcctaggcaaaatgattttttaaaagcaagaatggcaataattcatatcgaaatagaattaaagaaactattattaaaaggccaaaggtggtaatttcatttgatgtaaagtacaatccacaatagatatgacctgttatgtgctaagtaacgcactaaaatacatacaatgaaaactgtgagagaagcagaaattactaaaaaaaacattttaatgttactactagtcttggatagatgaagtagacaaaaataaataatggtttggagtgtgtccaacagaaacagaatggaagctacacatttcattttaaattttctagtagcctcatttaaaaagtactaaaaagagggatgaaattaactttaatagtatttattttttatttaaccaaaaatatcatttcaatatgtaaccaatataaaaattattcctgggctattttgcttttttggcatacatcctcaaaacccagggtgcattttctttttttctctttcctttctttctttctttctttctttctttctttctttctttctttctttctttctttcttttctttctttctttccttccttccttctttcttttcttttctttcctttctttcttttttttttttttgagacagagtttcactcttgtcacccaggctggagtccaatggcgctatctcggctcactgcaacctccgcctcctgggttcaagtgattcccctatcagcctcctgagtagctgggattacaggtgcccgccaccatgcctggctaatgtttgtatttttagtagagatggggtttcaccatgttgaccaggctggacttgaactaacctcaggttatccgtccgtctcggtttcccaaagtgctgggattacaggtgtgagccaccgtgcctggccccgagtgtgcattttacacttatatctcagttcagactagttacatttcaaatgcttaatagccacagacagagaatggctactacgatgatcagtgcagatatagaggattcaaataatagaattaacagaaaagataacagaagtaagaagtgaactaaactttgtaacctaaaaacagaatacaggctgggcccagtggctcacacctgtaatcccagcactttgggaggccaaggcgggtagatcacgaagtcaagagatcgagaccatccttgccaacatggtgaaaccccatctctactaaaaatacaaaaattagtcgggcgtggtggcacacatctgtagtcccagccacatgggaggctgaggcaggagaatcgcttgaacctgagaggcggaggttgcagtgagccgagatcatgccactgcactccagcctggcgacagagcaagactccgtctcaaaaaaacaaacaaacaaaaaaacaacaacaaaagcagcatacaaactttacaaactaccaaggaaaatttataaatattgattaaacactgaattacaggaaaatcaataatttcttaaaaatttaaaattagaaatttttttttctttttttttttgagacagggtcttgccttgtcacccaggctggagtgcagtggcacaatcacggctcactgcagcctcaacctcccgggctcaagtgattcacccacctcagcctcccaagtagccgggactaaaggctcatgtctccctaatttatttatttatttattttgagatggagtctaacttatgtcacccaggctggagtgcagtggtgcgatctcggctcactgcaacctccgcctcccaggttcaagtgattctcctgcctcagcctcccaagtagctgggattaaaggtgcccacgaccatgcctagctaatttttgcatttttagtagagacgaggtttccccatgttagtcaggctggtctcaaactcctgacctcaagtgatccgcccgcctcggcctcccaaagtgctgggattacgggtgtaagccactgtgcccaaccaatttttaaaaattttttgtagagatagggtttcaccatgttgcccaggctagtcttgaactcctgggctcaagagatcctcctgcctcagctcctaaagtgctgcaggcatgagccatcgtgtttggcctagaaagatcttattttattaccacagtgaaataaaaccagaacttgatattaaaaagagtaaacaaacccctctacacttaaacattaaaaacacatactcctacatatattatgagtcaaagagaaactcaaaaattataattaccacttaggagaaaacagcctatataaaatgttacaagatatgaccagcatcatggagtgacaaattcatagacttaaatattttcgatgttaaataagaaagaacataagtaaatgcaataaacaccaaactcaagaagtcagaacagaacaataaaacaagtctatggggaaaaggaggaaggaaacaataaagataaaagcagaaattagtgtatcagaacaatggttttctaacagtgctctctggattcacaagcctctgataagaaagaaaaagagtgggaaattcccttctcctcactcccctttgatttaatcacaagtgcttggcttttatatgccaggatttcacatacggttttattttttttaaagagttccattgtacaacttagtgggtaaaaatcataagccttaaaaatagcggggaaaggccaggtgcagtggctcacgcctgtaatcccaacactttaggaggcccaggcaggcaaactgcttgagcccaggggttcgagaccagcgtgggcaacatgatgaaactccacagaaaaatacaaaaattagccaggcatggtggcgcatgtctgtagtcccagctactttgaaggctgaggcaagaggattgcttgagcccaggagatgaaggcttcagtgagctgagatcatgccactgcattccagcatgggcaacagagtgagactttgtctccaaaaaaaaaaaaggcaggggaggaatatataaatgctacataagtgtaagtgtaagagctggaatttttcagaggggggggaatccagtaaatgataaaccattagtaaatgcaatcaagaagaaggagagaaagcacaaatatacaaaaattaggcagagtaaaaaggagcaaaaacaaaatttttagaaagatcatgaaatactttacaaaagtggtaagagttcaagtgcttttaatttctttctttgtacttttatatataatttaagttttgtgataacaagaatcattttatctctttaaaaagatattttgaaaaataaagtgccatgtaaacaaaataaaacaccaggcaaataaatttgaaaatctcaatgaaaagttgctgagaaaaatataaatttctaaaactaaattgagaaatgaaaaacctgaattctgaataagctaataagcagggggaaagaaagttgccgaaatgttttttatttattaagttcaagtttagatagttttatacatgtctttcaaacctttgagtaataaataattctcattctatataaactatcccagagcatacaaaaagaggaaaagttcaaatatttggtaaaagctaccataaccctagttctaaaagcacagaaagcaatcagtttaaggttagtagagagacaaaagtcctatataaaatactagtaaatcaaacttagtaatacattaaaatattaatgtaaagcttatattgggaatgtaaagatgtttcaatactattgtttcattgtatatttctttaataggttaaaaaatctaaaaaatttcctgataaatggcaaaaatgtcatctaatggtatttatatctactagtgacaaaactgtagtaaaacagaagtattccccaatgccaaaactttatgactaagatactaaggaaagaaactgtagaccaatatacaatacatttgcccttcaatttagaaaatggtgctactcacagtgaatgtgatctgcaggtgcctgagcaacttcactgctgtacttcactactcactactgaacagcaaagagacttaacaagttccctcgataggtcacctctctatttaaccaagctccccatcaacctgatgggttttccactaagtgaccaacctttttaaaataaaatctttcctaacatatacatcagatcatgtcacatcaggataggctgagctacctatggggtagatactgctgttccattttctgggtaaagaaacttgctcccaggttacacacctagcaagtggtgcaaccaagatagtcttaccataagatccagcagtcatactcttaagtatttatccaattaagctaaaaatttatgtccacacaaaaatctgcaagtgaatgttcataacacattttctcataattgccaaagagtggaagcaaccaaaatgtccctcaataggtgaatagataaacaaactgtgacacctccataccctggaatattattcagcattaaaaagaactctcagctgggtatggtggctcacgcctacaatcccagcactttgggaggccgaggcgggcaaatcacttgtgcccaggagttcaagaccagcctgggcatcatggtgaaaccctgtctctaccaaaaatacaaaaaagaattagctgggcatggtggcacgtacctgtagtcccagctactagggaggctgaggtggaagaattgcttgaacagggaggcataggttgcagtgagccgagattgtgccactgcactccagcctgggtgatagagcaagatcctgtctcaaaaaaaaaaaaaaaaaaaggaatgaactctcaagctagaaaaagatagagttcaggagtgggcgagggataaacaggtaaggcataagggatttttagggtagtgaaattataccgtatcatactataatggcagatacatgacatcatgcatttgttgaaacctatagaactttaaaacacagagtgagccttaatgcctgcaaatttcaagaagtcatttaggaggttaggagatttcaagaaagaatgtaaactgtaacaacgtaatctaactgtattacaaatctaagaaataaattcactgaaggggaaagggaaaaggcgctgacctaagtagctttggaaatgagcagaatttgcaagactacaggcaaaaggaactgaacataaacactgaactctagtcaataaagttgtttgccatgggtgtatgggttaacaattcttataccgctatacatgtttactgtaattgaacaattaagtaaatggatgatgaatggtgggtgccaggtttctcactgttggagtggaaaggaggggaaaaggtagcaagaatagcaaggcgaagagtctagaatgatccatgtggtaatgaattagaattggagacatcagtaagagcccatgtttcactttacacagatacagttggttatatatagaaacatataaatcaggttattattaatacatacacgtgtatttccttgctttgtcagctaagaggacctaaaagaaatgacatcacagtaacaaggagcatacctagcacaaacatcttgatttctagtaccaatcttcaataaaaggaacctaggctccttagaaaatggctgattctaggactggggaaggaaatatataagatgagcctaaaggatcttgtagtgtcagaaagtaaggaagtgctgaaaacacacacacacacaagcacacagacactgatgggacatgtcaaaaggggcgcaggaggtcgggcgtagtggctcacatctgtaatcacagcactttgggaggccaaggtgggcggatcacttgaggtgaggagtttgaaaccagcttggccaacatggtgaaacctggtctctactaaaaatacaaaaattagtggggtgtggtggcaggcacctgtaatcccagctacttgggaggctgaggcacaagaatcgcttgaacccaggaggtggaggttgcagtgagccaagatcacaccactgcactttagcctgggtgacagagcgacagagcgagactccatttcaaaaaaaaaaaaaaaaaaaaaaagaaaggggcacaggaaccaactgaaagagctcccagtggccaaaactggaacaatttccacaacaaaataaagtaatattggattataacccaaagtataaaataagtatgcacgattccatacttatatcaataaatggttgaatagataaataagtgaggccgggcacggtggcttgtgcctgtaatcccagtactttgggaagctgagacgggcagatcacttgaggtcaggagtttgagaccagtctggccaacatggcgaaaccccatctctaccaaaaatacaaaaattcactgggtgtgctggtgcctacctgtaatcccagatactcgagaggctgaggcaggagaattgtttgaacccagaggcagaggttgcagtgagccgacatcacgccactgcacaccagcctgggtggtagagccagattccatctcaaataaataaataaataaataaataaataaataaataaatgggagacaagagatgaatctccagtgcagaagaatttcaaataatttatgtactactccactctaaagtgggggagcataactcccactccttaagtgtggggtgcacatagcaactgtcttccaaagagtatggaaaggatgaataagaagtcaccttacaatagagaaacctgacaaacatcatatcagccaggtgatcaaagtcaacattaacagtcataatcatgctgatagcacgtacacttgacatgatgggacgaaaatagcacttttcctctgtgatcttcctcctcaaaacccataaccctagtctagttatgagaaaaagaccagacaaattttaatataggggcattctacaatatacctcaccagtactcctcaaaactgtcaaggtcctcaaaaacaagaaaggtctgggaaactgttacagcaagaggcgcccaaggagcctaaactaaacgaggtatcctggatgggatcctggaacagtaaaagaacattaggcaaaaactaaagaaaactgaatgaaatgtggattttagttaagaatgtatctgttctggttcattaagtgtaacagaagtacaatactaatctgaaatgctcacaataagggaaactggaggagaaaggaggaataggggaactctgtactatctgcttaatttttctataaatctgaaactgttctaaaaatataaagcctattaatttaaaaagtggcatatggtataatcttaatgttttgcaaataaaaaaaagatagggttcaattcattcattaacctgatctttactgagtccttcctttgtgccagtcaggcactgtgataaataacagaacattaacaatggccatctctgggtagtgaattgctgccattttcatcatcttctttatattctctatatttctaaatgttctaaatatatgtgttttggaatcagaaaaaaataagtaaaataatcattatgcaagcatgaggtaatattactcacaaattggatagactttaatttttggtcctcatcttcatttcactcagtagtagtgcgatcagctcaagtcgttgtgaaaaaggaaaggaagccccctggtcagagatcaaatggggaataaagaagatcctacaggaggtggagtgttaaagtatatactttattcctgtagatgattaatactatacctatatataattttgaacatcaactcttcttactaaattcattttcctccagctttcttgagtaataactgacaaatatccttactaaattataagtaaaatagcctatgtaattatagttgtgcatactaaaattgttaaaaaataattaacatgatataattatcccccaatgatgtcactaaggacaagctgtttttattatgattttacttttcaagtttgctccatattaatttttaaaagacttcctttcaaaacactttaggaggtcacatgttaatttaagtacttgtttctttacctgcactactcaggggaataaaagttcacaaagataacttcttccatctgtctcatccagctttttaaaaaaatctgctctaaaaatacgcccacacacttactagatgaataagcatataaccaaaaaaaaaaaccataaagaagtaaaaagcaaggtctacatgagagatcatatctctagtattatatgtgctttccaattcattttatgaagccagtataactctgataccaaaacttgatgaagacctaggaaaggaaacttcagaccagtatataaaacatttgcttttcagggctgggcgcagtagctcacgcctgtaatcccagcactttgggaggctgaggtgggtggatctcctgaggtcaggagtttgagaccagcctgaccaacatggagaaaccctgtctccactaaaaatacaaaattagccaggcatggtggcacatgcctgtaatcccagctaccagaaaggctaaggcaggagaactgcttgaacctgggaggtggaggttgcagtaagccaagatcgtgccattgcactccagcctaggcaataagagcaaaactccgtctcaaaaaaaaaatatatatatatatatatatttgctcttcaatgtaaaagatgatgccactcacagtgattacaacccataacccaaagaggcccctcagaacacactactcaccactgaacagggaagagattttaaaagatctctcaatatattacctcctttatttaaccaaggtcattattctatctggtgggttttctatgaagtgatcaaccttttacaaacaagagctcttctaatataaacatcatgtgcagtcacatctgaatgccttgagcttcctgtaagtgtaacacccagtgtgaaaagcaccactaactgcataagaacatcccccagatgcttctaacatcgcagcattcactctatgtaggacctgatgctacagagtcttcccacagttacctttaactagggagtgaacaataccgcatggtgtaaatgtcctcagaccaaagagaaaaggcaaaaatcaaaaacaaccataaacaatgctacattgtctaaatgcatttattcttcaagaaatatttgttgaatgcttatcacaggctaagcacaaaaagtaaacgaaatagatctaatctctaccttaactaagagtttacagtctagcaaagaatatagacttaaatagacaatcagaataaattgtgacaacaaaggaagttatgggtgtacaggcccatagtagaggcacctagtctcgaggggaaggtaaatcacggaaggcctctcagagaactcatctttcacctgaaacccccaaaattagcaggccaagaatgtgtactgggggaaaggtgggaagttggtgagatgaggaaaagaatggcccaggcatgggaacatcatatgcagaggtccagaggtgagagatcacagtttagttggagagacaaaaaatttcaaattggagggcagaacacagaggtcaggagaagggtggtgaaagattaatatggagggcaagcttgtagcaatatacagtattttatactaaaagtaatacaaaatcatttgaagtcgcatatttaaaacttaaacacagctctgacaaaaatgcatctttctgttataattcatagctgccctaaaacgaaaattctctcagcttccaggtagcttataggtatctatgtcagcaagtcagggtaggaaaagcaaacaggaaaagatgactgaaggacaagggaaaagagggtatttgcaacactagaggcatgatatgattatcacaccccagcgaaaaactgctgtagaatttgaaggccagctgaaaagattctgagttggcaagatgcacccaagagcactaggttttgtagactggtgaaagtttcttacattctcccaaattctctcatcttgtacattcacaaagctgctcttctgtttatttagaggagaatgacatcttatgggtcatatttttcaaactactaaaagattaaggttgcctcctgttttctaagtaatgctcctagtacactaaaagcaaaaaatatttgtctgtgttccctaacagttgcaagggtttttgttgatatatgtttctaaaactcaaaagttcacttcaatcaaccttttatttggaggcaggatgaatggccaaatgctgttgaaaacaactccaccgaccaaataccaatcaaagtgttcctagaggggaaatttcgtaaaagtatttgaactactaaagcagaactcacatttccaaaaagaaaaatggcataaatttctgcctattctagcattacactcaagaaaatacttgaggtttttgtctatggggaaaagggttagcaccaccctttggcaaaaaaaaattaaaaaataaaaaaaagtctcaagtactggcaaatactcttcacatgtgaatgcttgtcctcactgggcataattacagaaatgtccattctctctctttgttggtgattttattctcgttttacttcatcagccccctgcatacttctgccatcatccctcgtcccatcccctaacccctctcctcttttcatagccctctaagcctgttggttggcagtcacactctcaacagaaagatagagttggaggtgggagtgcaggagagggaaagaagggagagacataagaagaaattctgttctcccttccctttcggcccttccactggttctcacctcctccctacgtggggccccattcctgccctcattctgtccccttagatggtctcttccctaatcctcagaacccgaacctggctcccatcagctcctcactcctgcccagccctgctcaatggagtcattccccagtcacaagtaccagcatcagagagcttggagttggagaggagggggataaagagtgcactcccccaactaacaagaggaagcaagtagaagggggagatattcagcagagaaggagttttcagaagcccaagttggaaggtgagcccccatcaaaatattgtctatagtcctcttctctaggtataatacttgaaaagtagtttttaaaaaataggttggcctgcaaatcagcctaaaaacacggtcctttttcccataaaaacattgcttctataagaaaatatctaagtgaacattggaaaataatctatgtattgacttttaaaaaattgtaggagcaggatgctatttcagcctcatcttctcttaaattttcaatgatacctgtatttttttttctagttataaggaaaatgtttcctttatcttgcagacacttcactctgaatactttgaagcagttaaaacctaaaagaccagacatcacccctcccagttggagatgggaccctgggtggaaaagggtagagggatagaaaaggtttgttgggtttgtggaggagaagaggaaaggagaacaagcaaaggagggactcccaggggtccatcccagggctctccttgtactggtggtggtgggcagggactaaaaatctgtttgtgttatccccaggacttccatgagtgaactactaacagtaagacaatctttccaaaaataatgggctatgcctaaccaccttgtcatgtctagccaaccatgcctgccacaccaaaacaatctccaccttggaaacagtagaaaaccatatttcattctagggtatctgagtattctatacatttaattaaatgtcacaagtatctcgttaagttacatattgctattttatggaagaaagcaacctagttggtaatcccacttgtataaagtctcattgacagcttctggtagaaacaaaaataataattcccaattccctgtcacaggtacactgaagttatcagaccattaggatttctgcagtcactcttaaatatatcactaaaatcaaacctctaagactttagtgtttaattttcctgtcctattaattgaaaccttcatggaaaccttcactattttcacatcaattacataaaagtaccatagtggggaaaaatgactttcagtttgtctagaacatgttttaaacttacctaaaacttttgatctgaaaaatgtcatcattaaggcatatactttttaccttttgccaagaaggaaaacgtgttggcaggctaaaatcaaaccttatacctaccagctttgttttggtttgcaggaagttgtcagcattacaatagaaaagtcgtgggcatgttctggttgtggctaggttcgacctgctaactgtgtttgccccatgacctaagaaatgtgcagtgtttgtatttttaattttccttctacctcctgtagaggaaaaatgaaaatacctatatactcacaacacagagaaaacaaaaaccagaaactaaaacaatgagagtactttagatcaagttttaactagcagctagcctagaaatccaggattaacacttttgcaatctttatttgagagtttaagaatatattctatagaaacatctgcatatggccaggtgcagtggctaacgcctgtaatcccagcactttgggaagccgaggcaggaggattacctgaggtcaggagttcaagaccagcctgggcaacatgatgaaaccctgtctctactaaaaatacaaaaattagctgggcgtggtggcacatgcctgtaatcccagctactcaggaggtggaggtgtgagaatcacttgaacccaggaggcagaggttgcagtgagctgagattgtgccatttcactacagcctgagtgacagagcgagacttcgtctcaaaaaaaaaaaaaaaaagaaaaagaaaattctgcatatgtacactaagatacacagataaagatgttttctacagcagtgtggatatataaaatatttggaaacaccttaaacatccatcaataggacaattgctaaataaattgttaaatactatgtagcagtttaaatatatatacacatagatagatggatagattgatttgcatgaaaaagtctccaacactgctatggtaaaaaaaaacaacaacaacaataaaaacaaaccagggtgggtgcagtgcctcacacccgtaatcccagcatttggggagagaaaggattgcttgagctcagcagtttaagaccagactggacaatacagcaagactctcgtctctactaaaaataaaaataattagctgggcatggtggcatgcacctgttgtcccaactattcaggaggctgaggtgggagagtcacttgagcctggaagattaaggctgcagtgagccgtaatcgtgccactgcgctccagcctggacaacagaatgagaacttgtctctaaaaaaccccaagaaacaaacaaccaccccaccaaatattctatatacttctatgttgtgcaaatattttacaataaaaatatatctatcaattattttcataatttaaaaaatgcatgggccatgacatcaaccagaatgtctaaaaataaaaagactgcaataccaaatgttggtaaggatatggagcaacaggaactcccatatactgcttgtggaagtggaaaatgggtataatcacttaagaaaagtatttggagtttaacatacaactaccctatgacctagtaattccactcctagatatatttatccaagataaatgagtgcttatgttcacaaaacaagttatacaagaatgctcatagcagctgtattcatgatagccaaaaactgaaaacaattcattgtttatcagcataagaatggataaacaaattgtggaatattcacacaatggaatactatttagcaaaaaggaacaaaccaatacacacaataacatggatacatttcaaaaatacagtgtggacaacagatacaaaaaagtacatactgattgcattatgatagaagtcagaacagttattagctctgggagggaatactgactggaaaggaaactttctagggggatggaaggtggtgtgggtgtatattgataaggtatcttgatctggggagtggtcacataggtgtctatatatgcttaagtcaaccaattttaacacttaagataaatggtatgtaagtcatacctaaagtgctaagaagaaagggagaaaaatggatggaagggagggaggaagagaggaagaaaagaagagagagggagggagagagggagaaagaaacattaggctgttgcaaaagtaattgcagattttgccatttaaaagtaatggcaaaaacctcaatttttgcatcaacctaatagatggatgaatggataaaagggctcatacaaaaagttatgagaaagaaaagaatttggggcttttttttttttccaaaacagtgtcttgctctgccaccccaggctggagtgcagtggtgctatcttggctcactgcaacctccaactcccgggttcaagcaattatcatgcctcagcctccagagtagctgggattacaggcatgcgccaccacacccagctaatttttgtttttactagagacgaggtttcaccatgttggtcaggctggtctcgaactcctgacctcaggtgatccacccgcctcagcctcccaaagtgctgggattacaggcgtgagccaccatgcccggccagaaaagttatttttaaaggagtgtagtttaagaaggtttactaaaatgcagtgaatagatgttttctgtagctacctatgcaccccagcctacttctcatactagatttataatatatagtaccttaattaattccagctactacaatattggtttaactaagcacaaatatgtgccattggatatattttagtaaagcgtctattatttgaataaaaattttattttcccataacatactcatattagaatgtcaacaatgttaggaggagaccctaaatgagaattcaaataattcacaaatgattttattagagtcagcagccttgaggaagacttgctatctggatggtaagaccactctattcctgagctcagatctgtcctatcttccatgtaaatgctggatactaaaattaagcagtggaactcaaagactccaaacctgaaaatccatctgttataatcacctaacctataatgcagcactgacaaactggaaagcaagcaatgaactcggaaacacaggggaaacaaatatgaataaatgtagcagaaattataggatttctgtagggtgtaatggcttataacatgaaaaaattagatctatgatagttaggtcaatatgttaagattctcagatggtggtaaaacttgatacttaccttatttttcctatatttaaaatgattaaaaactgtttaagtattatacttatgaaattaggtaaaaatattatcttaataactggtactacagttcctcttagggaaagaactgtcattgtttgggaaaataacttgttttgctgtgtgtcactattggtgggaacctaaacaactatacagatagttaaactgccttttcatgtggcagggaaaaaaatatatgtattttttactttagataggataaagaaagaaagtgacaatgagaaggcataaggctgggaactaaatcaagtgaaagaatagaggatataccctgataactggggtggcagaagggtatttaggaataggaatgcctaatgctcaaatcatttgcatgactgtaatgtaaacccttcctccccatcctggcaccccctgattctccagggatgttttctatactcatagggacttcatgtgaataggcttttgtggaaattgagaaggaaaacatgtctaggccagggcttctcaacctcagcactattgacaattcgggctggatgattctttactgtggagggagtgtcctgtgcattgtaggaagtttagcagcatccttagcttctacccactagatgccaggagcaccctcccgagctgtaacaaccaaaacgtctccagatgttgccaaaagcccccagggtcaaaatcacccctgttggcaaccactggtttgggcctacacaacccaggacagacagcatgcatagcagcagggaagcctggagggaaagctgaccttgacaaggcatgctctttgagaatcaccctgatcctgaggagagctgtgaacttccatggggagcagctcttacctagagttcaaaagacctaggcagtccatctaacactagacgataatcagaatgaagttcaaatatctctaccacgtttttttaaattttagcaaacaaaagggaggagaatagacctttttttaaaaactgggaattaatgcaaaatactagttttacacacacaaaatagagtgttcttttttttttttttttttttttaaagacgaattttgctctgtcacccaggctggagtgcaacggcacgaggcgggaggctcactgcaacctctgcctcccaggttcaagtgattctcccgcctcagcctcctgagtagctgggattacaggcgcctgccaccatacctggataattttttgtatttttagtagagacggggtttcaccatcttggccaggctggtctcgaactcctaacttcaggtgatctacccaccttggcctcccgaagtgctgggattacaggtgtaagccaccatgcccagccacaaaacagggtattctataacaaggcaaggaacacttatctttcctgatatgctcagtcatacacaaacagactaggtaaagcttcaagtgccatctcagagaatccttttgtgacaaaacaaaatttcaactgaaacatcagggtagaaaaattatatgcctgggaatctataagaatatagaaaactcagagaactgcaggctaggtgacaacaaaagcaatgaagctaattttctctccttcctccataaagtttctcatcaaaatgatcactagactctgaaggaaagaaatggagattttgaaagaatccctaaaagtcgggctgggagcggtggctcacacctgtaatctcagcactttgggaggctgaggcgggcagatcacgaggccaagagatcgagaccatcctggccaacaaggtgaaaccccatctctactgaaaatacaaaaattagctgggcttggtggtgtgcacctgtagtcccagctactcgggagggtgaggcaggagaatcgctcgaacccaggaggcagaggttgcagtaagccaagattgcaccactgcactccagcctggtgacagagtgagactccatctcaaaacaaacaaaaagcctcccataatggagaagaaggataaaaacagggatgggccaccaatataagcaaaagaccatgactgggagttttactgtggaaaggcagctgccaaaacaaacaaacaaaagaggtcagctggataactcaagtgaaaaaaaatttaattttatttatcagacatttatatggtgtttagtacataccagatactgttctaaattcttttcaaatattcattcctttattcttcatataaattctgtaagataggtaccactattatctcaatactacagataggtaccattattatctcaatattacagatcaagaaactgagacccatggtccatttagtgagtaaatggtagtaagaaagtggaagagttagaatttgaatctaggcaaattgcacacagagaaaatatacaggacctatgagaaaacattaatgttcaaaaagaaaagatcacctgaagaactaaagacaatgcctccttctgaagcagatttattattaaagaacagaaatgtttagaaaatttctaattctcggcaacatccaaaaagtcattaaatgtacaaatcagcactttatagacgtaatgaaaatgagacaatgaatgatgaggaaagaatacatggcaactttttaaaaaataaataaatgttgaatttaaaaccataatgaaagcaatgacagatgagacagtaaaaaagatgaaacagagagagcatatcaggagtccaatatatgtatgctataaacccaagtatgacagaataaaacagatggagcagaagcataatagaagaaaactttcccaactcaaagggagaccagagtccatagatcaagcaggttcactacataccaggcaaaattattaaaaggccttcctggcatgctattgaacaacaacaacaaaaagtattaaaaagtctaagtaagaccttgatactaactagtgacatttttgagagcaaagaaaaatattctatactaccccagctgagaggagtggattataaatgaaatataccaggctggcatcacacttctccttcacaaaactgaaggccaaaaaataatggcacaatttttagaggcttagttgaggggaggttgaaggaaggggaaaagtgtgaccccagaacttcatgcccacagctaagtttatatgaaataagggagacacattctcagacatacagaggcttagtaagcctattatcaaagtacccttcctgagaaattcactcagcattatattctagatcatcaactaccaggactttacacactgtccagtacagtagccactgtggctactaagcagctgaaatgtcgctagcacaactgaggaaccaactttttttttgtatttaatttaattaataatttaaattgaaatagccacatgtggctagtgactattatggtcaacagcacagtgttaatatctaagagataaaatagcgttcaaggatgaaaaattcatggtaccaaaagtaagaaatgaacaagttaagcagggaaaacattcttgtttgtttgttttctgagacaggatctcactacattacccaggctggggtgcagtggtgcaatctcacctcactgcagcctcaaccttctgggctcaagtgatcctcccacctccgcctctcaaagggttgggattataggcatgagccaccacgcctggcccgatttttattttaagacattagggtaaaactatttgtggaataaaaatagggtatataacttgaaggcaaaaaaaaactcacttaacgattgtcttattccatttgagctgctataacaaaatactacaaactaggtagcttataaacaacataaatttatttctcaagtgggaaactggaaagtccagatcaacggcagattcagtctctgctgagggcctgctttttggttcatagatagcaccttttaactgtgtcctcacatagtggaaggagtaaggcagttttctgggacctctttttttttttttttttttttgagaacggagtctcgctctgtcacccaggctggagtgcagtggcgcgatctcagctcactgcaagctctccctcccgggttcacaccattctcctgcctcagcctcccgagtagctgggactacaggcgcccgccaccacgcccagctaattttttgtatttttagtacagacggggtttcaccgtgttagccaggatggtctcaatctcctgaccttgtgatccgcccacctcagcctcccaaagtgctgggattacaggcgtgagccaccgcgcccggccctctgggacctcttttataagggcattaatcacctcccatcacatttgtaattagatttcaacataaaaattttggcaaatcacaaacatccagagcatagccgtgatctaagaaaaccctcaggaaaggccaggcacggtggctcatgcctgtaatgccagcactttgggaggccgaggcaggcggatcacgaggtcaagagatcaagaccattctggccaacatgctgaaaccccgtgtctattaaaaatacaaaattagctgggtgtggtggcgtgggcctgtagtcccagctactcagaaggctgaggcaggagaatcactggaacctgggatgcggaggttgcagtgagctgagatcactccactgtactccaaactggagacagagtgagactctgtctcaaaaaaaaaaaaaagaaaaagaaaaagaaaatgaaaaccctcagtaaggccaggcggggtgactcatgcctgtaatcccagcactttgggaggctgaggcaggcagatcatgaggtcaggagttcgagaccagcctggccaacatagtgaaaccctgtctctactaaaaatataaaaattagcctgtcatggtggcgtgcgccagtattcccagctactcaggaggctgaggcagaagaattgctcgaacctgggaggcgggggttgtggtgagccaagattgtgccactgcactccagcctgggcaacagagtgagactccatctcaaaaagaaacgaaaaccctcaggagacaataacaagtgaaaaattataagtagaaaaatcaatagacaaacctgtgcacaaatatgtcccaacttttaaagtatatccatataatgaacactgagaaaaatacatggaaatttaacaattattgattctgagtaactgtatcctattgtgtgttttctaaattttctataattagcattattacttttataatcagaaaattttaacataaaaaaggaatagaactatagttatatctcacttttcagaattcaactgagcagtagcctcactgatctgcaagacaatccagtttcaaaaattaagcaaaaaagattctgagcagccaaaatacatcttacaaagcccacacttaaaggtgtgggtactttgttcatcaagaaagctctttgtaacttcttttacatatatctcaattccaactaacgtggttatctgatgtaccagaagcactgggaatgtagacacacagacaagggtgcaaagtgataggccttggcctaacagcaagaaaaaaataatgaaaataaaaatataaagcagacacagacacttacaaagcagttcaggggcaactatggccaaacatcctaaacaatatattaccataaagtatggtaatagatattcactataacaactttgagttaaagagtgctctaaagaggttcatttgaagatagccgtagactggttggctaaagaagaaaaattcctaatgcattttaggaaaaacctgatcacaaatatttataagaagaagaaaagagtgcttaaagagaatctcctcagctatccagagcaactcatttctgcaagttccccacagttggaattttactatactgaaacggattttatgattgactgcattgactaatacagatctggagaacaatctggaaggaaatgattaatgactgcttctttacaaggaagtttaaaaataaataactataggcatatcagaatcagcattaacacagcaattgctactacatgcagccaggttgttaatgttattttggcttaaatccatattctgggcaggatttagtaccatgtaggcagttgggacctatcagctaccagggtaatgtcagtaggccccattccatcacacaggacaaactacgaaccaaagaaatatctattccacctccttcatacttgtctcttttgcttctgacttcaaaagcagggctagaaagaccaggaagaagagactgattatgtttatatctgtggagcaaagattatgcaaactgccagcacttcattgtttttgttttcggtgtggttatcacagaacaaaaacaaaaagataacttctacatctgaagccccattatttgaaaacagacctgaatatttcctcctctttcaataaagcagaaagcaccctccattttacttatctatgaggtatttatttgttgataggggactagttactatttctatatgagagcttgacagagtctatctaaagaagctatttcctgagttactctagaaacctcacactgttttgatatttgccaaaaatccaagatagcgtgttttttttttttaatttctccaccttccatacccctcagggctaaaaagagaaaaacatgatcacaagcatagtaaatggtccgttagcactctgacctctctgagtttctatttgtcttttgttcctttttcttttaaatacccttactgtttattttttcctgtttacagaagtaatgcatggtcattgtcacaattcaaacaacacaaagatgtatgaaataaaaattaataacctcccctcctccaaactctcagtcttctctcaaggaagccaatgttaacagtctggtatatattcttttttacttattcctaggcttacacaaatatttataacatatgtggcttttcttgttttgtcttttggttttcaagcaaaaatgggatattacatgtactatcatgcattttgccttttagtcttaaaaatatgccatggacactttccaagcctatatatagatccacagaatactcttttagtggctgtgaagtattccatgagacaaatgtcccataattcattcaaccatcaccctgagtctcccaacttattaacatttagcatagatcttcgtgcatatactacttcatgacctttcacttcagtgacagatttttagaagtgaggtttctaggtcgagtgaaacatttccaagtgtctcaaattttatatttaaacaaaattaattttaggccttgggaatttctgttctcttcattatgcaaaattttgttatctacctttcacaatgctttacatattttattcttaaaagcacacacattatgtcaaaaaatgcccctgtcatttatgcttgtgtagttataaataaataaatgcttaagttatggctgtgatgtccagtgttaaatcactgtgcaaatgcttatgccttggtttatgaaagtagtaattcattgtggaaaccccacccccacagccatgtggcagcactagagttgcagccctcacatcctgtgactccctcccacagagtgactatatagagatcaggacctccattttttctaattgtcaacagttaaccttaaaaagtgtgtggtgggggagacaaatagcaacaaacaacaaattgatggccattttgggtttctaatatggacagattatttgtaacacaatgaataatcctcctggtctacaccagcgactgtgttccaaaagaaataaaacttgtaaccaatatattgctattattattacaggaacctttaaaaaacatatcttcaaacatttttcaatagaattactggatgaatcacactttacatttttttctctacttcagattcaagttctaattgcaaacttaaaaaaaaaagccttaaagaaatacattaaccaacgaagctccttataatttggtttcagactcctccatatattttaaagacctgagcaccaacagagattgttaagatacagcaagcttgatacagaagtatgcgacatgcaattaatctccattcataccccgctctacttgtcagcaaacaaaggttctgctttagaaggagatctgaagacttcaattaaaaacagtcagctaacaagaaaataatctaagctaaaggaaggtggcaggtgcagaaatgagttgtttaccaaagtgtcagttttgaacaatgaagaactgcacatcaaaaatgctgaaggaatggatttcattgcaagcctctgaaaataaaaaggaattttctaccaagcctagacacaaaactgaagtatagtttaataagcttataaaataggtttcctctcatcaaatgacagataccaataaaaagaatcagtttatatatttcaatgcaagggcagagttaaactttttgccacagtcccttctttcctagaaaccaaagacaattacagccttccttcacaagcctaatattaaaccaacaacagagggaaaggctggattgtttcttcttagacacccagataattctcttttaccctgcaaatagttttctacccccaaaatttagatttattctgatcgtaagtaaaacggattttggaaacctcacctcaaaagaaatatctagctgacagcttttacatagaagcaatccagaatggaaatagtgctacagacagagaccaaaaggacttgccaaatatttgattaggaggcatttataccgagataacaaggtaatggagatataaaaccaattaaattgagagaaactgaaaaaaaatactgcttgccaaaaatatgacctgcccaaagcaggccgtctgttaaatatgtgtcaactatgtcaacttagatgccaaaaggcttaattctgaatagtttcctcctgggagccttatgcgactgcagattccaggcctctgtcctccctggaaggttagttacaggaaagcaagtaaaagtgacttccaccacgaaacccagcagatgaaactgcccgttagcaacgtctctttgtgacatctctttggagtgttggcagtgtgtgttgagtgttgacggggatggccggaactctttaaaccaccgcttagacactgtagttggaaggtgaacacaccacaatgggagttggaaggtgaacacaccacaatgggggcacttctagaaaaggaggaaatcccatactgagaatgagcctgccttggggtgggtgagacccctagacgtctgcagggtgataaagggagggctggggttttcgcactgacaaaaactcacgtcaaccacctggccttggcccatggggatcccatgagcccctcgcagccccctggagagcctcggggacctctaagcaggaaggtttggggtcttctgtgagaggtgaggaagtcgtggctggggaaggagggggacgggaaaccctacagatgtagggcagtcctttggagaaagggacaggtcggagaccaggcaaggtggcatgggggaccaagaacctggcctgaggactttagaagccggggaggtgaagtggaggcgtggaggtgcctcaaggcaaaagaagatgtgggactccagggagtgaaaggggccctgaggtgagaggatggaaagctggctctagggagttgagggctctagaagccttaaggttctagaaggaggtgagtgacgaagccgtaaagaaagcctggccgtgggaggcctggtgtcccctttcggccttcggctcagcactggagggggcctgcgccagggcgttaccttccaggagccaacggatctcctcagggagggcggcggcctgcatttggctgggcgggagagaggcgggacggggcgcgggccctggtcgggaggcggacgggctggaaggcgacccggctgcaccgcgaggcacctgtacctcagccgcggtcgccgcccgcccagcccggccgcggggcggggccgtgggtccccgggcgcgtcaggaagtggcgcgggcggcaggcggggaccggaacggggcgcggggcgtgggtgcacgtggcgctcacgccggagccccacggtagaaggattgggggtgccggaagcaccgcaccgtgcgaggccaaaggtgcgcccctccagcacccaccaaaacaaaagacttcacaaggctcaaaggacccacggctttggacactccatcctaagcaccgaacagttgacctcacggtggcagatttgaaagaccacggggtgcctgaagtagggtgcagggaggcagaatccaaggaagagatccccgtcaagcatagcacccctcaattgccggtccagttcacatctccatccccagaaaagagggcaaaacttcgctctttgggaagccacaatgttgaaaggaaatgattaattcccaataagcaatataaggacaccaacatttgggagaatcgcggcagcgtggcagcaagggacacaggaaaccaaactgtgctgttctccctcaggatggaaaggccctgaggaaaggaaggggtaacacagggagaaagctgagggagaggagaacagagccctttccctccaggagctgcggaagggaggaaagtgaaggacaaaatcacacggtctcattcaagggacagttggtgtcagtgtcctggttgtgacatggtactgtaatagtgccagatgttacccttgggggaaactgggtaaaggtagacagagttcctctattatttctgaaactctctgtgaatctataattctcaaaataaagaggttttttaagtacaataggtcaactgccatgaaaaaagtataaagtgctatggttgataaaagaagggagctgaataccagaaaaggagggaagaggccaggcattgtggctcacacctgtaatcacagcactttgggaggctgaagcaggaggatcacttgagcccaggaatctgaggttacagccaactatgatcaccccagtgtaccccagcctgggcaacagagcaagaccctgtctcttaaaaaagaaagaaaataaaaagaagtgccagtgtgcatgtgagtgtttaaaggtgcatgtggtgtttgagatgggctctgaaaaacacaccagactttgaaggggcagaggactttccaggtggaaggaccagagtaaagaaagatggaagagccctcaccagcttgaggaatagttagtagccctcttttactggatgttgtagaaagactatggttgtcaagataaactgcagctctactgtgaagggacttgaaagtcagaataggaatgttgaacttaattgagagggcactggggagccattgacaatttttgagattgggaatgacctaaccagagctccggggtggtatgtggcctcacacatctccacctctgcctttttccttctttgtaaaaaatggcatttctattctcagactcaacctacagaatatgtagaaaagattaggagtggtgggaaaagacacagggggaagtgggtaaaatggtttttacaacagccataaggggaataatgatggactcaatctagcagacggggcaagagcagtaagaagaaaccatcgagaaggatgagtgtgataaaagtgcctgcctccttgtactgtttcccatccagagatacagcctcaaagatgagggtgtgatcctttaaggagtacagtgcatcctgccatctgaaaagcagtggtgcattggtttcagtgtcacatgacccacctacaagctgcagtaaattggggtgaggggacagaggctggcatgagcctctctggggtatctggctcctgctcatcctccttcctgccctgagaaagtatagtaatgggtggctgggcacagtggctcacgcctataatcccagcactttgggaggccaaggcaggcggatcacgaggtcaggagtttgaggtcagcctgaccaatatagtgaaaccccgtctctactaataatacaaaaattagctgggcatggtggtgcacgcctgtaatcccagctactcgggtggctgaggcaggagaatcacatgaacccggggggcggaggttgcagtgagccgagatcaggccattgcactctagcctgggtgacagggcaagactccatctcaaaaaaaagaaagaaagaaagaaagaaagtatagcaatgggcagactacccctttcaggcttgggatcaagtaccaggtacccccatggcatttttaccaacttcaccacttcacctataaaattgtagctgctctagaatcattttgaagtacttatgaggcatactaaaaagcaaggaaagatacatgggaactgtctgtgctatcatctcaatttttttttggtaaatctaaactgttacacaaaaaatacagcaagggcagcaaagtctccccatatgtcaacctaaactttgccttgctttccttcttggcaacagaagaaaatttgataacctccccctcttcttcaaggatatggtgtcacatactaatataagctaccagctaatgaattgtttgataaagagcagtaaacccaggtaattgcacttctttgcaggcttcactgcctgtcatagcttacttacaccaaaaactcacagtgtacgtattctatatgcatccttccttacaagaatctctgggttttagagagacaggggtagagggaggtgcacagtcgggtagtatgtagtgagtgactggcagattccaatacggtattgtcatgttgcatcaaggttcctcattgcagacagaaatctgcctccacacatgaacgcagcccttccttaatcatctgaggaccctgtttcagcagtcagccccactcctaatgacattctgttaaatggacaaattcctttgaagccttgtccttttttgaaatccaatttcgcaggaagccaaatctgattgggggtagccatggaaaccacatggaggagtcttagaggaggtgaagagaggcaaggcaaaacgtgatagtcacgagtcctttactgttctgtcagaaatatcaaagcaatctggagaggttggcagtagctgagtccctgcctgggtcctgttctgtgtggctgggtactatgtggctgtcatggaagaaagcagccagctgtctctgcacacaggcaggaggacagaacagaatacacaaatctcaggtctgtctgcctcccttttcttcccgtcccccccagacccaattccagcaagatcttagcatcctcttcttagctgcctgccccttaaagacaaacaacaaaagaatgacaaggttaaaatacaaggccctcacagataagaggtcctttggagcagaggccatgaaattaatctggaattccttgtaattagataagataaggggatctaaagagatgtagaacagccaggaatggagtccagcagcacaacatgcagaaaacacaccgccttgtccaccgggacccttcacgcactgtcagcagacagaagacacagaaaatagggcccatattggcctctgagcttcttgggaatgctgtctacatgttctcatgccaggtgggcactcgctaaataggcatctatgggatgtccagagggaccaatcaggaagaaacaaaagcatctggcacccagaatggcatgcagtgggaacacaactgcaagcaaagcaggagctggctggcaccgctctgccctggctgaaatgggtctggagaggaaactgcagagggcaggctctgaggctttattctgagctggttattgatccctgaatgctgggtcatgacatgtggcggagctgacgtctgccctatggatgtgcagccactgcctctcagcctctcggtcccaaccccatcaaccgggtttattgactcttttattgacaatgctggggcctaatgaggccaagagctgcacacttcattaagagatgtggaaggagagatgatgcatcctgtcggtgccaagaaccaggctcactgtatgttttgcaaggctccagaaaccaagcatcatgccaccttgaaggcagaggagatggacataagatgctaacttgggcacgttacttcagtggcctaaaaatgaagtttccacggcttgccagaagccttgttcttaccaattagctaactcttcaacttaggagggtcctgttatacacacactcacacaaatacacttccaatggtctccccttccagctcacactcctagattctctgccttaatacatacaacaaaataagcagcttctcatatcacatcaggaaacaattccataagcaggttctcagtgaggtacaggcttggaacagtatgagggactatataaaaactcaaaagaatcttcaaagggagcaaattcaagataaggaacagacccagcactatacccagggtcccccagcttaccaggagctgtgcattagaatcaggtacaaagctcttgtagaactgaaaaatacctaagatagatagttacagcctagggatcactgagccactctacgaagtcatcactgttggccctcctccatctaaatagtaatgtttcattcccagcactttgggaggccgaggcagggggatcacttgaggcagggggatcacttgaggcagggagttggagaccagcctcggcaacatagtgagacccctgtctctacaaaaaattcaaaaatttcaaaaattagctgggcatggtggcataagcctgtagtcccagctactcttgaggcttaggcaggaggattgtttgagcccaggagttcgaggttgccgtgccactgcactccagcctcggcaacaaagctgagaccctgtctgaaataaataaataaatagtaacatttctttctttcttctttatcttatctatcactcctcttattattttttctctattgttcccaatccttttttttttttaatcttctttacctatcctttagaccacattagatatccccgttgggcactgctgagcccagcagaggacctgaagaccaaagaggttgctgactctgacattctctgtttttgattggttctcttggggatctgaagtggagatggggggactcagaatgtatcagctgtagccagatgagctgtgcactctgagtgagatgtggaaacagtctgtgtagctaatctgcatgagagcagatgaggctaagactaattttatagactatagactatatattttcagacataactttggaaactagctggaagaaatagtcttttcttctgggggattaaggagattgaaggtagaaggacagcaattttctaaagtcgacctgggtttctttggtttcttttcatctgttatttcaaaggtaaaaaaatttaagttcccaaaccccttccttactttttatcctttcttcttcctcactttactacaggtcttagaattcagagttggagcagggggattcaaggtgagagaaggggcagttatttagaagctggtagaaagctctcgcctgcactgcacatgtgctcatgtgctttggaggatactgacactaagatgagtggatattctaacaagaaccaccagcattctcaaatacagacagaaacactagagtcagagataaaaacagcaatagctgattatttcgatgtaagaaagtgagtaaaaatacctttgccctagtggatatcgttggtcctcaagatatgttctttccttgccttcagaattgtgtcagtgtccatttcattttttttctttctaaatgtctattctttttttttttgagatggagtttcactcttgttgcccaggctggagtgcaacggtgggatcttggctcactgcaacctccacctcctgggttcaagtgattctcctgcctcaacttctctagtagctgggattataggcacatgccaccatgccaggctaatttttgtatttttagtacagacagggtttcaccacgttggccaggctggtctcaaactccttacctcaggtgatctgtccacctcggcctcccaaagtgctgggattacaggcgtgagccaccgtgtctggccaacaactgtacccggcctctattcttaaatatccctggactcccattcccacaacattttcttcctgtgtaaaccacactatctttcatacacaaaatggcactgtcagttcatgttgcattgcttttcagtttcactcttgtcttgcctcctctcatccctccactagaatttgtgatcacactctcttacaccacctttgagatcttcagtctcacattctttttcatcttcaatatttccttctgcctgctaacatccttggtcttctctatccttaaaaaccaagatcttcctttcacccctctacctcctccaactctcatcctttcctctccttccctgcccccatcaacttcctccatcaaatctcatgtcctttctcctccgtctcttaaccttgcctgcctgtcttcacaccaccaaagggatatctctcccaagagcatcactgacctccttctccactctcctttgtcttcaccagccttccttttggatcattggatggtcttgaccacctgctcttgctgtaagcacatagcttgcttggcattgccctatctgatcctctttctgtccatcttaactgtctgtgacttccctgcctccttctttggttctcttcatttcaccttctagtcataggtattcgccagagtttctacttgcctttctcccatccctcttctttcatttctctctttgttctctgagtctctagtggttttattctcacactactactactttcccctttgtacagattgctttgctgatttgtacctctgccccacattcccacctggatatctgagcagttccaccaaattgttatttcctctctccttaattattgcaatagcaacaaagctcagtggacagggcatgggcttacaaatcagaaagacctgggtcccgtttctggctctgccacctacctgttctaagactctgggcaaagctccatgagcctcagattcctcatcggtaaattggagatcataatccctacattacagggttattatgaaggttaagtaggatgatgtatgtatatagtatatgctccataaattgcaacagttaggccgggtgtggtgactcacgcctgtaatcccaacactttgggaggccaaggcaggtggattgtttgaggccaggagtttgagaccagcctggccaacacagcgaaatcccatctctacaaaaataaaaaaattagccggaaatggtggcacacgcttttagtcccagctactcaggaggctgagtcacaagaatcactagaacccaggaggcagaagttgcagtgagctgagatcgtgtcactgcactccagcctgggagacagagcaagactctgtctcaaaaaaaaaaaaaaaaaaaaaataggtaatgttataaaggcattgctgttttcctggtaattcaagctcaaaatatagaagtcatcttcgacccttcctcactcattctaaacagccactaaggccactagtcttacctcctcgcagtggcttttgaatccttaccctccttgcgtccttaatgtcacctctttgggtttggttctcaatatctttgttgggaagtgatatgttgaaatggcttctaacccggcctcccacatccaatttccccaccatcccatgccacccctcatataagcttcagagtatatatcccaaagcatggctctgaccccatcaaagaggtgatagagtatagaatgtagtggtcctaaagtcagacaaccctgtgctcaaatctgccaccgcttgctgtgaccttggacaagttacttatcttccatatgcctcaatttcctccgctgtaaaatggcaatagtaactgtattctcaaggttgttgtgaagatccaaagagctaatatatgtagtgcttacacctgcctgcagcatggtaggtgctttgtaaagtttagtgattactgtccctgcattccctgcaaaaactagcacctgtcagatgctcaataaatatatatacaaattatccataatctctcatttgatctttcttactcattaaagatatatttgaggagtggccaagatataggtatcattggttgccaaggatgagagttttcctctttatcaagctaatctgcctttaaagagatgaatagagtgtggccttggcttccttggcaccaggctctaacaaatcaaggttatcagattctccccacccacctccagagatttcctccctgccctatctattctagaatacttctagtgttctccaaaccacatgggggaaacactgatctggaaggcgtgagatattaacacctcttttcacttattgcagcaaaaacaaagttttcactataaataaagaccctgcaaagaaccaatcagaaagaagatcatatcctaggagtctgtagtccctttagtctggagagctgccagcagggctaagctctacagaagggctggggttgtggcagacggacacgacttggggagtgtgtgggagggttgatggcctagagatgaggctagtgagaaagaaaaagggaaaagagagtgaatgagaagttgaatgaaaagataaataagtggagaaatagaaaacatcataaagaagtcttcatagtttgaaggattagaaactaaatcaaacagatccacttcatttcctgaattgtaatttcaggctataccatgttctacctccaaggacaattgagtagcttcagggaatggctgtaaattcctaaagaaaagtgccttgtggatcaagctgttcctatctgctgctgtactttttagcatctgcactttcaacacaatgacacttcttattgagtaatatgtgatattttgcatcatgagactattgatgcagaatttcctttttcagagctcaatattccaatcaaagcctgttgcatcacatcactgaggccatccacttaatgacaaattgtaagatgcatattgcagaatattcatgttcattttatgctcacagtgcttgaaatctcctctaaacagcctctgctctcagcctattaaggtgcccgtgttatctacacttcattcaatggtgtggaaataattgtcttgagacgaaagaaaaaattgatggtcacaagccaagtcagcacttgtgttcttttcttactctgttgaatctggtgttatttacctcttccaacacctgggactcctgataagtcactcccatgatagctttttccaggacagtgctatggggtctttagaataagtagggatccttcataagctatattgttatcagcacaattcatgcagctaccagatgtgcaaaatagaaaccaccaagggcattcaggcaaagggggcttccccagctccatatggccactatgacatgtgctcatgagttggaggaggaatcagagaaaaaatgagatgcactaaacatgagggcctgtgttcttgcgagaaaatgcttatattctgacaatgttggggcccttttttactgcccttcatctgctatcccagcacctgcaccctatagcctgactccctacaaacctggctctactaaaaagaccttcctgttagagacaggtgggcccttttcttcatctcttccccttcctcttatctctgggacgaagcaccaggacgcgggctggtggaggagagcaattgcccctggcagctgatagttcagcaatgcggcctgcgactttgcctttaaatatcaaccacatgcacagaaaacaccctggcagcctgagaggtttccatggtgacagaatgcaggccatgacctctgtaaatgt

SEQ ID NO: 380 - DNA, 69878 bp, Homo sapiens
ccttcgggaaaggttccgttcacctgacgactccggtgagatgattagtttcaccgtcagtgtcacatggccatcttaagtctactttgtcactattagcgctgcagcaccctgagaactgccagtttgatccagagagaagctgaactcataattctgatggctgatgaaaacaataagatattaagaaatccaggccaggcacagtggctcatgcctgtaatcctagcagtctgggaggccgaggcgggtgatcacttgaggtcaggagttcgagaccagcctggccaacatgatgaaaccctgtctctactaaaaatacaaaaactagccagacgtggtggcacaagcctgtagccccagctcctcgggaggctgaggcaagagaatcacttgaactcgggaggcagaggttgcagtgagccgagatcgcgccactgcactccagcctgggcgacagagcgagactctgtctcaaaaagaaaaaaaaaagaaaaaaaatccaaagtgataatgggtgaagtctattcagcatcctacagtggattattaaatttttaaatcttagttgaggaaacaggtgtttcaaataatgttctggaaactatcaggaaacctgttttcaatataggcctcaagttttaattaagtatttaaggtggtttcttgaaaataattaaataaaatgcttaattaaaaaaatgttcccaaagttaaaatggtctcctgaagacacacatttaggcaaaaaaagaaaaaaaaaaaaaaagaagaaacaactttaaaaaaaagagaaacagtcttatcacctgttaattataattcctaaaataactcaaatcccttttcttttctatgtaaaaagaaacaactgtactttaggacctcatcattctcactagcacaacagcctgctctatctgatgcattcacctccagttctgcccttccgtgatccccacctgacagtcatccacgcagcaatcccagtgatcctgtcatagtgcaaatctcatctgtagtagttcaacttagtcacgctggtagccagtgggctaagtctagctggcagattttttgttttatttcaatgcctttgagcaggtatgtaccccaagccccaccattcactctaggcattcacacctggcccctgtgagacatctgaatttgccaacctctgacctacagtatacaatccaaatactgcagctggtgtgatctttctaaaacgcaaatgaggccatgcttctgccctgctacgctaaaaaaaaaaaaaaaaaaaaaaaaaaaaaaaaaaaaaaaaaaaaaaaaacagaccaaaacctctgtcttcatagagcttgaagtgctatggggatgaaataagggagagaagagaacatggtgtggtgagggcaggggagcctatttcagataggctggtcaaggaagacccacagagatgaggggacgtactataacgaaagatgcactccaatcaaggagtgggacagaggccctagaaggtgggtgggctgtccccgccagtattttctcaggcaaatcctagttgtttttcaggaatcagctcaaatgccatttctccaaggaaacctttcctaccattcccaggtggaatgaaattcctcctcccatacattcatatgcatatctcagctatactttcataattctgtcatcatttgtgaacattgtcctcaaaaatattcaccgaaaaaaattatctgaaggataaataggcagatatgataaagcactcttgatgaaaccctcctatttctttctctaacaacgagggatggtatatgaaatatattcttcagaaagaaaggggttttgaaatcaaagtccaggtttacatttctcatgtgagtgaagttggacaaattccttagcctggctaaagccaccatttatgcaccagtaaagtgctggaaggaccaaatatgagaaggcacattttagcccgaacccagtgaaaacacatagtcggccctcagtaaatactgcttttccttcctcttaaactgctttccatcatttagctgccaaaagcaggtgttgccacaagagggcacttttagcacagctggaaaagcatagctgctttgccttctcagattaaaccagccaccatctcatgcttaagctttaaatccacagtgggtgaacaatgaatgaaaaataacatttgacaagtatagagcggtgatgagtttggtactgccaagtctattacagacagacttaagagaaacgagaacctagcatggtggcgaagagcaagggtgtttgaagtcagactgatgggggtttgaatgcgggttccctgaccacaccgggcaagtgtgcctctctgagcttcacctgtagatgccaggcctctagtagaggatgggtgctggccccagtgaactcagtctggcttgatggatggatgaaccaatgtatacataggccccaagtgatgagaactgtaggaaagaagaattgaagttacctggtaaatgctgacccactgtgggtacacaatggcactagctctgtgctttctcctctgagcagtgcatcatctatagcgttgcccaatactgacagcctatgcttcaaggaagccaagtgagacaagaagctatcaaaaagatgaattctaacttcaacaaattagaaaaaaatcagactctaagagggttttttaaagttgattaaaacacatgtgttaaggacaatctcttcaacaaatggtgttgggaaaatgaaatatccacatgcaaaagaatgaagttggacccttactttacaacatatacagaaattcactcaaaatgtattcaagatctaaatttaagacgtaaaattataaaactcacattggatttggcagcatatcttggatatgccaccaaaagcacaggcaacaagagtagaagtaaataactggactacatacaaatttagaactttgctgtgcatcaaagtcaatggatataatcaaaggagtgaaaaggtaacctgtggaatgacagaaagtatttgcaaataacatatctgataaaggggctgggcacagcaccttacacctggaatcttagcattttgggagacccaggcaggcagattgcttgagcccaggagtttgagaccagcctggacagcaatagcaaaaccccgtctctacaaaaaaattagctgggtgtggtggtatgcacctctactccgctactcaggaggctagggtaggagaatttcttgagcccaggaaattgaggctgcagtgagctgtgatcatgccactgcactccagcctgggtgacagagtgagaccctgtgttaaaaaaaaaaaaaaaaaatatatatatatatatataacccctttagatatagatatatctgtgtgtgtatatatatacacacacagatatagagatgtataaagatgtatctgtatatatatgcagataccctatatctaaaggggttaaatatgtatttacaacatatacagaaatcaaaaatatattcaagatctaaagacataaaattacaaaattcttagaaaacaggaggaaagctgttaaatatatatatatccttaaatatatatattaatttaataatataaatattgttatttatatattatatgttactgttaaaaaaatatatatatatctccttagacatatatatctaagggggttaaaatccagaatataaagaattcttacaactaaacatcacctcaagcatatgaaaagatgctcaacatcactaatcattaggaaaatacaaatcaaaaccagaacaagattatcatatcacatccattaggacggctacaatctgaaaaacagaaaataacaagtgttggtgaggatgtggagaaactggaacccttgtgcactcttggtgggattctaaaatgggccagccataatggaaaagtctagtggtttctcaaaaaaattagaattaccatatgatacagcaatttcacttctgagtatatacccaaaagaaaagtaagtgggatcttggctgggcacagtggctcatgcctgtaattccaacactttgggagtcggaggcaggtggatcacctgaggtcaggagttcgagaccagcctgaccaacatgatgaaaacccgtctctactaaaaatataaaaattagatgggcgtggtggtgcatgcctgtaatcccagtcactccagaggctaaggcaggagaatcgcttgaacccgggaagtagatagaggttgcagtgagccaagatggtgccactgcactccagcctgggcaacaagagtgaaactccgtctaaaaaaacacacacaaaaaagtgggatcttgaaaagtatttgtacacccatgttcatagcaggattattcacaatagccaagaggtagaagcaacccaagtacccatcaaccaaaggctggataaacaaaatggtacacatacaatggaatattattcagacttaagaaggaaggaaattctgacatatgttacacaacatggaataacatcaagggcgttatgctatgtgaaataagccagccacaaaaagacaaatatggtacgattccacttatataaaatacctagtgtagtcaaattcatagaaacataaagaatggtggttatcgatgactgaggtgaggggaaaatggtgagtttctgtttaatgggtatggagttttaattttgcaaggaaatgttctggagattggttgaacaacaatgtgaatatatgtaacactactaaactgtatgcttaaaaatgtctaagatggtatattttatgtgtattttaccacaatctttttctttaaaaaaggtttaatatgcttctccctctgacacaccttaatgtgcttccacctctgctgagtctgcttgtaccaaaatgcctctacttgatgagtaaagctactcaggagcttggaaacctgataatgcagttgaaataccctgaaaacagaaagattagcacttccttccttctaatttaccacaagtatgccacaagacactggatattcagtcatacatactattcataaaagcatttgtatataaaacagtattttctacatatggagtctcaatcacctaacaggatgccaacctctaaaatatgggcagacttctggctctggattagtctctgtatgcagttacaaaggaattttaatacttgttttcaggaaaaagtatttattttacaccattacaaaaatatttaggcacataattttcatgtttatgtcacctgatttacatacctcaattcctcagtaccttttaacactaaaaatggtcatttggtaaatagactctaaaatgaaaaaatactgtgagaagctaacacctgtagacaaaaatcagttgatcatcagcatgagaaagaaaacatttgtgaaaaaaataatctctaaaaacatttttgtgagacaataaatctaaccagtagatttctttttaaaaagtatttttaaagaacaaagctttaaaaaaaaaaaaactacaacactgtaaactatatcctcatgccatgaagcagcatcctgaaagtaagacctagaagactggcttagaaaacagtaatggtgccagggactcacaatatatgacaactgagacaggcctggaagcaggggcagcatggggtcaagtgctttcaattcagagaggggaaaaggaacgctggcctttccaggagccatctaaaggtaaaaactgagaaagatttaactgaattgacattctaaaatgtaactatgtttctttaagatagaaaataattttcctggccggacatgtggcacacacctgtaatcccagcactttgggaggctgagacagaagggttacttgaggccaggagtttgagaccagtctggcaacagagtgagaccctgtctttaccagaaaaaaaaaaaaaaaggaagaaacgagccaggcgtaatggcacatgcctatagtcgtagctacttagcaggctaaggcaggaggatcacttgagcctaggagtttgagactgtggtgagctgctatgattacgccattacactccagcctggctggcgacagagcaagaccttctttcttttttttttttttttttaaaaaaaaggagggggagtagggggaagaaaataattttcctttattaaaatgtactgtcacaatataaaagaaattttgttctttttaaaaaataggtagaatcacctgcatcatgtaatggccgtaattgtgtccagcagatatttttaaaaaagaaaagacagtgaacagaaactgctacctaaggattctagaggcaatgagacacagagtcctgtttttcaggacagaccgtattgcccaagcctctagcatttacggagcataaattaagaatcttgttttgccttgagtctcaccatgaaataatgacacggtagccacatttgctgagggcctaatatgtaccaggcattgtgctaagtagtttcatatccatgtctcatttattccgaacttttttcctcagggagagaaaaatcaattacagtcttgttcataggaaaaaccaaacttacaattttgggaaagcaagaacatgtacagtagaggaggaggcctcaagctacttacagaattctaagagctgtgttgctatctcagagctagaagattaactaatatgagttacaaaagtcctctcggattaaaaaaatgctttagctctgtggggcgtccctaaaatcagtgatactcataaccatgcaggcagctcttggttacaaaatcacggactcctttcatctgtctcctttctcccactcagggtccaggtttccatatctggctaaagaattacacactccttgaaagcaagaaccatgtcttgtttatcttttttccagagcttagcaaaatacttggcatacaagagctgctcactaagtctttgctcactgaacgaggctatcaagtaaggcaggcccaaagtcctggggtgccatttcaaaccaactcaatgtgaaactccactgtttctccgtgaggatcctgcaccagctgtactgaccaaaaccctccatggattcttgataaaacaggactaccaaaagcgtgtaaatgcactttttaaaaaaaaaaactaggtgcaaactggagcctacaaatgattgactcataaagtccacagccacatgaggcaattaaaactcaacgggacatgctggcaatgtgtagcctggccaactagggttattccaatccatttagccttgactagaagcagattggccaaagagggtctcacttacattgaacaggagacactagtcatagaatttgtcttttggaataccacagctcatctgtctcagtgggcaaattaaggatttaactctgtattgcctctttttctcccaggaggcagttaacaggacaaagaatttctgcctagtaaatatcaaacatggggcaaaaaccagactttctgggaggtgccacagtaccaggtaaatcaccagtatattgtaacacgcctgcaataatcaaaacgcaaactccaaaagactattcagtctccagcttgttcaccctgctccatcttgcaatgctggttagtggctgaaggatgcatccaggaagcagaacacagacagggcaaagttgctgtactgctctggtcagccagaagtttcagcataagccagggctcccaaggcacagaagcctgtcacgtgcatttagtgaagctgtaactacacaatgttctcaaatactcctgaagaggtgacagatctcctagggaacctgacccccaagaggcagttcaactcctggtggggctctagcccaacacctgttaaagacacccaaaagcctttcatgaagaaatattctacaacaaaaattattcaaacgtccctccttcatgttgctgacagaaagaacagaatcactaaaaatagctctcactatgccctttcactgtacctaagcaaaaccaggaagtgttggcaacatttacagccagaagtgcattatcaactaaagtcagcctggaagtgggataagggttccaggacagggtaagctgtcactcttcctgatttgcaaagtatgctcctctctgacaccaaattcaatcaactgcttgcttttttgaaagtgctcaagtgaactcaggatctgtttccttactccctcagaggggaagggcggttaattaaatggcagcatagttcaataaaaaggacatgggtttgatgtattagcaagtcatctttctctgagttttgttttctcattggtaaaatagggagagtaagacccatatgacacaagatactatcctttactcccagtggaattttctcaggtcagaagatgctagaaaaaagtgagtctaaggctcttaatgaagcttgtaacttgggagttggttgcagggataattctagggacacagcaccaccagccaagctttagtaaagacaaaccaaaagacaggaatatgaaaatgatctcaatataaatttgcatatcaaaaaaaatcaaaaccctaactgtttaggtcaacagagtccagtggattccaaacccaatgaaatagacactggtgtgtgcattagtgcaaaggtaccaaatctcttgcacactggctgtacaactggcctgagcaaacacactaatcctcaaagtcaatggatatctctgagtcaagtcatagggttatgtttgagttaacacctccaccctccagattaccccaagaggcaatttaggcagtgcccattcacagctgctctcccaaaatgcagcattggttttgagagaagttggcaagctcagtaggtgagccaaggggcacatgatgtaggtgagaatgttgaaaggagggaagtttgctcattgctcatgccatttaagaaggaagatgatagctctaacactgacactgccagagaaaaaccaaccattgacaatacaaagacgtctaaccagcctttcccctcaaaccaataaattcagaaatgtgggacctcatcatattcatccaaagagcaaccaaacccaaaggaaggtggcaagggaaaacagacttgcctgtctgcaattttcacttagagagggagtcaatgctgagctgcactggtttacaaaacacagctctttacttgtacctcatctcacattgcagcatttggattcacactattgccgggtaggtagggcaggtgttcttaatccaatttacagatttgcggcttttgagtgctgaaacaacttactcttagtgacatcttctgaatagattaacagagctaaattctcaaccttacctgagtcactatggcaggagtgagatgtttcaactacctctgcaaacatctctgtatccccagcatttagcacaatgcctggcacatatacttaaaacattttagttgaatcaataagtcaaatagatgaaaaattagtaaaaggcctactttctcacccccttcattatccccattctacacaacaaaaaaagaacatgttttcaaggaatgcactctgctcatcctatgaaagtcagggaagccaacatagatagcaatacacttcaaagccccacatatttttatagtgccaaagttgttttccttggcaaatggaatgatgatatgatgaagacaatgcaatcataagaaataagattcaaagaagagaaatttcacatattcgtctgcatttccagcagaggaaaggctaaactgcctccagatgcagcaacaatttgaatgatgaagctccagttggcaaacattacatatgcagctctcagggacacctggatatcaaattatgaaataaaatactttcaaaacactgatgtttcactgtcggcatataagaaaaataaattaaaaagcccagtaccttttccagtctgatataaattaattcaaacaacatatttaaaatagagtcaattataagtttctctcttcataaaattttaaaaggcagcaatcaatcctcagattgtacaagtgcaaaggaatggttatttcctccataatcaagacacctcagtgtctctgtaggaactgccagtgttctgagttgattaaaaacttaggcctacgtatcagatgaagcaatcctctggtcacactgctcctttccccttaatgtccagcttgttattagcctctgactgtttgctcagctgctcttcagtgaaagtgatataggaatataccaggctcccagcaatgctgcaaaacagaaagccactatcagagatggaggaagggagggttttagtgtaaacactctactcagtaaaaaaacttacaccaaaaaattagatgaagagtaaagtttcacagtggggaaattcatacaatgaagtactatgcatccattaaaatggtataaaatataaacaggcattgacacattaaattttgtaagacagcttaaatttttatgagaaaatatatcataaaacatcaagcattgtctaatcccattttatttaaatgaacatgagtatgtatatcaatatgcactggaatagacaaaagtctgtaaggaacacaccaagaatattaacagtggttacagctggatgctgacattacaggtaaatttttacttgtatttttttgcatttcgaaaaataggcattaataggaaacatcccaaattagttaaatatgcagaccctaggagattcacagagctgatttttctctgactaaaagcaagttcacagtggggaacttatcatctgggccgtcagcctatgacaggtggttgctggtacccctcacttatccatcgcacctaccaccaggaaggatccctctttggtgacaatgattacttggtccattctctgtggggacctcaaactcacctaggatacgcagcctcctacccgattcactaagtggaaagtagtctggaggagctcacagatccgaccactcctgccctgtcctccctggctcttccactgagactgccacccaggactcccttggattccagccagctggatgcctgacctgggcgccaattcttctgccctggttttggccctcatcttctgcctaaccacttgactcatgaacttgctgcttatttgaaattagttctgttctctgggctctgacatcagccccagaccagctgcagaagggtgagagacgcctagctcttgttcccactaggaagaaagcaggatcaggcactggcgcttgttctttactgcacacgctcgcataatactagccattctctgagactccaatcaacccaaaataaagccttttccaatttaaccttcccaaccagattcttccttttcctcatctgcacctcacggcacttaagagcaatcaaattattaaagtctacttgtcaagcattttacatacatttcctgtttttgcaatattcctgcaaggtacaatatccctccaaggtgtccattttatagatgaggaaagtcccagagtcataagataaattgctcagggtcacaaagcatcctactgatgggccagaatacaacctaggtcagtctttctccactccaactgctgcctcccttatgacccttgtgccactgaatactagttatccatcctcactctgtccttatcatcttgttaatttcccacggccttaattcttttagctgtacagagtctcttgcaattggcctgacactttttagcaacacaataagtaactgctgaactgagtatcccctatcaccccacttgaggaaagggggcctcatgaacccaattcttacactttttattgtctttccccccctttctgtggaaaatggggtctcgctatattgcccaggcaggtcgtgaactcctgggctcaagctatcctcccgcctctacctccctaagagctaggattacaggtgtgagccaccgcgcctagcatgaacccaattcttatgccaatgttcatagagcttcatcttttccttcatccagcagctttttcccatttaattttttctggaatttgatatgactctcctagaaacttttctggtttttctagtccctcaagtagactacttccctggtagctggcctggacccaagaagatggcttactgaagtcttttttgactgaagctaaaagttctttaaggttcacatgtacgtccacccacatgacagtcaatttccctttgcctccaaacccaccccaaaacaaagtagaagggctacctctcctttctttcatcctaccttcctctagcttcgccttcccacaacagcctaaaaaataaaaatgctttcttatttttcctgttaagatgatctttgatgttcacattaatcctatttaaactggataggaatactggggaagcacaggatagaagaagacaaagaatgtcctgtaatttattccaggcttagccctaatgataattccagaccctatattcccagcatagtcagtgtattggaaaaaacactgactctacggttaggtcttggttcaaatcctgaatgtactctaggttgagtatctcttatctaaaatgcttgggaccagaagggtttccaatttcaaattttggaatatctgcattatactcaccagtcaagcatccaaatctcaaatctgaaatgttccaaagaacatttcctttgatcatcctgttatcattcaaaaattccagattttggagcattttggatcacagatgttcaatctacactagctatgtgaccctgggcaaattaattaatccatttctgtattcatcaaataagaataatgttatctatctaagcttgtctgaggattaaatgagattacacggataatcttctcttcattctcttctcccctaccttccctgtcagccctgacactcagaaccagaggggagatgtactgctgacaaaaggtaaggtactataattataaacgtcttactccatttgggttgctataacaaaataccataaatggtggcttataaacaacagaaatttatttctcacagtcctagaggctggggagtctaagatcaaggcaggttcaatgtctagagagggctctctggttcacagacagtatcttctcatcatgctctgggatctcttacataagggcactaatctcattcatgaggatgccaattccatgacctaatcacctcccaaagccctacctcctaataccatgactttgggagttgagagttcaacaaactgggggaacacaaacattcagaccatagagcaaggaatgtaacattatgaaagagggggcacactattgccacatggttgtaacttgaggcaacaataaaatatatttaatttcatctttattactgactcgatcattatcaaatatagattttcggaaagggcaattcatgaaccacctgaagagaactgaatattcatcaacgagcatactatgtgttacgcagtgatgagtaaacgctttggaaaggaactataatttgctctctagcagctttggggaaggggaaaactagaaggaagggaaagggaaaatgaggaaaagcccagatttgaaggggagaggggttatatctgactttttatacaacactaccaaatgattctaaatcaggatcttctactacttcaaacagagaccctttaactaatctattggccccataaatattcacattaaagttgataccttctagtactatgaaattggtgttaatacattagatcatcctaaatattcattttttaaaagtagaactcctggtattagtactggtcaacaagattttcttttaaaaagttaaaacatgcatattgaaaataaggtacagtcattatgcaagcctaagtttatgccttttaaaaaattttcaagcaattttccatctgtctaatcttcaaacaacagcactaccaactgttttattttgttgggacggagtctcactctgttgccaggctggagtgcagcggcgcaatctcggatcactgcaacctccgcctcctgggttcaagcgattctcctgcctcagcctcccgagcagctgggactacaggtgcctgccaccacatccagctaatttttgtatttttagtagagacggggtatcaccatgttggccagggtggtcttgatctcttgaccttgtgatctgcccgcctcagcctcccaaagtggcactaccaactcttaactcacagagacctctgtggcagatacagctgggagacaccagaaaaaaaagacaaagttacagttcctgagacaggggccttgttagaatactgcaaatctgaatggaacgtgccgaactgcttccaaatctattgaatctactaaatctactttatctgctctgatccacttttgatcttcaaaagcaaggcaaacacagtctacttctcctaaacctacagtcatggacatattcattagcccccgacaatgagatacccattccaaaaatatacactaaaaatgctttcaatatagcaaccctgtggccagggaacaacagtcctaatgtccaccaccacgcccaggtaattttgtcattttttttgtagagacggggtttcacaacattgcccagactagtctcaaactcctgggctcaagcaatctgtccacctcagcctcccaaagtgttgggattataggtataagccattatgcccaacctctccctgcttcttaaaaagcattatgtagagacattaaatatgtagcacatagaaggcactccacatatgtttaataatgaataaatgttccattaatttaatagcctaaccttattgtgacactatttgaatatccaattccgattttgcaatttaattaaatatttttacttacctgatatttaaaccaatgaagtttgtccacgtgaaaatataatctccaccaaagaccattccaatataagttattaatatattctaaaaataaaaatagtaatatactgttatataggtttaactgagcttcttaaatatatataaaactcatccaaatatctgtccttaaaatacaaaaacaaataaacaaaagacaaacaatgaaaacgcaccaaccctaataatagtataaggaagaacactattaaggaatcagtgacattagcctcttcccaatcgatttctccagaagataaatgcttttgccaatactgaagaatactaccaacagaatgggagaaaatattcacaaactatgcattggacaaaggtctaatatccagaattgataagcaacctaattcaacaaacacaaccccattagaaaatgggaaaaggacatgaacagatatttctcaaaagaaaacatacatgcagcaaacaaatataggaaaaaaggctcatcaccaatcatcagagaaatacaaatcaaaaccacaatgtgataccatctcataccagtcagaatgtctattattaaaatgtcaaaaagcaacagatgttggcgaggttgagaaaaaggaatgcttatttatacactgttggggggaatgtaaatttagttcagccactgtggaaagcagtgtggacatttatcaaagaacttaaaacagaactaccatttgacccagcaatcccactactgggttatatccccaaaggaaaataaattgttctaccaaagagacccatgtattcttatgttcactgcagcatgattcccaatagcaaagacatgcaatcaaccaagatgcccattaacgatggactggattaagaaaatgtggtacatatacatcatggaatacaatgcagccataaaaaagaaagaaatcatgtcctttgcagcaacacggatgcagcaggaggccattatcctaagcaaactaacacaggaacagaaaaccaaacaccacctgctctcacttgaaagtgggagctaaacaccgaatatacatggatacaaagatgggagcaatagacactgagggctgcttgaggtgggagggtaaaagggggatgtgagttggaagactacctgttgagtactatgctcactacctaggtgacaggatcgtttgtacaccaggcctcagtgacacacaatttacccacgtaacaaacctgcacatgcacccccagaacctaaaatatctttgcatcttcttctaaaatggaaaaaagggaatggtggggactttaccaatacaatgactgtttttagaggaatcttccttggtctcttaagaaaacacatgggaagtcatctcaagatattatacctaaaatcacttctgacactcccaggtgcaaacatcttctggctcccttttaattatcctaagaccataaaaacaaaaaataagtttctaaaatttaaactagaggctgaatatcctttatcaggtcccaaatacttgggacctgaaatatttcagattttgtaatatttccattacacttaccagttgaatatctcaaattaaaaaatccaaatgcctcaatgattatttcccttgaatatcatgttggcattcaaagagttttagattttggagcaagcattttggatttcagatttggggttgcaggaaatcaaaaaattttacccccaaatatatttctttaacatacagtaattaagatagctgtcagaaagccagcaaaaagaagtagctctgcaaagctgtcttttgtgagggaaatttacatttgtagaaaaatctacactgactgtagccaggcctccccttgtccagatctaggaaacactaactgagagtctaacacctttcaaggtctaaaaaagcatttatcatctattctctccaagggctgctacctgtgaggtttcatctgtataacaagaccactttagctagccaagcctcctcttctctccctcccataacctattttgcccaatctaagcccccattttttctgtaacttcaagatagtatataagcttctacactccactgggggtttaggtagtcactctgcaatattctccatatacacatcaataaattagataccttttcttttactagtctgtcttttgtgagctgatttttaagcaaattttcccttcatccctacagttttgatgcagtaagcagggtcaccaaagctgttctgctcttttggaagctgcagcaaagataatccaggacctcaccagccagcataaggataaaaatttcttaccagccaggctccagacctctttctccctgtggaatctggtcaagtggatggtaaaaaaacaatcagttcctttttcctctccaaaatctttttcattttttgccaccaggtctcactctgtctctcaagttggagtgcagtggcacaatctcagctcactgcaatccctgcctcctaggctcaagcaatcctcccacctcagcctcccaagcagctgggaccacaggtgtgtgccaccatgcctggctaattttttttatttttgatagcaatgaagtttcaccatgttgcccagactggtcttgagctcctgagctcaggcaatccacccacctcagcctcccgaagtgttgggattataggagttcagccaccacacccacccatacagccacagagcccaaatcttgattaatgggagaaaaagatttgtgtgacaagtcttggttatagcttttggttctctgtggcatgaatattcaaattgtttgattcatttcttccccaaaatagtcttttcctttatctttgtctttctgtgttgctctgtcataaaaattagggtactgcttgaggttctcttgtcattttgtgcccttgaaagtttgacttctgatcaagtggaagcactctctcttggtctctgccatctgggggcatgatttttgagtcacgtcaggtggccagtctaaaaatggctagaaacccaagactttgttccaaatgtgtcaagctcttaggacagtctgtcataaagtctcatctacaagggcttttgtcatctcaacctttgttgcctggttagtactaaaaaagtccagtcccatgagggcctacctattctcacagattaacaggtctgtgactggtggtaccccacatatctgtgggttactgaagaccatctatgataattagaatctttcactatctgagcttattcctggcaatacattttttgggcgggggcatgggaactttgggaaggctcttctatgccctctccaagaacacatttctaaacctaaaaaattacatcctaggttttccataaagagactattagattgagtcactattaaaataagtacaccattaaaaattcaacagccaaaagatggatcctttaaattagactcctaaatcaaaaaaaaaaaaaaaaaaaaaaatttaagagatttcttattctaaacaattgatgagaaggtcacatttttttttagaagacacacaatagtgtcatggttagtcttacaaatttttctcttgacaaaattaaaagagcaaaaatctgacctaaaacaaagttaaaatcctttgtaagctcacactccctgctttagatcccctgtgggattcacaataaaggctgctgtaccttatggctggtaattcaagttgtacactttcaccaccatagcctgggttcaattcctggtcagagaatcagccccttttggctcagtattcatgtgactttgactttttggggtacccattcacctctttagagatgccaggtgcatccttagttaagtcataactttggttaagtcttactggtttcacttgtgaaggtatcttcaataaaaaaaattcaaaaggcaaaaatatcatctgtttgtccccccagctaaaatctgacaatagattttaaaagattttttaaaaagagctctgtggttaaaagtcagcttaattaaaaactgatattcaaattatacatgcatatataatttaagaacatatatcctggagatatatatatatcctgttcttaaattttttttcagtagactaaaactctctcaaaattatgtttttaaaattagactcttaaattttacttcctttcttagaaattgggccaggcacagaggctcacacctgtaatcccagcactttgggaagcagaggtgagcaaatcacttgagcccaggagttcaagactagcctgggcaacatggcaaaaccctgtttctataaaaaataaaataaaataaaagttggccagtcatggtcacaagtgtctgtagtcccagttactcaggaggctaagatggggggataaattgagcccgggaggtcaaggctgcagtgagccatgattgtgccactaaagcctgggcaacagagtgagaccctgtctcaaaaaatatatatttttctcccatttactcttatttcttcctactcctccttcctcctctttgctgtctttggtacaacataaaagaatctagagggcacttctaatgattcagatcccttaagaaacacaaaaaaaggtgccatctacctcttacttgtactgtaggagaaatgtgacttgtgtgtgtgtgagagatgagtggtgagtcatcaccacggtaagagctacagttttagaggtgactggtaacagctgtttatagtaaacgattattactacaagagactacttgtttctttgtgagtttagatttaaaagatgtagtttaaatacttttaaaaatgtctgtatcaaagtacactatacaagcattgcataacctggtttcatagcatttttctttctggggatgtgggattcaatgtaaaagcaaaattctacatttgtaaagctctatatgttttgcctttcaacggtgcctactttccacatattttaattattaggccctaaaaactacagatactttgttgaccctgttgcttaatgggctctgccttgagctcagtgatccagttaaaaaacagactaaattttacaatgcccctctaaataaaattagtccccttataaaatcctataagttcctataagtctgttaccttgacatccatttttaatcttccactaacacattcaaactccttttaaaaaatataaattctctctctgcactttaaaatataatttactaccctattttctctaaaacacaataagggcttgggccatgtgaggcagataaactttaatctttttcacttatgaatacaaagtttaaatccaactgttcttttaaactagtgaattttactggtcttatggctaaaatttaaaaaccaaagctataaagtctttatttgtgtccatctatatttttatatatacatgtctaagtgtatatactgtctacataatatcaaattaacttataagttagtactcacaaattaaataggcccaaataattttcaagttcacatgattttagtaatccttaataaattaaaagtttaaaaattattagtaaaataaaattaaaatgtcttcaatttttagtttttttttttttttttttttggcctggttggattgatcagacaggtttatactgtctctactaaatgttgtaaggtcacagaactgttacttctataatatttttaatgcttacttaatttatctgtgagcttatgtctgtaaatttgagactttagattctaatgtctagacaaaaaaggtctggggacaacacccaggccctgtcctccctagcccaaccatgtctcttggccatactaaggattaactcctccaggcattgtgttcacagctctattctttgtcttgcactgcacatagttacaattacttatttcctaggtttttcactaaaagtaagagttactaagagatactatcataattaatatatataattaaaagtactagatattaaaataaacaattccatacgcaaagtatattccaaaaggaaaatgtgtttttagtaaaaaaggttataaaacacataaaaatgtgtttttgtaaaaaaaaaaaaaaaaaaaaaagattttgcctagtataaacgtttaaaaagtttttaattaaaaaaacaaaaataaaaaattttaaaaatgtttaaatttaagaggctatttaaaaacgtataaaaatcttgtggtcaaactaattaaaattaaatagatttatttacaaggctttattaaaaattaactttaatgttaataatacactaatacaaaaataaaatcgaattttctctgtttttttttgagtcaggatctcactctgttgcccaggctggagtgcagtggcgtgatctcagctcactgcaacctctccctcctgggttcaagcaattcttctgcctcagcctcccaagcagctggaactacaggtgcatgccaccatgctcagccaatttttgtatttttggtagaaacaggtttcactgtgttggccaggttggtctaaaactcctggcctcaaatgatccccctgccttggcctcccaaagtgctgggattacagacgtgagccaccaagcccaggcagttttctctttcaaacaaaatttttatgtactattgataaaaaataatttttaaaattttatttaccttctaaataaattacaaaaaagagggggtagagggaaaaacagattcagtatgactcatggtatctttattatgtcttataagtctctaccaagagtaaaaggttttgctttttaaaatctttaaattatcacgttgactaatgatatcttttagtggcctgcaatcctgttttaaacctttgttatctgacatatttccccaaatcaaaatttcaaattcagtttttttgacctcaaactaactttttagataatagggcccctagaagtctaagagaaacatattagccttatttagtatgttaaaatcaaatggaaatcattaaaaaaatggtgcttaactttctctgcattatatttatataaatgtgttattaatatatgttctaaacctgtatgagattcctaaagatttgaaatgtcttcagatatattatcagtaataattatgattatgttaaattggtacatgtcaatgaaataatcaaatttccttgtcaattgttaactattctaagacttttgttttccattgacaatcattgttttactttgattcttctcgaaatgtagtttacaatcggtagagtccaaaatttgcttcttcttcggagaaattaataaaaaaagaccctgataagtagttgtaaatataggtttctgataactttattgatccgaccattagactaggtaaaaactttcagtattctagttaaaaaactgatgtattcatgaggattgctaacctaacatccaacagtataagaattacaaggaattacattagtaaaagactaatttttatgacttcaaaaaaaatgctgtgttttccagtcaaaaaacttttttttcttctaaactatttataatttacaacaattgggtaaaatatactttgtgaacaaatttaaaacatctttctaactaatttctccaaatttaaaaactatttataaatattcttaacttatcagaatataattatttagataagttcaatacacatctgttttctttgtaataggacacagagacactggttattttaccaatactttgactaaaataacatatttgcagatatgaccagactacttgaagaaattaaagttgactttataaagccaataaaaagacccttgtctacacagttcctttataagtttcctgacctgtgattaaaaaatgtaactttctgacagaccaagggacctcgagttattttatgatatcaaaaggagaaagattcacccaatttgttacaggtattagagtctggtggcaaatccttggcttagcctcctggccttgaggcttttaaaagtctaataatctaagattccttattaaaaagttccaataaaactaatctaagaagagcctatatggccaatcgctattcttattacactttatacaaataagcaggccaagtacaataagactaaaatttattttacaaataaattaatcctactatgatttatctttggtaaaaatgggagactagaagaaaaaaatcatgtttcaaataaaactatagcacatctgtttaaattagattctagcctcattaattgttattgttgttattacttctctaatatttagactaaaacctgaattctttcctggctacaagtttccaaactaacattttcaaatttttcttccatttttgactttaagccactgaaagttgaaactgtgcttttcttaaagccctacaaactgaaactagacaacgtaaacttcaggaaaaatcagaagttaaatacaaacagccttcatgcctactgatgtatagaatactcagaaagttcacttcaatgctgatttgaactataatccagtaaaatctgtcagattgccactgcaatctgaagatacctcaaggactctaaaaaactctatacactactccagacattaaccttggttttttcttctgtttccacaaaaacatctcttattaaagatctgtttcccttcatcatacacagaggcctagtgtacctacaatgccaccttctaaaatgggacacaaatgtttaatccattcttaggactatgactaaaaaagatatggggcaatacatttaaatttactcttttctgcttatctagatttgttttttcacttctttgtctatctctgatgacctctggcccaaatggcttttaatatataaaactttatgaagttttaaagtgaggactgaaggaaattaaaatattttaccccaaaatatatttatctgacttatttctcacaggcctctagattaggcctatgagacacaaagtaaattgatacattgaaaaaggccaaaaagaaacttcaaaattatttttctaataaaacgccctttgagagaaccttcaaaattatgtcagcctcttctaggcctaaggatgaagacaggaggttgccttagaaaggattttcctattatttgaagggaaaaaataaaattaagtatcatgtaacaacaaggctagcaggcaacttaggaaagtgtataacaggacgtcatttgaatacagggatccagggaggtggattaatttatgtaagttgcccaaggaacttcagaaatgaaggtgacagagaatccaacccatgctgctcaaaatcagaagttggaaaacctgtaggtatatattagggtatcctaagcaaggctggctatcaagaaaagacaccaacgtcttcaaaaaagaaattatcaagaagcacagaagagtcatgatagctcaaaactaagactgcaattctcaaactttagtatacccgacaattgcctggaaaccctgttaaacataaacatttctaagctttactctagagattctgactgagtctatctgggtaggccttggaatttctactttcaatgagttatcctaagtgattttcccaccatgctgaagagaaaaaggaatgctgaccgaaggatttgcaggggattctcaagcacagaaggaagcttaaagcctcttgtaggaggaatggctgagctaaatgggttataactgggatgctaatgacagaagctgcactgtatcctgtgagacttcgaccctgcaagggtatcagcagattcccatctgtctgcatgtgcaagccatccttcaacagtgataccctgcaccagtatgaagcaagaacagtagtgaactaatcagacaattcagtttttgcctccctgtggagtttgtaagtaaaattaatcaccctggaatgagtaaatccatggagttcttggactactgtgaggagaaacatatatcaaaaggaaagtataaaccttatataagcaagaatgactttatttgtatcccatgttgataatgataaagtacactaagaaatcccaggcaaataggtttacttattaaaattaaacataggctttccggcatcatccgtctccttaactaaaaacatggcctatttctcacattctcgctactcttatgctgaagacgaaagccatccactttgcccttgaggcattcactttacaaaaccaaaacatacctagagctaatttgggggaggggcctaaaactgtctcagccagcccaatccctggcatatagattgtctctagctttctaaaggaattcacacaaattgacctgttacagcttaatttggaattctattcacagcaaacagttcaatttcatgatttgaaaccacagactttctggattttaacccaatctagtctctaaactgagatcaggtgggcaccactctattgagactacaaagataaacagcagagcagtaaaaacttgacctctgaaatctcttccctcactactgagtaatggggcatcagaaaggaagtcacaagggtaatggccctcttttccccaaacgttaaggacctacctctctgggttttgcctttttaaggaagcaggcccacttggctaattcatttggaattcagacaagctgtggcctcttgaatcataaagcactagaatcacaaagtcagatgaaagaggcctcaggcttcaagccaccaactttagctcaatattcaagtcaacttggctctcctggctgaagacaaattagtctgcctcaaataaaatggatcaggaggaaatgagatcattggaaatgtcagacacagctttcaaaagtgagccatttaaggtttggctcaggcataggaaaacccccccaattagcttctggccagcatactttccctacaaaacagccagacctcagtgaggcagagaacacagcagttctcattaggggttaaagggacaggcttatcactaccaagctattaatctgccctgtcagaaatagacctaattctattccttcctctattcagataatacattttccttttcccatgctcttcagagctaagctgcctccaagtagagactatgccctccctgcattcttaaagaatatttcagaaactatcaccacaatttgtcaaactaagacagtatgtgaggaaataacgatttgggtcttaaggccatcaacagactcttatcttaaaggaacaattttcaaataatgcaggtaccaaaagctaacagtatttttctacttaccttaatacagccaactattgtagttgtaagagcagaattatactgcgtgcagagtactgtggcgtacattaagataaacctagaatgaagaaagaggtataaaatccagtttctcactttatactaatctctagccaagataaacaatcagtgttggccaagccagcacattctagtcactgaccagctatgaattttccccacctcactgcttcttatactgcagcttcagaatttttaaaatttcactaaatagaaacacattcatctccttaccaagagtttttctttgctgccctcatcaaaaccctgaaccatctcttacaatcatgactatttttatagatcatgcttcctactaatacacctaagccagccagacagaaagctcagagctcacagaccctaaaatgcagttgtgcaccttccataaggacaacatgtcctctgggccagacgaagacaagagagatccttaaatattgaagaaaaccaaattaaaactactttaagaggggatacaggttcacttaacaactaagtggcagcagttggaactctctgatttacactgaggcttctcagcttaagtaccaaggcatcaggtcaactttattttgaagcacctgctcactgtgtgccagatccagtcacaaatagcaactaaactgactggctgaggaaaaaaaacacattagagaaatatggacatgaggataagaggcacgtttgcaggtatcctcttaacctctacatattctctcctatgaggaagaaaacatggtaaagaggggtcaaactgccccaaattcaaatgctgccactgccacctacaaagtgcgcaaatttagacaatttactaaagttctatctgtcaaatggtcagtatagagataaaactatataatgcatgttgaaatataatggtgcttactaaacagcaggttatcaggtaaattttttcttttcttcatccttctaaggtatcaattcagtagccctaagagcacattcccaagagctatgaaaccacctgaatctggaggcttaattatcctaggctgacacactcaggagacctaaagatattgagaaaagaggcatgcaaatttctctaacctatttctttaggaaaactatctgctaacaaggtaacaaaggcttaccccatcacacaggagagggtgaactgcagaagaaagagggtgtcagcccagccttcaaactccacagcctgcaacacacaagaaagcattaaattttagaccaggccttcaaaatcagctatcccgttttaatgtaaatccttctacgagtctgcctccaacacagacacagacacagacacagacacagacacacacacacacacacacacacacacacacacaggtatatgtttccctgaattactccaaggatagagagtgatgttcaaagatttcatgtatacagagttgaactagtaagtagtttcataagattttctcccatccaaaatgtaacgtggggattttatacttctcactattggtgcaaagaaactggtatttccttgaaggcacaagccacatttggctaatctcagttctttcagatggctattaatgtgctagtactaaaggctttctcaaacattaaaacatgtttcctttctgtaacatgtgaaagcttaaatacagccttagttatacaaattcagctgaggtctattcaaggagaattactgttttaaaacggttcattctaaaaacaaggtattttgtgttgttgttgttgtctgtgttaagccaaaaggaaaggaataaagagaaatgaaagggtacactgatcatctcatctcttgtccaagaggaatggattctcaagtacctagttgtttttgcaataggagtttgataagcaaatgtgacaaacattccacctttttatctctgctaacctgtccagcttcaacttttgctacttccgcataaatctgatggcaccagggctccaacaataccaggctccctgtggcttataaaacataccatacactttcttacttgcatgcctttgcctggaatgtccttcccctcaacattcgtctgactcctgttcagccatcaaattaaaactcaaggctcccttgtggggcccttcctgatcaagtactccttcctttgtgcctcagtactcctctctagagctcttgtctcttcgaactgtaaatctttctataccatgtctacagaatgaactccctgaagggaggacccacatcacatttatctaatcatattcctaacagtgcttgacagacagtttgtttatagttctttgttgaggtagaatacatgaaaaataaattaattttaagtgttcaattcaatgagtagtcacaaatgtataatcatgtaaccaccattacaatcacgataaagaaatcaactccttccaaagttccctcctccccattgagtcaatctcccctccatttctagcccctggcaacctctgatctactttctgttactataacttcgctgttcaacaatttcctacaagtggaattgtatagcatgtactctagtgtcttccttctctttcacttggcattatgctcctaggactcatccatcctatgtatgtatcagtaattcattcatttttattgccaattagtattctatcttatgggtataccacaatttgtttatccaaacaccaggtaattgacacttatttgggttatttccacaagttattatgaacctttgaaccttccgttacaagtctcccaactgacatgtttttatttatcttgggtaaatagctagaaaatgggattgctggttcatttggttaggtgtatctttaacttcgtaagaaactgccaagctgttttccaaagtagctacacaattttgtattctcaccagcactatataagagctcccactgatctatattctcaccaacacttggaactgttacaggccattctaataagtggttaagtgatattttctcattttaatttgcatttccctaaagactatcaatattgagtatcttttaatctttgacattagcatttcttctttggtgaagtgtctgtctaaatcttttgccatttttttttttttttttgagacagagtctcaccctgtcgcgcaggctggagtgtagtggtgtgatctcagctcactacaacctctgcctcctgggttcaagcgattctccttcctccgcctcccgggtagctgggattacaggcacatgccaccacacccggctaatttttgtatttttagtagagacagggtttcaccatgttagccaggctggtcacgaactcctgacttcaagtgatccgcccgccctagcttcccaaagtgctgggattacagaggtacaaaagaggtgcccggcctcttttgccaaatttttattcacattatttgtcttattactgagctgcacgagtttttaaaaatatattctagataaaagtccttaatcacacatatgctatacacacacatacataaaatacaaatattttttcccagtctgtgactcaccttccattttcttttttttttttttaagacagagtctcactatgtcgcccaggctggagtgcagtggcacgaactcggctcactgcaacctccgtctcctgggttcaagtgattctcctgcctcagccttccaactagctgggattacaggtgcatgccaccacacccagctaatttttgtattttttagtagagatggggtttcgccatgttggccaggctggtcctgaactccagacctcaagtgatccgcccgcctcagcctcccaaagtgctgggattacagtcgtgagccaccatgcccagcctcaccttgcattttcttaatagtgtcttttgaagagcaaaaaatgttaatgttgatgtagtctaacatcaatattgtcttttataattcttgcttataactttttaatgaaacctgggtgtaaccaaaagtcaaagatcttctcctatcttttcttctagttttatggttttagcttttacagttaggtctatgaaccttttaacattagtttgctagagctgccataacaaagcaccacaaaactgagtagcttaaatggcagaaatttgttgtctcacagttctggagggtagaactccaagatgaaagtgtctacaggattggctccttctaagaactgagacacaatctttttcttgcctctcccctagcttctagtggtttgttggcaatctttggtatttttttagcttgtagaggtatcaccctgatgtctaacttcatgttcacatggtgttctccctgtgtgcatacctgtgtcctaatttcccaccccgccccccaaccttttttttaagcaaggtcttgctttgtcaaccagtctggagtacagtggcgtgatcatgggtcacagcatccttgaactccgaaacttaaataatccttccacctcagcctcctgaacagctaagactataggtgtgcaccaccatatctggctaatattttttaagttcttttgtagagacagggtcttgctttgttgcccaggttggtctcaaacttctggcctcaagtgatccttccaccacggcctcccaaagcactaggattataggtgtgagccaccctgctggcccttgatttcccttcttagtaagaacaccagtcatattgaattagtgacccaccctactcccgtatgacctgatcctaactaattacacctcaatcatcacatttcaaaataagatttattgtgaggtactaaggattaggacttcaatatatgaatctggaaggggagggacacaatttaacctataacactttcctgattaatgtttgtatattccacaaggtcacagtcaaggttcactattttgcatacagatgtcaaattgttctaccaacatttgctgaagacattatcttttcctcattgatctattttcacacctttgacaaaaatgattgcccacatggtatatttctatttctagattctctgttctgtttcactggtctgtctactcttaatccaatatcacagtgtcttgattactgaagctttataagaagtgttgaaatcaagtagggtaaatcctctaaagctgttatttttgaaaactgatttgactatactaagtcctttgcaattccacataaatttaaaaatctgcttgtcaatatctacaaaaatcttcccatagagttggggtggtgttgaatctatagatgaatttgctaagaactgacaaattatatcaaaccatctaattaataaacataaaaatcacttatttaggtcttttaaaatttatctcactagtgttttgtagttttcagcatacaggtaacatattttgttaaatttatcccccaagtactttataatctgaagctattataagtggtattttttacttagcttccaagtgttcactgctgttttgtggagctacagttaatttttgcatattgaccttgtactgtacaaacttgctaattagttccaatcacttttttctagattctttaagattttctacatatatcatcatgtttttaatacacacagttttgcttcttcctttcaaatctatattatacagatggagttcttcaacataacactgaatagaacactatatgagtacagacatcctcgccttgttctcaaatcttagtgaaaaagtattcagtctttctttcaccattaaatatgtcagcaatagattctttggtagatgtcctttcttatgctgagaaagttcccttctattcctagtttattgagaattttacactcatgagtgggtgtcaccttttgtcaaataggttttctgcatctatttaggatagttctactatattcttgttaatatggtaaactgcactgatcgattttcaaatgttaaattaaccttaattcctgagataaacacaatatggtcatgatatactgcccttttaatatattgctggatttttttgtactgtactttctccccccttgtaatgtttttgtcagattttggcagaaggtaatcctagccatataaaatcaacaaggaagtgttctatcttctattttctggaagaatttatgtagaattattatttcttccttaaattttttgtcaaattctccagtgaagcaatcagggcctgaaattttattttgaggaaagtttttaactacaaattcaatttctttaacataaatagggctataatagccctattattaattaaggcttatgattaatttcaattaaacagacctatttaattactgtattagtctcttctcatgctgctataaaggaatacctgagactgggtaatttataaaagaaagaggtttaattgactcacagctccgcatggctggggaggcctcaggaaacttacaatcatggcagaaggcacctcttcacagggtggcaagaatgagtgcccagcaaagggggaagacccttataaaatcatcagatctcgtaagaactcactatcacaagaacaagatgaggaaactgccccccatgattcaattatctccacctggtccctcccacgacacatggggaatatgggaactacaattcaagatgagatttgggtggggacacagcaaaaccatatcaattacttaacagagtagagttattcatacattacctatttcttcttgagtgagctttggtacatagtttgtcttttccaagaatctattttgtctcagttgtcaagtttattggcataatattgttcataatattctcttactattcttttaaaatatacctgctctgtaatgaggtccttctttaatttctgatattgataatttatgtaaactcactttttggcctgattaattggctatgaattagcaattttattaatcttttttaaaaaaaatcttagcttttagtttcattggttttcattgcattgatttctattcttatcttacaatcttacatttcttatgtttattttggatttaattttctagtttcctttttttattcttccttcttaaaagacaggtctcactatattgcccaggctggccgtgaactcctgacctcaagtaatcttcctacctcaggctcccaaagcattggaattacaggcatgagccacctcatcccagctactttcttaagacagaggcttagatcactcattttagatctttcttcttttctaaaataagcatttagggatttaatttatataattaattttatgggtttccctctatatactgttttggctgcattccagaaattttcctatgttgtagtttttttgttttttgagacagacacaaaaacaaccagggtctgttgccgaggctggagtgcagaggtgctatcttggctcactgcaatctctgcctcctggattcaagtgattctcgtgcttcagtatcccacgtagctaggattacaggtgtgagccaccatgcctggctaatttttgtatttttagtagacacgaggttttgccatgttgaccaggttggtctcaaactcctgacctcaagtgatccacctatctcagcctctcaaaatgctgggattgcaggagtgagccaccacacccagccactatgttgtgctttgattttcattgttcaaaatattttctgattttctttgtgatttttctttgtctatgaattatttagaggtgtgctaatttgcaaatatttggggattttccaaatatctttatgccattaatttctaccttaatattgttctggtcagggaatatactttgtatggtttcaattcttttaaactattaagactcattttatggcccagaatatagtttatcttggtatatacccaatgtgcacttgaaaagaatgtgtacgctgctgttgttgagtggattgttctttaatgtcaagtagatcaagcttgttgacagtattatccaagtcttctatactttactgacttccagtttcactgttttatcaattactgagttaaaaatattaagatcccaattgtaattgtgggttggtctatttctcctttctgttctatcagtttttacttcatatattttggagctctctcatcaagaatatatacacttaggaccattatatccttttgaggaattaacccattttatcattatgaaatgttcctctttatggtacagtttcctttacattctgtgtttactgagctccttgtgtgtgtgcctttaaagttttcatcaaatttgcagaaaaaaaatttctactcccacccttcatagacttcttgatattgccccacaggtcactaatattgtgttcatttgctttacaatcttttttcctctatacgcttcatcttggacagtttccattactgtctttaattcactgatcttttctcctaatctgctgtttcattccttccactttatttttcaattcagatatttttcatccctaaaagttccaattgagtcttttgttatagctttcttttctcttctcatcctttcttaacaatccttcacagcctgtcatccaaagactgaaaaatgttgtttgataaatgtttgattttctagtaccttaatgtaggaaggtaaaccctgtccgtgttattccatcatggctaggaaatgaaagaccacattcagttcctgatttgaattataaacctgtaccaaatgatgcttccactaggaagctttcacaaaaacctaagttgcacattagtatctttcctgccaaactcaagagaagactaaatgctacttttatcaggttccttactaagtatgtgtacatatatggacatctttatgtacatgactatctctccagacagacattgcaaataccttgatgatttatctctgtatccatggtatttaacaaagtgatcagaaaatagtaggtgtttaataactgtttactggatgaatggaagacatgagaactcatgcatacaatctcatgctacgctccttcatacctgtaaacacaacctcctctctgatgaaaaatcagtaacgcacaataaactggcctacgactcaggagaccagcttctgctagcaagactgtaagttccttgggagcaggaaatgtgtcacatgtcatttctgcagagttccatgcacttagaagtgctaagcacaaatactagtggcagtagattaaacatccatgatctgtggcccagcatcattttctacacacagatgaggtgaactttgcttttgttttaatccctgaccccctctgaactttgctttttaatacacccacacacctgcttgtacatgctactaactgtatttaagttgaatgttaaatctacataatttgtttttaaaaaaagttttatttcacatttatctgaaactggaccagaatctcaagtatgtttacattttaattgttcacattttaactgtttcttacactatcagtttgccctgtttcctgcgccccacgccccaagctttattaaggtatagttaacaaaatatataattttaacttttcttctaataattaaaggtcatttgaactgcatgtaactcattagctttgcactaagttttttttttttttctttgaacagacaaggcataacccagtaagccatcaattaggcaatggaaaggttacgcataccctgcaagaaaagccattgtacctagaaaagtaggtggaccaggattcagaagcctggtgtcttgtaccacctcaccactgcttcattatgctagactgagcttctgtaaaggagaactgcatgggtattaaggcttcttccagttgtgacaggagtattagatcagcttgaaaagtagagagtttattttacccaagctaaaacacataaaagaaatctcagccctaaaacctttcctccagctctaaattatcttcctttcctggctaagctattcttttatcccaaagtcattaagaatacagaataagttgttgtaagggacaatgataattctctgaaccttagtttctacatatgtaaaaagaggaataataaggcctcatctacagggttgttatcagaattacaaaaaatatatatatggatacaatcactgacatggagggaatctggctcaataaatgatgtcagctactatatataatcattacttttaatttttttttttatcagtgacctaatcagtggttcagtaatcagaattatttggcaaagacctcaaataaacctctcataaacctaagtttcttctctcctctagctctaaatatctcctctgctttcggtgtacaattctgacatctattaagtcccatgtgccaggccccaggcaggatttgaggcacaatgctaaagatggtttaatcaggcttcctgataatcaagcagcaaatgattaaaaaagtgctgccatacatttttggagtgccttatggtttaccaagtgcttctgcatgtatcatgtcatttgattgccatgacaacctgtgggacagaaaggccagatcttcttatacccagaagacgggtaacttactttaggtcacacaggttatatacggtaaacatgagtctacatatgctaagccccaaggctgtctacactgaatgttacatttgattcagaaaaatgccccaaatatatactgcacagtctcctttggggacataataatgatatctgcaggacattaaaataaatctcatggatatggttccattcagataaaaatcaaaaacagaaaaataattctcatgggactttttttttatttctctaagtatttggcctgtctctggagaaagtcagtctatggcacaagcacgctgttgcattcctctgcttcgccacaggaatagatctttggctgcaacaaaagcagcagcagccatttgaaagtacagctgtaggaaaaacagaaccctggcagtccctacagtgcaaaggagcccattctccctgccataaagacagcattaaaaaaaaataaaaactactgcttattaagtgcctattatgtaccaggctcagaaacattcagtaacttttccaaaattatctagctagtaagtacctgttcagctccataacctatagtctttccatctgtactgccgcaaaaaaaaacaaaggcaaggcaacaacatgttctcaatttttttttcctttatggctccacgtggttaccaatcagtgagtcaaatagcaggagttctaattctaactgccattaactttccatgtggccatcatagttatttaacatcagtgagcctctacctatgttatgaatgtagaaaacagtctgctctatctgcctcctgtgaggatcaactgagagactaaaatgcagtcactttaaatgtagacagaatttacatacagaagaaattattcgcttaaacttccaccagttatctcctggtggtagatttgcaagcgaattttttattctccctaagataggaaatagaaggcatggtgaacatacattttgttaatcaggaaaaaaacaaaacatttaaaatgaaacaaaacttctgcttctagagaaagctctgataaagagccattgtgaagagaatgacctacctggtcattctgtgtgtgacacagaactaaacaggctctctgccacaaggcctggaatcttcggtcttggctgactggtagctgtgattacagatttaataaacaaagatgcttcttaggctttccttctgttttgaataaagtctttagcgctacaggtgccagtataatgtaaataccccaggagtgaaaacaatgtcccataatcaacgggagacagcaaatgttatatggacctaccactacctataactacgcttttattttttttaaatttgtttaattgttatttttaaataacatggtaggtatatatttatgggttatttgaggctattttgatacaggcatgcaatgtgtaataatcacatcatgggctgggctcggtggctcacacctataatcccagcactttgggaggccgaagtaggcggatcacctaaggtcaggagttcaagatcagcttgaccaacacggagaaaccctatctctacgaaaaatacaaaaattagctgggcgtggtggcgtgcacctgtaatcccagctactcaggaggctgaggcaagagaataacttgaacccaggaggcagaggttgcagtgagccgagatcgcaccattgcactccagcctgggcaagaagagtaaaactccgtctcaaaataataacaataatcaccatcatcacatcagggtaaatggggtatccatcccctcaagcatttatcctttgtattacaaacaatccaattatactcttttagctatattttgaaatgaacaattatcttgttgtgctaccaaatactagttcttattcattttttctaaccattttttgtatctcttaacccttccagctttcctcacccccctactacccttgccagcctctggtaaaccacctactttctatctccatcagatcaattgttttaatgtttagttcccataaataaatgagaacacgtgaagtttgtttttctgtgcctgccttatttccttaacataatgacctccagttccatccatgttgttgcaaatttcagcatctccttttttttatggctgaattgtactccattgtttatatgtaccacattttctttatccattcattcgctgatggacactcgagttgcttccaaatcttggtgaatagtgctacaaaataggggtatctcctcaatatactgatttcctttcttttgggttttacccagcagtgggattgctagattgtatggtagctgtatttttagttttttgaggaacctccaaactgttctccatagtgcttatactaatttagattcccaccaagagtgtatgagggttcccttttattcacatccttgccagcatttgttattgcctgacttttggttaaaaacctttttaactaaggtgagatgatatctcattgtagttttggtttgcatttctctgatgatcaacaatgtttagcactttttgtatatgactgtttgccatctgtatgtcttcttttgagaaatgtctactcagatcttttgccaattattttaatcagattactagattttttcctatagagctgtttttcaaatatttacaaatattttctcccattctgtgggttgtctcttgactgttgttttcttcactgtgcagaagctttttaacttgatgtgattccctctgtccatttttactttggttgtctgtgcttgtggggtattactaagaaatccttgcccagtccaatatgctggagagtttccccaatattttcttctactagtttcatactttgaagttttagataagtctttaatccattatgatttgatttttgtccaaggcaggagatagggatctagcgtcattttttgcatatgtacacccggctttccctgaaccatacactgaagagactgtcccttccccagtgtatgttcttggcaccattgtcaaaaattagtttactgtagatgtatggatttagttctgtgttctattcagacacatagatttcactgatctatatgtctgtttttatgacagtaccatgctgttttggttactatagctctgtagtataatttgaagtcaggtaatgtgattcctccagttttgttctctttgcttaggatggctttggctattctgggtcttttgtggttccacataaattttaggatatttttttctacttctgtgaagaatttcactggtattttgacaggggttgaattaaatctgtagattgcttcaggcagcatgaacattttaacaatattgatttttccaatccatgaacatggaatagctttccattttcttgtgtccttttcaatttcttgcatcagtgttttatggctttcactgtaaagacttttcacttctttggttaattttaagttaaagtattttatttcatttgtagctattataaatgtaattactttcttgatttccttttcaaatcgtttgctatagccatatggaaatgccactgatttttgtatgttgattttgtatcctgcaattttagtgaatttatcagttctaatagttttttggtagagtctttaggtttttctaagtacatgatcatatcatctgcaaaccaggataatttgacttctttttcaatctggatgccctttctttctcttgtctgattgatttagctaggacttccagtattacactgagtaacagtggtgaaagtgggcatccttgttgtgttctgatcttagaaaaaaggctttccatttttccctattcagtatgatactacccattcatctgtcatatattgtttttccttctatactcagttttttgaggatttttatcatgaagggattttgaattttatcaaatgttttttccaccatcaatcaatcgaaatgatcatttggttgttgtccttcattctgttgatatgatgtattacattaattgatttgtgtatcctgaaccatccttgcatccctaggataaatcccacttggtcatgatgaatgatctttttaatttgttgttgaatttggtttgctagtatttttgttgaggatttctccactactattcatcagtgacattggcctacagttctgtgttgtgtgtgtgtgtgcgcgcgtgtgtgtgtgtttaatgcatctttgtctgattttggtatcagggtaacactggccttgtagaatgaatttggaagtatgccctcctcctctattttttggaatagtttcagtaagattggcattagttcttctttaaatgtttcgtagaattcagtagtgaagccatatccaggctttcctttgcttggagagtttttattacagctttgatctcattccttgttactggtctgttcaggttttggatttctacatgattcaatcttggtaggttgtatgtgtccagcatttatccatttgtttcagcttttccaatctattggcacacagttgctcatagtagccaataatgatcttttgaatttctgtggtatcagttgtaacgtctcctttttcagctctgatattatttatttgggtcttctctctttttttcttagtctggctaaaggtttgtcaattttttcatttcagaaaaccaactttttgtttcattaatcttttgtattgttttcttcatttcaaattcatttatttctgccctgatttttattatttcttttcttctactaattttgggtttggaacccaaaagaacttgcttttctagttctttaagatgtatcattaggttgtttatttgaagtttttcttttttttttttttttgatgtaggcatttacagttgtaaacttatcctctcagtactgtttttgctgtataccataagttttggttttccattatcatttgtttcaaaaaattttttaatttccatcttaatttcttcattaacccatttgtcattcaggaacatattgtttaatttccatgtattcaaaaatccctcgttattaacttctagctttattccattgtggtcagagaagatgctggatattatttcaattttttgaatgttttaagacttgtcttgtgacctaacatatggtctatccttgagaaggatccatgtgctgggaaaaagaatgtgtatcctgcagccactggacgaaatgttccgtaaatatctattagacccatttggtctacagtgcagattaaatccaatgtttctttgttgactttctgtctgaaagatctgtccaatgctgaaactggggtgttgtagtttccagctattactgtattgggatctatctctctctttagcactagtagtatttgttttatatatcggtgcattcttgcatcagtgttttatagttttcactgtagagatctttcatttatttggttaatttaagttaatgtatattaacttaaaatatatccgggtgttccagtgttgggtgcatatatatttacaactgttatatcctcttgctcaatttacccctttatcattatatagtgaccttctttgtgtcttacagtttttatcttaaaatgtatactgtctgacgtaagtatagctacttctgctcttttttggtctccattggcatgtaatatatttttccatccctttattttcagtctatgtgaatctttacaagtgaagtgtgtgtcttgtaagcaacagatcactgggtctttttttttttttctttttttatccatttagctactgtatgtcttttgattggagagtttagtccatttacattcaatattattactgttaagtaaggatttgctcctgcccactttgttctggtagttctgtggtcttctcttccttctttccttccttcctgtcttccttttagtgaaggtgattttctgtggtggtataatttcatttcttgcttttcattttttatctatctgttgtatgcttttttatttgacattaccatgaggcttgcaaacacaacctaataacccagtattttaagctgacaacaacttaacactgtgtgcataaacaaacaagcaaaaagaaaactaataagaactctacaccttaatttcatcccctcactttttaactttctattgtttctcttgatatcttattgtactgtcaatgtgttgaaaagttgttgtaggtattatttttgatgggttcatctttttgtctttatatgtaaaataagagtagtttacataccacagtcacagtgtataagtagatattttgttgaaaacttttagttaaataaaaatatttgaaaaaatttttaattttaaaaatgtgggtttttttgttgcctaggttaaggaaattaagagagaaagggagtatgtgagtaagattagcacaaaaactacacaatcaatacaaaggctaaactctcatccagggatgcaatcagattttgtcttttgtaccagctctgatcaactgattctggctgtctagactcctgtcttggtaaacagtctcaggctatgtgtaagcatagcaagaaaatattgtgactacttggtaatgtctacaatgagcacaggataacttagcaccaatttacaatttaccaaccctaatctagtcagaagtatggaaaagtttcaatgtccacttgaggcaaccattccccatttctgaatcatcaattcatttgaaatctgaactaaaatccaaagtgtgacagatattttcttagtgttttgacacatctctgtttaccatgaagtctaaaaataaaccactgagtttgcatgtcatggtaaagaaaaaagattaataaatgatattctattcctgaaaattctttccctgaaaaattactaagaaaaaaattgaatccttatctgaaagtaaactgttaggaaacttgctaaggcagaaagaagataatgtcagtggtgccacctatataaaataaaacctacagatcatgtcaaaactacacattccagcttgccaagtaggtcacttgctcttatttaaaaagagatatctcagaggtaagaatggttagaaacataacagtgtcagtcaaataatatactggcaaagagaaagttctattcattcataactaaagaataattgatccaacccacctgttttacatatgggaacaccaaggcccagaaaacagaaggaatctgtctctatgtggtgagaataattcagagtctgaaaatcaatctgtgtggtccacagagcaatccagaaaagatgaataactctaaacaggctaacttaacagcctaaaatttcttcattatttagtcagcaatgcttagtatgagacacttccaggcagacaatttgtgcagcaacctttcctataactcccctaaaccatgtaatttagccagtgatataatggagacattatacagcgtaccacagaactagccttgtgagatctacagcaagtggtctgttcttccatctctatgtaagaacacctagcagggtgtgctgccagaaagccaagctccaactcctgtgactgaatcactggctttgtactaaaaaaaaaatcccatctggaggtagcaattagtaagtttaaacacaatctgtactgatgctttggaaagtcattggtcaaatgatgtccactctgcctttatctatgttaactaggtatcttttattaacagtaagctggtttttgcatgaggcatagtttaaaaaaatgtttttaagttagaagatacatgttttaaaaactaagtgctgaatatatttatttgttccttggtttctggtaaacccagaactttgagaaccttggataaactttaaatatgtatacacacacacacacacacaaacacacacacaactagtttggtttctcaaaatgctttgccaagaccttgcattatgtgctcactgggacgagtttttcaactggaactttcctttacattcttatggtaatatatttcgtttttttcatcgttggcctccaactcttgcttaaaggctgtatcaaccccatcaactgctgtatccaactcctgtctctctggggagctggcctttcagagcccccttgttggattcttgtcctaacaaagggaagttttccctcttctgcctactaaatttaacagtgagactttcagaataatttgcatcgattttgcttcaaactgcaatgtgggtcaagagtctgcaacttaggataataaaaaactgacttgccatgtccccagttattttcaaatttagggttaatcacaggatagtagtcatttatataaaaactatcttttccttattgttcctttgatatagtttttaaatacgtttatgtggtcctataatcaaaaaaatatagaaagatgaatagtttgagaagtctccctcccattcctgttctacttaccctgttcccacaatatgcacaaaaatttattagtttcatgtatatttttccagactttatttaaataagtgaaaaaattgtgtgtgtgtgtgtgtgtgtgtgtgtgcgcgcgtggggggtattcttatttttctttttattttacccaaaaggtaggatatcatatgcaccattttgcactgtgctttttcatttaaccatttatcttggagatcttttaattcaatacatagaaagtttccattcaaagtggcccccattcaaagtgggtcaggaaagtctgaagtccaacaaatgagagcagtttatcagcactgattataggggagtagtgggctcatgccagctgtgagaatagctgcctgtttccacaatgacatggcttttactcctcagaaactctgtctcaaccccagaaagggctgtacctagagactcattttacaaatgataaagctaggtgggagagcagaagggatttatccaaagtcagatggtggtcaggcacagaactggaggtggctagttttctgcattctgagagccctaaattctccccactgtaccacttacatcacaatttttttttttttttttgagacacagtcttgctttgtcacccaggctggagtgcagtggcacaatcatggctcactgcagcctcgacctcctgggctcaagcgatcctcccacctcagcctccccagtagctgggactacagacacacccgaccatttgtgctaatttttttggaattttttgtagagatggagttttgccatgttgcccaggctggtcttgaattcctaggctcaagcaatctgctcacaactccccaagggctaggattataggcgggagccactgcacccagccctttgtcacaaacttttaaggacttgtcactacctgcagagtaaatgtcaaattcttgtgtctagcattggtcctaatttagaaggaatcagggtgtgatatggtgggaatggtaataacacctgcttagaacttaaaaatctaggttctagtcctctctggggcccagtttccccaactatgaaataagaggctcaaaccagatgctctctaaggtctctgctaatgtttctaaggtctttgacttctaccttctaatttgaagagtctggtctttgcaggtatgcctgagctcatgctgttagttctatctggaatgtaccttttgtttctcttcctccgcattcttcaaggcccactttgacttttcctggtatttgcccatttaaaaaatgctaagcactctcacctcaggacttggaacctgctcttccttgacctagattactctccctccaaagggccatacaaattgctctcttagtccatttggttcaatgtctgctaaaagaaactttatatattccctaagcaaattaattcttccaactttctcagatttgcctcaagatttagaaccatatatcacaccatattcttgtcccaaagctcgagagtgaggggtgcttctgctagtcgctagtctgctccaaagcacacagcctttggagtcaggcttgggtttaaatcttgactccactattccccaatagtatgacactggacaagtttcttagtctctctgaacctctccttccacattagtaaaataggtataattaaaattttcttgactgttataaaaactacattatattaaatatacaaagtgactaacacataatagggattcaataaatgttagtttcttgtcccattttttttcacagccacaaaatacttatttaatactctttattagagaaatagccgtttcctactttggtgtcatttttaggcctgctggcaggtaggtcacagttcattaaaacatttacacgtatattcaagatgacctgtaccagttctttaaaagaagaggtatgatggggggtgggaaacagcttcataagctgtcagtctccagcctttggttcaagaacaatttaatagtccaacagcttttaaaaatctcttttattttagctcccacaaacttgtaaaaatcacggtctttagagtaaatgaccaacatacttattctgaagaagttactagccaggggaatcattagaaggaatcttggtacagaaatccttgccataattctggatttccatttagtttgcagaattttgtgaattctgacaatatgttatcaatttgtctcctacacgggcttgttttaaagaaaaattcttctccagatttattttactactctatgctgtatttatttagctagacatttgcagaaaattggtaaactactatattagttgttctttataaggttaagttgccacacaatgctaaatatctcctgagaaaaaaaaaacaagttgggagttaaaccaggatgacaactgtacactaaaactgagaacttctagcaatgcctagcattttgtttaggatttggagaattttactatttcaagatttttgtttctcaaggatagtttactactattcctattttatagtttagcagaaatgtaaaaattcccttcctctatccttctggcatgtaagaaaaagacactagctggcaagcactatttttatgttgacagcagagctattttgagtcatctttgtactatccaatgtttacgccaagaaaagaggttagcatgacattagcaatttaaagagtaaatgctcagtttttggtcacttaataagcatatttcttttgaacaacaaagcctatcttttcatcataaataataatgcagttcatcaacgtaagccattaaaccgtaattagaaagtcctaccttttgtgcatctcctgtgaaatacgcaatggccagggtgggcagaatcatgaacagtgcattgtaatagagcagtccatattttcccagctcctaggacagtaaataattaggtgtttcatctgcgttttgttctagcagatacaacactgtacaaaataccactcaaactacacataaatacacaaacacacacaccctcccctacaacatacacagcaaatgaattaagttagaagttttgcaaacattaagaaataatctaaactttcaagaccaaataaagcaaacttacaaaattttatacttacttgaaataaattcctcaagtgcttaagatcagagaaataaaaatgactactggctgcctcaaaatagcaagtagaaaagaggttattttgaacacatacacacacacacaaacacacacacagcaatatcaaaacatctctctgaagccattctctttctagaactgaatcaagactgagtatgtcttgggcttttcagaagcctagcacagtgtcatttaagaaagatggatgaggccggatacggtggctcacacctgtaaacttagcactttgggaggctgaggcggacagattgcttgagcccaggagttcaagaccagcatgggcaacatggtgaaacactgtctctacaaaaaatacaaaaacagccaggcgcggtggctcacgcctgtaatcccagcactttgggaggctgaggcaggcagatcacctgaggtcagcagttcaagaccagcctggccaacatagtgaaactgtctctacaaaaatacaaaaattagccgggcatgatggtgggtgcctgtaatcccagctacttgggaggctgaggcgggagaatcgcttgaactcaggaggtggagatgcagtgagccaagatcgcaccattgcactttagcctggatgacagagtgagacactccatctcaaaaaaaaaaacaaaaaaacctagccgagcatggtggcacgttcctgtaaatcccagctactggggaggctgatgtgggtggaactcttgagcctgggagttcaaggctgcagtgagccaagaacgagattgtgcccctgtactccaacctgggtaacagagcaagaacctatcttaaattaaaaagaaaaaaaaattagccaggaatggtggtgtgcacctgtagtcccagctactcaggagactgaggtgggaggatcccttgaacccaggaatccaagggaggctgcagtgagctctgattgtgccactgcattccaacttcggcaccagagcaagaccctggctcaaaaacaaaacaaacaaaaagcacaaagcaaacaaacaaaaaaagatggccagattcagacatgcagactcaggcctagaccaataccaacagacagcacttctcagtgaagtatttccgaaaacgtgtacatgaagtaaaatgaagattaagattactataactacagctcccagaacacaatatgacttactgggttcttagctactagggagcaacaaaggataacacacatcttcaaacacagggagcctataagaactctgagtccacctttgattcacacacttctgggacattcagcatgaagcagtctcctgaaaatgcaggccagggtttgagaggtgggaagtggggacagtgagggagtggtaaggatgggggcataacacttgcctaactcctgcgattgaaagattactgactgatgagaaaagtcgaactgccttctcaaaagcagcactgaaaaattggaaataaatacccaacaattgaaaactagctgattaggctgggtgcagtggctcatgcctgtcatctcagcatttggggaggccaagacaggcggatcgcctgaggtcaggaatttgagaccagcctggccaacatagagtaaccccgtctctactaaaaatacaaaaattagcctggcgtggtggtgcacacctgtaatcccagctattcaagaggctgaggcacaagaatcacttgaacccaggagacacaggctgcagtaagctgatgtgccactgcactccaggctgggcgacagagtgagactccatctgaaaaaaaaaaaaaaaaccccgaaggaaaactagctgattagatgattagactataactagctatacaatgaaacattacacagccactaaaaatgtttaatgatgctgattgacattaaaaaggtgttcaagaaatggtactaagtgaaaaatacaagttagaaactatatcatcccttttttgcttaaaattttaacatacagataagtgtgcacacacatacacatacaaaataaaggatatccaccaaaacagtgcttctcactcgatgatagtattaagggagatttatgttttcttcctcttgcttatccatgttttctactacttctatcataaacatgcattattttatgtaatattttaaagttaaaaagttttaaattcgatagccacattcaggtctaaaatgcagcacaaaatctttatgccatatgactcatactcaatggactataattgtaagcagcctgatattatcagtaataaaactcctgattggctgccctgcctatggagtagccattcttttgtttctctacttctaaaaacaaaagaaaacaagaaaactccggatgtattaaaaagcacctcagcatggccgtactgccttactgcctctgggataaaccaagtaactgattgcttatggtcaccacaagcatcagtgtaaaggtgtgcctcatgtgtacggcagcaaaaaaaaaagccatactgggacaacctttaagaagggtgcccagtcagccagagacatgagtgttatccaggaagtagaggatatgcatggaggcacacatacacacaaatacacatcatccagtaactgacaaacagcaagaacttaaatgccaaaacttctgtttttctttatacattttaattgttttgaatgtctttctccctgccttcttaaagtacactgactgaaactagatttagggcatcatcataaacatgtattattacatcttatgatacactgttacgcatcataaatctgtattattatgtttatgtattatgttcttattcagtgttgcccttacggctgtttaatagaccctgtatctttttcttcttctccagtatttctgtcttttacaatctgactgtttctcttgttagctgaccttttatactgctggtaaacctctctgcctctaaatagaattctaccttctagtttgttgcttataagatatgagctaggagaagtaatcaatgaacttaaaagttctagtataaataagtcatagtgatttctaagtgagaaactgaagggctctcctaggaataaaacactcagaaactttgattttttttctagattctaggatatactatagattgtactaatatggtagccactagccacatgtagctatttcaatttaattataatcacataaaactactgatttcagtttctcagttattttcaagtgctcaagggccatgcatggctaatgaccagttaatggaaagcagaaatataaatttccaatgtcacagaaaattctattaacagtgatgttttagacaactgaagctgctggacaaataaaatgtcattaatagtatctattttccaaagcagcaaatgggctgaagaaaagagtaagatcaatcactaactgctaccttttctctagctattttaaaaagataaaaattcttactagtagcttccattaaaatgtaaccatcatatagattcatcaaagcaaataaatggaggccaagacatgcatatttaaagaaaatggattggaaacaaatcaacaccgtccttggttcttcaagcctattccaaaaacaaaaacaaaacaaaaaaaaataaactatctgcaaaataatgaaacctactgggatagacattgaatctacacttcttttctagaggagcaggcaaagcccctggccaaggcaagatcaattcaatactaatagtactatcaagcaggtaggacacttgtatttatttattatctaagctcccaaaaaggaacttaagtagtttcagaaacattctacacataatagaaaagactaaaaactaagcagttaaagtcatctgactaaagagaaaatatgggtaggaaaataagataaagtcatggtcagttacaagatgtaattatgagataaaaatgtaccagctgctcaggaaaaactatggtgacatctaagataagtatctcatatgagtcctcatataggatacattatgatatcaaggacaattccttcaattagccaccctaggatatataaagttgagatccatttaggtgtttcttacagtaatgtaatctcataacgtaatgttgcaaaagcaatatgattcaaatactcagctttctaataatctggcttgatctaaaaataatatatttaaagtatatagtaaacaaataaacaatatctggtaaagccaaggccaggaaacactgtgttgcccctaagagagacagagatactaatgctccctaaaatttcccattatttatagggcaaatacataaaggccatttttgttttgcagccccttccaacattcatttcccttcaagtctgcccaaaggtttccaagtagttctctttctgcctcccaggtccctcggaaagtcctctagaatacagccatgaacatttaaagacactgcagtgaacacactttactttccctaccccacacgaagtcaaaattcacgcaatcccagaaaagcctggaataaaacctaattgctaattaattaaaaaataaagtttcttatatgaacactaaagtacaggaattttaccctcagagagccactatgtctttctcatccccagtaagaactttctttattccccactttttctcctatgaattgacatgccaacatcagtacacaactgttaaagctttagattgctacttacttttgaatctaatttttgttttacgtatgcaccatttgctgctgttaggacatcgtttatcagaataaaagcatatccttccagatcaaatgccaagtcagagctgcaaaacataagcaacactttaagaacaacttaaagaacatgcatttaattttaaatagatataagctaaaatatttacaagaacatattctcatctagggaagtgaatattaggcattttatcagctactagtatttcttgatttctggtcatagtttgcaatttcacctcaataagggattcctcagaaataagaggcactaacatttaaacacataattagcaacggtcattcatgtcatttaatagcacaccgctctgcattcaaagccagatgacaacaagcaccaaattaccattaagtacatctgtgaagcaggcagaagcaggcagagctcaatttcatagacaagaaaaccaaaaggatgaggccattaacaagtcattttctgaaggtccacatgaaaggtaggactatcttgcataggtagttgggcccctgggtgaaatttctgaagtgtggatcatggttagttctgagatcaagctagaacaatgtctaagcacatagcaggaactcaaatacttaaacaatagctcaatgaacctgtgaagtataacttgggggtttagggaaactgaaaatttctggaacttagagtaccaggcacgagataagaatttagtaaattaaacagaataaatgaaaatctgagaaaggtatgccttcagcatacttcagcaccctagctaaaatagtggctgcacagactctgattttgcagagatactgtataggagccaagacttatctaatgagttctatgccactgcaattttaggcaggactaacttaatgcacactccctaccccaagcagtctaacaaccttctgactgacttcagaggtctgagttcccttcctttcaatctttttccaagtcaaagggtctaaccagataaggctggtccagacagtaatccttttcagaagtttttgtagacacaagaaagccctgaggaacccctgttgtttggtacaattttgggtcccatcagcttcaaggaaatgtttcaaagactagcagggcacctctaaaaagaaaggtaggaggctagcatagaatttttctccaaggggggaatatgacatagaaggaaaagcagttagctatatagccaatttctagtaaccaattacgccactctcttttttttagaatgaaattttacttggagattggacttgtaaaacaggactggactgataatattttcttccacctatactacaggaatgtgatgaaggtaaatgagtcaattcaagaagtacactggaactcctggatggaaaacatatgtctggcagaatgtgtggcattagtaaatacatatatgcatgccctgggctgattaaaatgttgtagaagacttctagcatcattataattttctaggtctgtgggtatacattttcctcatgtattttaaaactaaaacttaagaaaaatgggaaaagctttaataacctaatagaatatctaagttatggcatttgtgacatatcttatgtgaggccaattaaagcaatgttattgttcattattcgaaaaggcaagcaaatgtttcatagtcattttcctcacctcacagaagaggagacatgcttttctttagcagcatgcaaaattaaggaacgccaggccaggcgcggtggctcacgcctgtaatcccagcactttgggaggccaaggcaggcggatcacgaggtcaggagatcgagaccatcctggctaacatggtgaaactccgtgtctactaagaatacaaaaaattagctgggtgtggtggcagacacctgtagtcccagctactcgggaggctgaggcaggagaatggcgtaaacctgggaggcggagcttgcagtgagccgagagcccactactggactccagcctgggcgacagagcaagactccgtctcaaaaaaaaaaaaaagaaatgccacatggtttataaaaacacacaggctctgaagaaagccacagattcaaatttcagctctgccattagctctgtgaccttaagtaagttattgaacttaagttttagtttcttcaactataaaataggaaaattatacccatacctctcagaggtgttgtgaagaatacataataagatgtgtaaaatgccaaacatattgtgtggcacatgctatgtgctcagcacaacgacagtaacaaattctaaattacatcaatttaaattttaacaatcccaagaatcttatttttgtcaacctttatcttaatacagccaaaaagatttaaccttttcaagagtcttctagatgcttttcaaagatataattcttatttaggcaataaaaaattgttattgataagcaatcatttattatcaataattattgacaatttataatgtgctagtcataggcccacatcttacctggcagctacaaaggctccaataatcattgcaaatacagtcattttaataccccaagaaaaagtcttcctacaaaacaaaaaattttaaaatacacacatgactttattcccacactcattttacaacagaagcaaaaaatgggatatgctttctcaaaagctataaacaatcgtattttaaacatttctgagaaactgatatttaaaagaacccctttgataaagcaaaaatttattgttatataagttattacacccacttttaaaattttcacctattgtcattattagtgagtttgaatttttgtgaagcagaatttctttaacagaaaaatgtcacattcatttggagctagacatgaacactatttaaaacctatacctatgattctgatccagcttctcccggtggcagtagtacagaaattctagaaagtaaatctcacgttcagataagattttcaactctaattcataaccttcccaactaccactcccacaaactatcaattccagcagccaagagagagggttgcttaaacttctcaaaaggtaaggtaggaacaagacaaataatttaatatctcacatatgctgggcaccttttcaaggtgatttaaagaacagatatattagaaacttagctcacttgagtaaaactccttcagcaaacattgtaaacaggatggagaaccttctcagaactgtaaacattggcaagctggaaaaaaaaaagataattaggtaaaatagaatttaacaatttgttttaaactaagattttccaaattggtagttaaaataatgctattcttccattatggaaattccatacaaattaatttatggttaaacccctgcttctctctagaagcaattcctacttgaaagcctacaacagttgcttttaaaaaactactagaagtgagaaacattaaattaactacaaaactttattctaattatgcaaaaccctaagctgtaaatatgtcagtttttaatagaaaaaggcttccttctcattttttcactagtctgacctcccttcccaccccctagaccacccaaaaaccatctatgaaaatcttaccccatgaaatgccttgactgtccttttgtggatgtaattttgtcttcatctaaattcccagagcattttgcttgtactaatcaaacatacagcctcttgcaatatagttatttctgaatatatcttatctcactccaaagtgccttatacttagctggcaatcaaagataggtgtgaatgaatggttggatgagatggatgaaaaaaagcaaactctacacaagcagcactttgcagaaggcctgcatttctttcctggtgggtaatgaaatggaaaaaaatgtcccacccatgataaatctgacttccttggaaccctcttcagagatatcatctcggtcattctgtcaggtttctcgggttttaaaggaagaaatgaaaaacaccttgtccttgatgctcaaaaatctctccattctattttacaatgccagggttttagcttgtgtggtagtggtgaagccatggggtttctgttaaatgttttctctatttgtgtcattttaataccacacacaaccgatatgtacactacaataagagcagaagccagaaaccgggaggttagagggaaagacagtgttaccatggagaggagagctattgcttctttctgaaaataagtatgttgcctctacagttacatgccatgtgtaagatattaataatatttttatcagggttctagctgatgttaccttacttcacattaaaagaaaaactgcaaaagttcttgtgcctaccctctaattttgctgtgtggaagttgcctaaaatatttatgaactatactaaagaactgaaatcccagaagcctagtatatatcttcactattgtggctctagaaaaataataaaaatttcctatcatagcattttataacattttaagacttctaacatcaaaatgaggggtaaaaaaacaaaaacaaaaaactcctctttctcttcaaagaaaagagcataaactataaactaaaacctttggcaccactttcattatttagtagtaatagaagctttctggtcctttcatttttttccagaatcaataacaatgtgttaaatatttgacattcaagtacaattttaagaatacattatattaacctcactagtaaaataaagttatccatacttcagtttctttgtgctgaacagtcccgtgatttggttcccaaaatatagtagaggtagtggaaacgtctagaaaatttaaaaagggataacaaaactcaataataaagatagctaaaacaaggtcctttcaaacagaaacaattttgtttatatgatcaaaattttttccacttaaaacgtaaaattagttatcatacacaattttgacacccaaacacccaaacaaaacttatgcttggataaacaacattactatagcagaaagaaagggaggaaggcagggagaaaagacagaaatatgaatatgatcaatgtgagacagaaacatcatttgctgtaaaatatgataatgtattagagcccatggctctattgtcagcagaaaaagtaaaggcatttcatcttcgtttggagtcaagcagaggcagacagtataaaataagcccaaagaataatgaatgcaggatacactggctagattagatggatagagaaactgcaaaactattgtactctcaacaagtgtgcattaattaaaaacagaagaatattcctaggttattttttctcttaagtttaaagagactgtaggccttctttgacacatattactacttttattctttacattcattataaccactctagactgggcaattttgaggctgcaatttttaaatacgcaaggcactgataaaatatgttaatacatactgacttcatttcacaaaataaagtatcgcttttcttcttttacctttcgaggtacatttctgtcaaggtcaggaaacttgactactctgagcgcctttcccacccagagaactgccactgtggccaccatctgtaaacaagagaacacagattcactgttctacacataaagacacacacagaagttctaacaacataaaccacgtaatggtgaggattccaactaacctggccaagtccaacacatagtgaggagggaaatctacaaaaagggcaaagaaaaaaacaagatcagaacaaacctaacttagctccgtgaattcaatttgcacatcggcaacgttaataaggcattccgatacaagccacatcaacgtccgcccctaaatcaaacaaaaatcttgggagaaaactctctgcctgttggttgtcagtccaccccgctgatgtagcctcgggcggccgcttgtcccatcttgtccgagtctacagtttcagtccgctgcctgcaaaggatttctcaaggcagtgcagatacagatctctgcaacgatttcacacaccttaaaaaaaaaaacaaccaacttctgcctctgggtcccagtgttagcaagggaataattgtctgctgggttgaggatgcgtacgtccccagaggctgtcagcgggtgcaggggacactgaagccccggccccctgtccaggctgcggaggagggaggcttccctcgctctcctccctgatcgacaggcataacggctcaaaagtcaccaagcaaatcactttgctccatctctctgaagggcagggttttcggggcggtgcgcccagggcatggcaggcgagccccaaatgtgccgggccggccggagctccgcgcagggagcggacccctgccacaggcccgctcgccaggccggctccgctgcccgggccgcgcgcgtcagccgcccgccctccccagctcccgcccaactttgttcggctttaactttggcagtcaaagtccagggagccggcgccgcgccgccgccgccgcccgctcctcctccgcggcctgggccgccgccgcctcggccctacctgtaattggtgagcacgctcttattcaccaccacgatcaggaaggagctcacgccgtaaaagccggcggccagcagcttcagaaacacggtcagcgtttcggccgacgccatccccagctcctcctcatctcggagtgtggaggatttcgcgggggcttctcctttaacccgagcatgctgacgtctatgaacttccgccatggctgccgcagcagcggtggcctggcggcggggcctagcggctcgggggcctgcagcggcagctcccaggggactccaggagttggggaccgcagactaggccagctgcgcgctcgccgcctcgactccccgcttggccgccgcctgtccccgcccaggggcagggacgccggggttcacacccctggagactttgctcgggcattgtgcaacgcggggtcagagagtagggccgcgccgggcttagcctgggcaggggttggagagagcctggagaaggggcagtggcgacccccctgcccgaggcggataaggagaagccaggggaactacatcgagacaccagagcgccgggcgacaaaccacagactccgggtgacagtcgccctgcgcctgcgcacgagcacgcgctgggtctctccgcggggcgcgtacctggggcgtggggagtctggtggcagaggggctggaaggccgtattctccggataactgccgcaactaagtgcagaccctcctcccctctgttacaggtggccggccaagtagttacagtacactgcgtctagactaattctgaatgctcttttagtctctcttgcagggggtaaaaacccttcaaaagtatcagatgtggatcaacagtaaacactcaacgaaaatttcattccgcaatgcctcaggcttcttacattttctgaacccagaaaacaccaaacaatacttttcagattgagaagtttcgtttgtttgttttaagaaaaatgttgacatatcccaaaaagtagcaagataagcagcttggggattggggaaagcacaaggtgtttggagcctaaaagacttgatttccaattgtaggattcctagaaatgacgaccccccccccccccaccaacacactcactccttattgtgtgtcttggaccaattagatgacctccctgaacctgatctctgtggatgtgtagctagcaaagagctagttttcggtaaatggtagtcattattgtataacagaagcaaatcattatgatcggtttaagcaaagaaattacgtattgaactttaatagattaggaaagaagaactttgaattatttttctaagtgcttggtctgtatctttttaaatttcttttttttttttttcttatttttatattttggtaaaccaggtatagtggttcacacctgtaataccagcactttgggagcaggtggaatgcctgagcccgggagtttgagaccatgctgggcaacaaagtgagaccctctctctacaagaaaataaaaaaattagccagatgtggtggcgcacgcctgtggtcccagctactcaggaggctgaggtgggaggatggcttgagcccaggaggtcaaggctgcaatgagctatgatcatactactgcactccagcctgggcaacagcacaagaccatcttaaagaaagaaataaattgtggcaaaatatacaaagtataaaatttatcattttaaccctttttgagtatgcaattgcatggcattaactgcattcacatcgttttgcagccatcatcactaatccatctttagaactttttcaccatcccaaagtgaaactctttcccctttaaacaatcactccctgtttccctacttccttccctctctgctgttaaccagtgttctactttctgtctctgtgaatttgactactctaggtacctcatataagtggaatcatgtagtatttgtcctttcgtgatgaacttacttcattaacgtaatgtcttcaaggttcagccacgttgtagcatatgttagaatgtcctccctttttaaggctgaataatattaaattatatgtgtataattggtttatatcttttgagttactttgagaacacctatgttcttcaagtgtttcttaaaaaactggtacacaggatgaggttcttaacatagcctacaaggtcctagataatgtggttcctacccacatctccagaggcactattcacgtttccctcccctaaggtgcagataaatcaacaatgtgggttccggcttctgtgtctttactcccattattccctccatctgggctgctttttctcttcctcctctcacccagctcctgaaaaactcttacatttccttccgtattttggcagaacattacctcttctctgggcagccttcacactgccccccacttccctctacataattgatctctctcctttgtgcctctcctaccgcatctttatataccccctttatagagtgtccatctgctgctgctgctataacaaaatacctgagactggataacatataaaaaatagaaatttattttctcacacttctggaggctgagaagtccaagatcaaggtgccaccttaaccactgcatcctctgaaggggaagaacaccatgtcctcacatggcagaagggacagaaggtcagaaagggacaaacactgtgtgaaacctctctcataaggcatgaatcctactcacaaaggcagagccctcatgacttagtcacctcctaaagggcctgcctcttaataatatcacattggtgattaagtttcaacatatgaattttggaggacacatacagaccgtagcaaaggggctctgcattacatgtttacatatcactctcttccactagacagttgcttcttgaggacagtggcaggcaagggtgcctaacacagtttagatattttagttgattgaatcaatggaaacaaggaaaatgattaaatttcttccttgactgctagcttcaaaaggaaaaataactaaaacattgtattttaagaaacatccttgcagaaaaaatattatagaagtaacaatgaccctcataataaaaagcaaatatatacatatatacacatttttacacattttaaaaaacatacctggaatagaaccagagaagaacactaatcctcaagccacacactgctgctgacacttagtagttttgtgaccttgggcaaattactagacatcactgtgcttcaatttcctcacctgtaaaatggggataacaatagtacccacctcatagagttacaatgagaattaaatgagttaatgaatgtaaagtgcttagaacataatatgagtgtttattacaattactgttatcactagtattattaggcagtcttcctcttttcacttactattccttgatggtctttctgtggcaacgcttaaacttaacctcattcttttcaaaggcttcagagtattccattagttggatgcatcatcatgtaaccctatagacatttaagttattgccatttttcagtgtacaaacaatgcttgtccattcaactttgtgcaagtataaatttctagaagtagaattgcttagttaaggctactttttaataaaaaaattaatagaattgaggaaattccaaattaacaacctccaaagagtttatactcattttttattcctgctaacacggtatgaaaatgaaaccctcttttataaagtcaagagggcagcaatggagaacaatggaagaggtgagataatatttcaagttctaccctgtggaagtatgaaatgccaggtacaaattttcaaaatcataagttatgattacagaaaataaaaataagagtgctgatccaggcaactactgtttttctcagcatgattactttattaattaacaaatatttaagacctatcacaggccatgaactgcattggattttctcagctccagtaatgatttggttgctgtggacccccagtaaaatgctatagagtttaatggagtcaagcattctcattaggtacccacaaagataagataggtgccatctctagtaggatttttatctctttcccatgttataggtacttagactttggggtaaattttggtattttaggtcctcagatctgtttcctcacttcagtaatattaatcacagaattatatatggagtatttacacatcattgggtgaaactgaataaatattgaaatatatcttaaaaagttgttcaagataagaaagactgaattaaatgttctcacttaggtacaagtgtactctatttggaaaggtcaactttgtgggttgataaattttacatcttactgggtagaattactagcaaaaactcttcttagtattaaatgatgtctttttatcaaaacattgccgttaggtatcctgtttttcattgagggaatattgattctgtacacagttttttaaaacatagcttatattacttcttttctccacgcttctcccttttccttggcccacttgctcctctcatagtggaatgtatataggcctcttttgttatccacctgcattcaccagtttcctatttcactgccaacctagatcatacccagtgacctgctgtgctgcacagctggttactttatagtcaaggagcaaaggtcatacatgtttcctatttgaacaatactttaaaaattctgagaatcagcatggagcttctcttctctgcagtgccttgtacttttctacattggactgcaaagaatgaacttattgtccactgatgatgagcctcacaatgtgcttctcttgtaattcattatctcatttcaccctaaccactgtgagaagcaggtatggtgaaacaacatataaacaggaaaacaagggctgagagggagtattagacatacactgcatcccacagctctaagtgactgtgtacagattcggtcctaggtctgtttagcatttattctgtgttcctccactggacactcctgcctcctttggggcagatggacaagacctacttttacaagacgttctggcaatgtcaatgctttcttcaatgaccaagtttagtgtttatcaaccctatgaagaaggataagcaggataaaggaacagtaatgtgttgaagtcatagtcaatcatgactcattcacaaatagcataccagacaccaagttaggcactggaaatacgaagacatttcaagctcaatgtatttacaactgaactttatataaatctctcccaaataagttgcttctttgaatctccaattttagtgaattgacctcactatccacctatttactgtggttctgctctctgtataatcaccctgcaagcactctttaacccccaccaaactagttttaccccctccaatacactgaagctgttcactgcaaagttacccatgacctccatgggactacacccaatgagcactcttagtcctcctgcttgaccactctacagcatttacattgctgatattctcccttcttttagctacaccctcttcccttgacttctgaagccccatactctctgaaacctctcctcgtactctggctgctccttctcatcctgctttgctggttcctcctcttctcacagacctttaaagttttacattcctcagggctcagtcttgggtcttctctattctatgtattcttactaaatctcattccattccatggtttcagttatgacttattgtttgccagtgcttaccaaatctacattacttatgttctctctaactccagattaatgtgtctgactgcctcctgaatatcttcacttggataactctctgttatgctgctcaacatgcctgaaactaatcttgtcattatcccttttactccaacattctgcttctctattgttcttcactgtatcaggtaatgaatcctgacagttgagatcctagttgtcttattttgccatccaaaatgcttactactttgcatttatcagatctgaacaacataatttaatcaatgtgttgaaccagtttattttgtatgagaatattaagatgatcaagatctctgtgaactatattatggcaaagagtaaaagattggatgtcaatccaatgatgctatactgctggccctgacatgtaagaggtaaactgttttagttggaccctataaattaatatagagacaaaacatttgccatgttaatagctacacactaggtgtcaggaaatgtcatggtgatttgccctagtaacactacgtctggagcatcaactaacattggagtcacctcctgattaagtttataaccacactcagttatttgctaagatttctcttctgcattggacaaacaggtgacttaaatggagatgtgataggattcatccatctttcaagtctttgatgatggcactaatctctgcaactcctctaaagatgtggcatatctttttttgtactgtcctgaaagggaaggaaagctccagaggcttcctctttctactatcgtggtccttattccatgggtcacacagacactgtgaggattttaccagctgcctagcatatctattatgcctaaacatatgtctcttccaattatacattcaagagctggagacaaaaacacacagtggatttgtggacctactgagcacatcgtgtttcaaagttgggctaggtctccaattatcacctgactcacttctatagtctaaatgtgtgtgtcccccaacaaattcatgtattgaaattgtcatgtgaaaatagagatgaatctctaagtaaaaaggttttgtttgggaatagtatacaagacgtaggattgtaatttgggacatatatacaaaccaggatggcctccagtatatatggagaacagagtaaaaggttaggattttattggagaaagaggagatttatgcaagttgttttaaaagaaagttttttggtgctggcagcatcttacaagagctgaagagttttgatatgtgaatgtcagtggtccttaggaaggacttgtaatcttggagtttcagttaggcctttacatttagaattgggtttgtgagtcagtgtgtcaggcatgtgttcttgtgtaagcggctagctgtccttgtgctgccagctgtctttgtgtgactcacgtagtaaactgtggtttggaaaaatgtcctgtgatagtttgtgttatcaggcaaactgtgtgtgagagccctaccagcatagccttctctagctccattttgctagggtttgacacaagtgactacattttgaatctgacaatgttcacaaaatcctaacctctaaggtgatagttttaggaggtgaggtctttaggaggtgattaggtcaggagggtgaagacttcatgaaaagaattggtacccttacaaaagagccctgagagagaccctttaccccttccaacatgtgaggacacagctggaagataccacctatgaaccagaaatcaggcactcaccagacaccaaatcagcctgcatcttgatcttggatttcccagccttcaactgggagaaatgaatttctgttgtttataagctacccagtaatatttcattaaaacagcttgaactgactaagacgctacataagcccccagtttaactggtagactgcaggactgtaagtgcccaggaattagtatcggttggccagtgtttgataatcccacaaaaggtctgggtatttcctttttgttactacacagtcaccctagtaaatggcagcagtttcctttgaggaagacttgaaagaagatatacagtatacacttgtggctatgatatagggccttcctcaaagagacctgatctctccttcaatccaagagattctcgtattgtacatggcttaggtctggaaactgaataaaagaccgtgactgtccatttctgagactccagtcagttttctttgctgtcaggtctggtttttactgttatagagattaaggaccattttactaggttgtctaactatttcattcttagggacattataatcaataggatactgcccaaaattcctatggcttaaaactatgattaccactatgttactgctttccttttataataaatatgccccctaccttgtcttctgtggttaagtactactgcttgcctctgatactccagaacttccaacatctctattaaattgcggagcccatctcaatactgaaaattcccattatacctagcttacagagcacagccacaacagaacttctcaaggatgtacatggtctatacacaagtgtgtttctccacatgtcagttatgggatttcctctggattctctcaaggatgttgagggatgggtgtgtagattacatgtgataaatatgctccaccattcctgtttccctaagcactggaatcttttcctcaacattataatatggaaagttctggtatctcaacctcattaaatagaccctgctgttgtgcccaactgtcagtaaacaaacatattaaattgttggaatgcttccacctgcatgagccaacacattaaatccagaacctcaggtaagtacacccttatcaatacgtttggccgaatccagtgttatatttcatcttccttaagctccattcctatacatattccctaggttgatggtgatataaattagaaaaatcttgcaattcttttggtttaccacctgcttcctcctaagttaaacttcatgctggctctttggggtgtgttgatatctgacctagttatgggtatagtggatagagttttcaagcaagagaaggctaatctgtcagacacaggaggctcccactgtcagaagaggctcaaaatgacttgacaattcaaaattcttaaccccatttaagcccaaacaaatgtgtactcattccaagttttagggtcattttctttccattttttttaacttctacatgagagacctagcaaggttgtaaattcaactgatgttgtaaaaattgtaaactggcctattaagcctttttttatttttaacaatatcagccctgtggctgcaagaaaagagagattcttttaggactgccatagaatcattttggcactctaatgagactttatgaagaatgtaaagacctgagtttgttattctttctgtatgtgttttattaaactcaagaatctatcccacaccacagtcctcacagtcattactactgctaacagttagatgtagcaggcccatgctcctaaggcacttggttcagtaggaatatcatcacaattaactgcaggtgacaatttaatgaatcatgatacttctgcatgacatgggttaccagaatttatttcacattagtggggagctcagcacttcattcaagctcaaggacagaaccaaacaaatcccaaatcccaacttctaaagtctattctagaaccaatttctatatcaatcaaggtccagtcaagagacagaaaccacacgttatttgattagagataattttacattaaaaaatgttaactaggtaaatgaaagtttaaaaagaaacacttcaaaagccccccaaaccataaggtatcgtggaggtagcaactgcaggaagggctgagggaacaaaggaaagaggctagaattatcaaaacttagaaacttagaaggggaactccaatagctaaaactcaagatttctgaggaagaaatgctgctcaagtgattctagggtctttgggttcaaaagaggatccccataagcctgaaattcagacctttgaagagagagcactatctggttagtgctgtgggcttagtgtcacgtggggtgggaggggagtaggggcgggaagggtaggagggggagtggaacgggaacacagtgttgtgatataggctgttctctaaatttagggaaaactgcaaactgaattcaactactgctaagggaagaacttgctacttctgggacgaagaatcattgctagactgaggctactaggaagcacatgggaaaaagcatttcttttctcctcctccagctacccagtatccctctagtgccacgtatggaagagtttacgtagagccagccagcaaagcagaaatgtgttttgcaaaatacaagcatcagcttcacaaagtagaatatagaagagtaggtttccagctgagagacaattaatatgtggcacacccattttagtaaacatatcgccatatgccaag

SEQ ID NO: 381 - DNA, 23482 bp, Homo sapiens
gctctagggatctagtatacaacactgtacctatagtcaacaaaaacgtatcatacacttaaaaatatgttaaaacagtagacttcatgttaagtgcttttaccacaataaaataaaatttgaaaaaagaaagaataggggctgggcacagtggctcatgcctgtaatcccagcactttgggaggccaaggcaggcagatcatgaggtcaggagtttgagaccagcctggccaacatggtgaaaccccatctctactaaaaatacaaaaattagccagacgtagtggtgcacgcctgtaatcccagctactcaggaggccgagatgggagaattgcttgaacccagtgggcagaggttgcagtcagccaagatcacgccactgcactccagcctggatgacagagtgagactccatttcaaaaaaagaagaagaagaaggaataggaagtcattaaacaagtttactaagtagaaacaatctcctaaaacagaaaacaccaagtccacatgattttcagaaaagttcaatcaaatcttcaaggaataaaccatttcaatcttatatgaaatcatccagagactagaaatgactattcctgaattcagtctttgaggccatatagtcttagtgctcaaaccaaataaggagagcatgagaaatgaaaactactggccaatctaactcacaaacgtagatagaaaaatcttatacagcatattagcaaactaaattcagtagtgtataaaaagattatttagcataagcaactttatcccagaaatgcaagagtaaaaatgagaaaaacctacaaatacaattcaccgtataacaatttaaaagccatgtgattatcccaacagatgcaaaaaatagttttataaaattcaaattttgacagattacatttttaacacactgggaatataagggaatatccttaacaagataaagtgtaggtattttttttaaataaaacctacagtatacatcattcttaaaggtgaaactattagaagcagtcccttaaaatctgcaaaaaaaagacagggatgaccactacactgcttctattccacaatgtactaaagattctagccagagtgatgttaaaaaatagaaatttaaagcattcataattggaatagaaggcacaaaaccatcattagtcacagatgataactgcctatttttgtagaaggcaaagagaaccacatacaaattatttagaaataacaacagaatataggaaggtgactggatataagattaatatataaaatgaattacatttttgtacaccagaaaaacatagaaagaaatataatgtttaaagataccatttaagatggccaattacaggcagctgcggtcacagcactgctgaggaaggagagcagcaaagtgaattcaccaccttcaactgaaatatccaggttctcacattgggactgactaagcaatcagctcaacccatggagagcgaagaaaagcagggtggggtgagggcccacctggagcaacatggagccgaaggaacccccatccccaaacaagggaggcagtgagtgattgtgcgaccctgcctgggaaaccacacttctcgcacagatctttgcaacctgcagatgacgagatcccctcatgagcctacatgagcagcgccttggattcaatgcacagagctgtgtggagtctcagcagagcagcaatccagcacacacagagacccaggagttttacatactctggcctcgggatccccaacaagggggcagatccatctgtatattcccctaggaaggtggctgaatccagggagccaagcagcatcattctgcaggccccacttccacagcacctcacaagttgggacctgctggcttggagttccagccacagtggcagtaggcggagtctgcctgagactgggggagtttccaggacctggggggaggggtggctgccatttctgcagtttggtcaactagtatttcagcttgccagctctggacagtccaggcagtctggactagtccccttctatgcagcacacctgctttgccagatcgtgacagactgcttctttaagcaggatcctgatccattcctcctcactgggtggggcctccctgctgggagccctcagtcaccccagccaggcttatatggacagaattccgatctctccctgggatggagctcctatggggagaggtggccaccatctctgcagttgagttgactcagctgttccagcctgccagctctggagagtctaggtggtccagacaaggaagggtccccaccaacacagcacacctgctctaccaaaaagcagccagactgattctgtaagcaggtccctgatcccattcctcctgactgggtgagacctcccaacaggggtctccagacacctcctacaggagcattcaggccagcaacaggtcagtaccccctgggatggagcttccagaagagaagcgggctttgctgtttcgcagccttcactggtgatacctagagttacaggaaaagccaaggcagctaaggtctggaatggacccctagaaagccacagcagtcctacaggtgctaacagtcagtggcctgttaaaagaaaaacaaacaaatagaaaacaacaacaacaaaaaccccaccaaaaaaccccactcaaaggtcagcaaccacagaaaatctaaggtagataagcccacaaataagagaaaaaaaatcaatgcaaaaatgctgaaaactcaaaaagcaagaatgcttcttctcctccaaatgaccacaatacctttccagcaagtgcacagaactgggctgaggctgagatgacagatgagatgaagcttcagaaggtgggtaataatgaactttgctgagctaaaggagcatgttgtaacccaatgcaaagaagctaggaatcatgataaaacaacacaggagctgacaaccagagcagccagtttagagaggaacataactgacctgaaggagctataaaatacaacacaagaacttcacaatgcaatcacaagtataaatagcagaatagaccaagcagaggaaaggatctcagagcctgaagactatctatctgaaataatagaggcagacaagaatagagaaaaaagaaagaaaagcaataaataaaaactgagaaatatgggattatataaaaagactgaaccagccaggcacggtggctcacacctgtaatcctaggactttgagagactgaggcgggtggattgcctgaggtcaggagttcgagaccagcctggtcaacatggcgaaaccccatctctactaaaaatgcaaaaattagctgagcatggtggcaggtgcttgtaatcccagctactcaggaggcagaggcaggagaatcgcttgaacccagggggcagagattgcagcgagctgagattgcgccacttcactccagcctgggtgtaagaatgaaactccatcttggaaaaaaaaaactgaacctacaactgattgggatacctgaaagagatggacagaatggaatcaagttggaaaacatccttcaggatatcatccaggagaactccccaacctagcaagacaggccaacattcaaattcaggaaatgcagagagccccactaagataccccatgagaagatcaaccccaagaaacataattatcagattctccaaggtcaaaatgaaagaaaaatgttaagggcagccagagagaaaggccaggtcaccttcaaagggaagtccatcagactaacagtgaacctttccgcagaaaccctacaagccagaagagattgggggccaatattcaacattcttaaagaaaaaaatttccaacccagaatttcatatcttgccaaactaagcttcataagcaaaggagaaataagattcttttcagacaagcaaatgctgagagaatgcatcaccaccaggcctgtcttgcaagagcaccttgcaaggaaggaaggaagcactaaatatagaaaggaaaaaccattaccagccactacaaaaacacactgaagtacacagaccactgacactatgaagcaaccatataaacaagtctgcaaaataaccagctagcatcatgatgacaggatcaaattcacacataatgctaaccttaaatgtgaatggctaaatgcccccaattaaaagacacagagtggcaagctggataaagagccaaggtccatcagtatgctgtctcacaagcaaagatgcacatgggttcaaaataaagggagggaggaaaatttaccaaacaattggaaaacagaaaaaagcaggggttgcaatcctagtttctgagaaaacagactttaaaccaacaaagactttaaaaagacaaaaaagggcactatataatggtaaacggttcaattcaacaagaagagctaactatcctaaatatatatgcacccaatacaggaccacccagattcataaagcaagttcttagagacctatgaagagacttagacttccacacaataatagtgggagactttaaccccccactgacaatattagacagattatcaagacagaaaattaataaagatattcaggacttgaactcagctctgaatcaagcagacctgatagatatctacagaacattacacccaaaaacaacagaatatgcattcttctcatcaccacatggcacttactccaaaattgattacataatcaaaagtaaaacaatcctcaacaagggcaaaagaactgaaatcataacagtctctcagaccacagcacaatcaaattaggattcaagattaagaaattcactcaaaacaacacaactacatggaaattgaacaagctgctcctgaatgactcctaggtaaatgataaggttaaggcagcaatcaagaaattctttgaaactaatgagaaccaagagacaacataccagaatctctaggatccagctaaagcagtgttgagagggaaatttatagcactaaatgcccacctcaaaaacctagaaagatctcaagttaacaatctaacattacaactaaaagaagcagagaaccaagagcaaacaaacccccaaactagaagaaaacaagaaataaccaaaatcagagctgaaccgaaggagatagagatacaaaaaaaccccttcaaaaaatgaacaagtccaggagctgatttttgaaaaaaaaatcaataaaattgatagactgcaagatagactaataaagaagaaaaaagagaagaatcaaataaacacaattagaaatgataagggagacatcaccactgatcccacagaaatacaaactaccatttgagaatactataaacatctctatgcacataaaatagaaaatccagaagaaactgataaattcctggacacatacaccctcccaagactgaaccaggaagaaatcaaaacactgaatagaccaataacgagttctgaaactgagacagtaataaacagcctatcaacaacaacaacaacaaaaagcccaggaccagatggattcacagctgaattctaccaggggcacaaagaaaagctgataccagccaggcacggtggctcacatctgtaatcccaacaattacacatctgtaataccagccaggcacggtggctcacatctataatctgtaatcagaggctgaggcaggtctctactaaaaacacaaaaactagctatgcatggtgatgcatacctgtaatcccagatactcggggggcctgagacaggagaatcgcttgaacctgggaggcggcggttgcagtgagccgaaatcacaccactgcattccagcctgggtgacggagtgagactccatctcaaaaaaaaaaaaaagagaaaagaaaagaaaaaaagaaaagctggtaccatttctacagaaactattccaaaaaactgaaaaggagggactcctccctaactcattttatgaggccagcatcatcctgataccaaaacctggcagagatacaacaaaaaaagaaaacttcagaccaatacccctgatgaacattgatgcaaaagtcctcaataaaatactggcaaaccaaatccagcagcacatcaaaaagcttatccaccatgatcaagttggcttcatccccaggatgcaacattagttcaacatatgcaaatcaataaatgtgattcatcacataaacacagctaaagacaaaaaccacatgattatctcaataaacacagaaaaggccttcaataaaattcaacatcccttcatgttaaaaatgctcaatgaactagatattgaaggaaaatacctcaaaataataagagccatatatgacaaacccacagccaatatcatactgaatggggaaaagctggaagcattcccccttgaaaactagcacaagaaaaggataccctctctcatcactccttattcaatatagtattggaagttctgaccaggacaatcaggcaagagaaagaaataaagcacattcaaacaggaagagaggaagtcaaatcatctttgtttgcagatgacataatcctagatgtagaaaaccccatcgtcttagcccaaaagcgtcttaaactgataagcaactttagcaaactctcaggatacaaaatctgagtgcaaaaattgctagcattcctatataccaaaaacaggcaagcagagagccaaatcataaatgaactcccattcacaattgccacaaaaagaataaaatacctaggaatacagctaacaagtgaagagcttcttcaaggaaaactacaaaccactgctcaaggaaatcacagaggacacaaaaaaatggaaaaacattccacactcatggataggaagaatcaatgttgtgaaaatggccatactacccaaagtaatttatagattcaatgctattcccattaaactactattgacattcttgacagaattagaaaaatctattttaaaattcatatggaaccaaaaaaagagcctgaacagccaagacaatcctaagcaaaaagaacaaagccagaggcatcatgttatccaacttcaaactatactacaacgctacaataaccaaagcagcatggtactggtacaagaacagacacatagaaaaatggaactgaatagagggaactaagaaataaggctgcacatctacaaccatctgatattcagcaaacctgacaaaaacaagcaatgagaaaaggattccctatttaataaatggtgctgaaaaaagtggctagccacatgcagaaaattgaaactggactccttccttataccacatacaagaattaactcaagatggattaaagacttaaatgtaaaacccaaaactacaaaacccctagaagaaaatctaggcaataccattcaggacgtaggcatgggcaaagatttcatgatgaaaacaccaaagcaattgcaacaaaagcaaaaattgacaaatgggatctaattaaactaaagagcttctgcacagcaaaagaaactatcatcagagtgaacagacaacctacagaaatggagtatatttttgcaatctatccgtctgacaaagttctagtatccagagtctacaagaaacttaaacaaatttataagaaaaaaacaaacaatcccattaaaaagtgggcaaaggacttgaacaggcacttctcaaaagaagacatatatgtggccaacaaacatatgaaacaaggctcaacatcgctgatcattagagaaacgaaaatcaaaaccacaatgagataccatctcataccagtcagaatggtgattattaaaaagtaaaaaaaaaaacaaaaaacacagatgctggagaggttgtagagaaaaaggaacacttttacactgttagtgggcgtgtaaattagttcaactattgtggaaaacagtgtggagattcctcaaagatctagaggcagaaataccatctgacccaataatcccattactgggtatatacccaaaggaacataaatcattctattataaagacacatgcatgcatatgttcattgcagcactattcacaatagcaaagacatgaatcaatccaaatgcccatcaatgatagactggataaagaaaatgtgatactgaaatatatatatatacacacacacaccatggaattctatgcagccataaaaagaaatgagatcatgtcctttgcagggatatggatggagctcgaagcagttatcctcagcaaactaacacaggagcagaaaaccaaacactgcatgttctcacttacaagtggtagctgaatgatgagaacacatggacacataagtggaacaacacacactggagcatatcatgggggtggtagggagagggagaacatcaagaagaatacctggtgaatgctgggcttaatacctaggtgtagggatgatctgtgcagcaaatcaccatggcacacatggtttatgtatgtaacaaacctgcacatcctgcacatgtaccgctgaaattaaaataaaagttgaagatttttttaaaagatagcatttacaataatattaaaaatataaataagattgtaacacctgcatgagaaatgtcataaacctttctttaaaatattaatgaaggtcaaaatagatggaaatatatatatcaaagacaatattataaggatatcattcttttccaattgatttgtagatccagtgcaattcaaatgaatatccaaaataggtgttttgtttttgtttttgtttttgttttcgttttcggtcagagtcttgctctgtcacccaggctggagtgcaatggcacagtctcagctcactacaacctctgcctcccagttcaagcaattctcatgccgcagcctcccaagtagctgagattacaggaactcaccaccataaccagctaatttttgtatttttagtagagacggggttttgccatgttgaccaggctggtctccaactcctgacctcatgggattcacccacctcagcctcccaaagtgctgggattacaggcatgagccaccacgcctggcccgaaacaggtcttttgaataacttgataaactgactaaaatttatatgaaaatacaaaatcctaagataaacaaagttcaagagattaagtgtggctttggagtgggggtatacagtggagtgaaataaagggctcagaagcaatcccacataattaagcaaaattattttgcagttaaatagaagaggaactcattaataaataggtctggaaccactgaaaaatgaaaaaggatccttatgttataccttaccaaaaaatcaacatcaggtggttttagggtgtaaaggtaagccaaaacttcaaaacttttaggagaaaacagatccaagatgtcctcatgttcctagataacatagtgtagtgtgactaagaacaaaaactctgaagccaagttcaaatcttgtctctaccacataataaatgagtgaccttgtacatgtaacctaatctctgtctccatttcatccttaaatgatggtaataactgtacttacttcatagggtgtatatgatgataaagtatatacaaattacttaaaaatagcacctggaattaagtagtactctaggttataactaaccctgttactattattatagtgctattgcactctttctcttgtgccatgattagtttcttctgtgcataaaaggtcaaaaagagaaaggaagaaatccctttttaattcctcactctgatgattctacccttcatgattaaatatatgcagaagctctgatccttaagtttctattgcttctagatgaacatgggactcactatcaagggtctaatcagtttggggccttcagcttcatggctgggtacccaagcactcactgttcaactcaacacctagtaatgtccagtcctggcccttggggtaggtgagctcaaccgtctcaagtatcaagcccaaaatataacatcaggtgataccacaactatcctgcctgctgcttgctgcaccatgaagtctgccaagctgggatttcttctaagattcttcatcttctgctcattgaataccctgttattgggtggtgttaataaaattgcggagaagatatgtggagacctcaaaggtatgaagctaaggcagaaaataaatccaaaggtcaattatgaatgagagagaaggtattgggagaaaagtgtgttatctaggtagtccaggaaggtcttcctttcatgacaatacccatagacacttagtcccttgactcagggcattacttacactaggggtcctctggatgtttgatgagaaaaaacagaaatgacacaaagtcctttccagatggagacctcttttataggaggtccaaaggactggaagtattttgaatcagaggttgtgtgacaaatttcaaagatcccagaccattgatgattatgtattgggatgagagagaaagggggttggagacagagcaaattaagacattttcagtatctgggctatggacatatacagaactcttggacagatgattcctgtttagaggagctcacaatgtaaatgtgagaggcaatgagactttcttccatagatagtgtgtgaaggctcagcgcttccaggggacgagaaagtagcacagtttataccgtaagtcagacacttcaagttctggacctgttcacttagcagatatgtgcccttggacaagtcactcaaccacttattattctcttagtctcagtttccccatgtgtaaaatgaagatcagaaaagtgcctgctgcagagggtgtttgtgagtatgaaataagattatgcacataactttaccagagagtaaattccaggctggctgcttgagtaaggtggattgtcaatacaaccatgattgtggctgttccaaccacttactacccaactcttaacaataaaaacagagggtttgcctctgagaaggcaagaaaggagaagatgacggggtatgaggatgaacgagcatcaccccaaggttatgcattttagcattttagtatgcatcctgctttaaagatagcagcagccatggttacttaaattttgaagtataggtagtatagtgaatgtatgaaactggggaggaggcactctgaattgcatgtcctatgtgggcaattaaaaggaaaggaagatgatgtggggaagcaggaggatactgtactttaataaactgtaagataggaaatgtagggaagctcatcgccctgcacaagctagtggtggaacctcctttttcactgatcactacttctccttctccaatacactgctcacgacaacaacctggaattttaaccaatttgcattgtgcaagggcaacatttccaagcaactctaactccaagagaaaaccacatctttcagagtccttgaatatgagaatagttccaggctaaacgtaggaatttttaagggcccataaagacaagttctcctgctgagtccttaccaattcccactaactcaatgggaacctctcatgcagatccctgcaaattggacatgaattttggaagctgctatgaagttcactttagatatttctacaacagaacctccaaaagatgtgaaacttttgtcttctccggctgtaatggcaaccttaacaacttcaagcttaaaatagaacgtgaagtagcctgtgttgcaaaatacaaaccaccgtaaggaatctaatcctgtccttggtccttgggggtagtaaaagaagaggttttgacatcctaagatagagaaaattgatcaggggctaaccttgcttggagtgggaagagggaggattgctcaaataagaagttttaacagttgggttggccgggcgcagtggctcatgcctgtaaccccagcactttgggaggctgaggtgggtgtatcacctgaggtcaggagttcaagaccagcctgaccaacatggagaaaccccatctttactaaaaatacaaaattagccaggcatagtgtcgcatgcctgtaatcccagctactcgggaggctgaggcaggagaatcacttgaacccgggagggttcaagaagttcagagggttcagaggttgcggcgagccgagatcgcgccatccattgcactccagcctgggcaataagagcaaaactccatctaaaaaaaaaaaaaaaaaaaaaccacatttgggtgggctgtcaggatcatttgctcattttgcagttaggaaatcaaatgcccagagagaaaataatagccaccatctattggacaattactgtgtgtcaggcactgcactaagcaattaacatatattgatataatttaaaattatatcaaggtagggccaggcgtggtggctcacgcctgtaatcccagtactttgagaggccgaggtgggcggatcacaaggtcaggagatcgagaccatcctggctaacacagtgaaaccccgtctctaccaaatatacaaaaaatttgccaggcgtggtggcaggcgcctgtagtcccagctactcgggaggctgaggcaggagaatggtgtgaacccgggaggcggagcttgcagtgagccaagatcatgccactgcactccagcctgggagacaaagtgagactccatctcaaaaaaaaaaaaaaaaatatatatatatatatatatatatatatatatcaatagatatatatcattatttttatgtgacagatgaagaaaccaagtacagtacaagtaaccaagcatctcgaggtcacattattaaatggcacagcagggtttctaaccagagctgacagtcacaatggtcttgacaatcttacatggacaaggtcacccaaaccaaattcttgcactctcatacctttgaactcttcatagcaacttgctgctttatacaactaagctcccagcccatgcttgactatttcccaatcattggaaatagaaggtcaatggtgcctaacagggctgtggtttggctgattcccaggagaactggctggagagtggccttgggagtaactagaaagcagaaatgttgttttgtttattttatattcctagtggatcttttcagtgcctggcacatactaagcaatgattaagtgttaagtgaatgaaaaagtgaaagattaatcaataaaataagggaaacattgagatagaaggcatcctctgtgctttccctaggataaaaaatgacctgcattaatccagggagaccttcaaaaacctgtaacaccgatttgggtttttctttcctttgcttaaacaggaggtgagaggatgtgaactcatgaagttgtctgctgcaccatccgaaataaagacacaagaaaattcagactgattttgaaatctttgtaatatttccataatgctttaagcttccatatgtttgctattttcctgaccctagttttgtctttcctggaaattaactgtatgatcattagaatgaaagagtctttctgtcagccctggctctcttaatttctctccacttgtcttatctggatttgcagagctgaaatgtcagctggtcccatccattgatttccccctcactcctgagccatcccttacatatgcacacttagcttcatttatcctaaactgctaaactgtttcaggtttgacaagtctgtacaggtttgcatcacctcccctgtcaaattgaactggttagtggaaccaaagtaccaaacctatactcccttttgatcttgaaatcaaacctagcagcgaactgcacacttatgtgaaatgtccctgcactcataacaaatttttctttgtcgtgtttcctgattcaagtccctcaattagtttaattacctcccaacctggtccctgtttaggagtaattatatggacctctgtcattgctatttgacttgattatagtcagtccttctggaaaagaatcctcaacttcagtccagtgactgtgtttcagctaccaaaaaatgattatccaaacacaggttcccaaatcttctgcatataatgctacaaggtttggcatggccatgatcagcctagctgtaagatttacaagttgaccacttcacctctgaattttttcaggcatccaaactgaacctgcactgaagtaggaaaacctatcctggcacctgttattaccctctgcatatctaccatgtccatcttatagacaaagccaatccctcacctgtgaatcacaacctggaacaggggtagctagggccaacattgtaaaccagtgagaccataactagacacacaagcctgatctctgctccatcttaagactaggaagatcaatgccctaaattaagatgcttttctgcaaaaattctggtaactacaagatcataccctcaaccagacagggtttattctgagcaggtaaagtgctaataacccagttgattctggcatatttcatcttcaatgaagatcctaaaattatagatcattcttgagcccagccagctgcaagaccctaaaataatagagatgagactaatctaattagtccacatacacagaagttctgagattttcctgttatgaatcatgaaactgggtgtcccagaagcagacagtctttcagggacaagatagcatatttcgggagcctgtttgcttcctacttcagccaactccttgaaaagtcagagaagtaaaaaagaggtgtacagatatgaataaagtcaagactaagaatcctctgaggaaagaaggcaattgtatcctggtgagaaaaggaaatagatgcccaggacagattgttgagcatcaaaagtgagataatgagttgagtaagagcttttgaggctttcgagttgtgttattctccccaccacaaagatctggatcagtcattgcctgctctcttgccaaatcactaacagccacaaaataccagataacatagtggtcgttccagagtccagctagagaagtataaaagcataaaagaagtgagaagcataaaaacaggtgcaactgagctagccagacacagagtttactgttttctcttcctcctatatacagtaaggtttatgtgactaaaactaagaggaagaaaggttcctagaaaatacatctaggacagaagtgtagatattttctctggttggaggtggggggaggaagatagagaaataatgttatttaggaagaagcaaatggagtaaggaagcccaggctgtatcactgtaaagtctcttctctggaatcatctaccaccaccacaaccacccttgaatccaccaagagcagcacaagttaaaaaagttgggctttggggagctaagctattaaagtgcaaaggcataagaagaaggctgggctcagtggttctagcctggattcctagcagaaaccactgctcaaggaaatcagacaggaaataaaaaatggacaaacattccatgctcatggatagaaaaaaatcaatattgtgaaaatggccatactgcccagagtaatttatagattcaatgctattcccattaaactaccattgatattcttcattaaattagaagaaaactattttaaaattcatatggaaccaaagaagagtctgaatagccaaggaaatcctatgcaaaaagaacaaagctgaaggcatcatgttaccagatttcaaactgtgctacaaggctgcaataaccaaaacagcatggcactagtacaagaacagacacatagaacaatggaacagaatagagaactcagaaataagaccacacagctacaaccatctgatctttgacaaacctgacaaaaaaaaaagcaatgggaaaaggattccctatttagtaaatggtgctgggagaattggctagccatgtgcagaaaattgacactggactctttccctatacctcatacaagaattaactcaagatgtattaaagatttaaatgtaaaacccaaaactataaaaaccctagaagaaaatctaggcaataccattcaggatttaggcatggacaaagatctcatggtgaaattgccaaaagcaattgctacaaaaataaataaatagcaaaattaaaaaagcaattgcaacaaaagcaaaaattgacaaatgagatctaattaaactaaagagcttctgcacagcaaaaaaaaaactatcatcagactgaacaggcaacttacaaaaatggagtaaatttttgcaatctatccatctgacaaagtcctaatatcaagaatctacaaagaatttaaacaaacttacaagaaaaaaacaaacaatcccattaaaaagtgggcaaaggacatgaacagatacttctcaaaagaagataaaatatgcagccaacaaacatatgtaaaaaagctcaacatcactgatcattagagaaatgaaaatcaaaaccacagtgagataccatctcatgctagttggaatggcgatgctggagaggttgcagaaaaataagaatgcttttacactgttggtgggaattcagttagctgaaccattatggaagacagtgtggtaatttctcaaagacctagagacagaaataccatttgacccagaaatcccattactgggtatatacccaaaggaatataaatcattctattataaagatccatgcatgcatatgttcactgcagcactgtttcaaggaattatttattttcattcttaatttcttccttcacccattcaggagtatgttgtttaattttcatgagtttgcatagtttcaaatgttcctcttgttattgatgtctagttttattcattttggtcatataagatacatgatatgatttcaattttttttattatactttaagttctagggtacatgtgcacaacgtgcaggtttgttacgtatgtatacatgtgccatgttggtgtgctgtacccattaactcttcatttacattaggtatatctcctaatgctatccctcccccctccccccaccccacatcaagccccagtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacactttcctaatccagtctatcattgttggacgtttggcttggttccaagtctttgctattgtgagtagtgccgcaataaacctacgtgtgcatgtgtctttatagcagcatgatttatattcctttgggtatatacccagtaatgggatggctaggtcaaatggtatttctagttctagatccctgaggaatcgccacactgtcttccacaatggttgaactagtttacagtcccaccaacagtgtaaaagtgttcctatttctccacatcctctccagcacccgttgtttcctgactttttaatggtcgccattctaactagtgtgagatgatatctcactgtggttttgatttgcatttctctgatggccagtgatgattagcattttttcatgtgtctgttggctgcataaatgtcttcttttgagaagtgtctgttcatatccttcgcccactttttgatgggtttttttttcttgtaaatttgtttgagttctttgtagattctggatattagccctttgtcagatgagtactttttgttacttgtttcatgtcctaacatatgatcagtcctgaagaatgttccacatgccaaagaaaagaatgtgtatcattcagttacaggatgaaatgttctgtaaatgtctgttaggttcatttggtctatggtacagttttaaaccaaagtttttttgttgattctctgtttagatatctgtccaatgctgaaagtggggtgttgaaatccccagtgattattgtattggggtctatccccttagatctaataatatttgccttatgagtgttgtggtattgggtgcatatacaattattttatcttactaaattgattcctttactattatataatgtccttctttgtctacagatttttacttgaagtctgttttatctaagtagagctattccttgcttttgtttcccttggcatggattatctttttccattccttcacttcagtctatgtgtgtctttacagctgaggtgagtttcttgtgggcatcatatagttgggttttgttttttatccattcaactagtctaaaccttttaaatggggaaattaattaatttacactcaaggttattattgataggtgaggacttactcatcttttttttgttgttttctagttctttttttttttttttttcttgagacggagtctcactccatcaccaggctggagtgcagtggcacgatctcagctcactgcaacctccgcttcccaggttcaagcaattctcctgcctcagcctcctgagtagccgggattacaggcacgtgccaccacacccagctaatttttctatttttagtagagactgggtttcaccatgttggtcaggcttgtctcgatctcgtgacctcgtgatccacccgccttggcctcccaaagtgctgggattacaggcatgagccaccgcgcccagcctttctggttcttttatagttcctttgttccttactttctctcttattatttttgcaggtaggtggttttctgtagtggtaagatttgattctctttttcctttgtgtattggctcttctagtgagttttatcattttatgttttcatgatggtggctattgtcttttcacttccagatataagactcccttgagcagttcatgtaagaccagtctagtagtaatgaattcttagtttttgtttgtctgtgtaagatcttatttctttttttttttttttttttttttttttttgagacagagtcttgctctgtcgcccaggctggagtgcagtggggcgatctcagctcattgcaagctctgcctcccaggttcacaccattctcctgcctcagcctcctgagtagctgggactacaggcgcccgccacaatgcccacctaattttttgtatttttagtagagatggggtttcaccgtgttagccaggatggtcttgaagatcttatttcttcttcatttttttttttgacaggctctcattctgttacctagtctggagtgcactggcacaatcatggctcactatagcctcaacctcccagactcaaccaaatctctcaccttcttttggctagctgggactacaggcacacaccatcatgcccagataattttttatattttggtagagacagggtctcactatgttgcctaggctggtcttgaactcctgggctcaagtgatcctcccacctcagcctcccaaattactgggattacaggcatgaaccacgacattcagcctctccttcatttctgaaggataatgttgctgggtatgatattcttaattggcagagttttatttttatttcagtactttaaatatgtcataccattttctcctgacctgtaaggtttatgctgagaaatatgatagtctaatggagattcatagctaatggtaattcccctatatgtgacttaatgcttttctcttgctgcttttaaaattctttctttgtctttgacttttgacaagttaactataatgtgcctcagagaggacctgtttgggctgaatcaatctggggttctttgagcttcctggacctgaatgtccatctctcccaagacttgggaagtcttctgacattattttattaaatatgttttccttaccttttccctttcttctctttctggaacacccataatatgcatattgtgcacttaatggaaaatggaattccacaaatcctgtaggctttcttcattctttttttctcttttcttttttaatctgcctatgttatttcaaaagtcctgtcttcaagttcagaaattcttttcttctgcttgggctagtctgttgttgaagctctcaattgtgttttttatttcattcattgaattcttcagctctaaggtttgtttggctctctttatgatatctatctcttcattgaatttctcattcaaataatgaattctgttcctaattttgttgactcatctatctgcattctcttatatctcactgagtttccttaagattattatttttaattcttttttagcatgtcatatatttccttatgcttagggtctgttatggaagaattattgttttccttttgaggtaacatgtttccttggtttttcatggttgatgtgtccctacattgatttctatatatctggtagaaaagttgcctcttacaattttatagagtaggttttgtaaggaaagacttattcattttcataggtattgactcagtggagttcattggccttggttctaggtggatgcagtagtatagtatccatttagtttcttctaccttagtccacactaatagtgtttgtgaatttctcagcggcctaggctaagagagtttgtgataatagtagtgaactttgccagaaatgggctttctaggcttttctcaggtggggagtgcatgtgtgtttctcaggtgggtcagccaaattggggttggggccacagagctgttattctggctgggagcactggcatgcagttgctcagtcaatctggacgtgtgtctgccaggagcaacccacagggctgtttctcaagcccagcatatgggtgtacagctgcttgtaaaggagtctttactaaaagaacaaatcacctagctgacctatggagtgattcccttcaagcatggtaacaaatcagtgtcttagcaaactagatagtcagaaggtggaagtccctcttgttaaacttatacaaaatttacagcctaaaattccttgaaacaaattttccaatctttcttcttcaaaatactttatgacatgggcagacccttatccactgcccaaaaatctgttgcccccaccacatgaaatgaatgaggacaagttcatttgggcttgtttgggctgttataacaaaattcagtagattggatggcttataggcaatagaaatttctcacagttctgaagactgagaagtctaagatctaagatctaggtctaagtataaaatcaaggtaccagcagatttgagatctggtaagaccagaactatttcttagttcataaatgataacttctccctgtgctctcacatggtagaaggggtaaacaagctcacttaggctcattttagaagggcactaatcccattacttagggctctgacctcatgacataatcacctcccaaaaagtcccatctcctaatactatcaccttggagttaggatttcaacatatgtatttgagggtatatgaacattcagagcatcgaactaagagtataaagtttaaatgttctcaccacaaaaaaactacatgaggtgatagatatgttaattattttgaccatagtaatcactttgcaatgtgtatatgtatgcatgtgtgtatatagtatatatatatatacacacatatatattaaaacattacattgtacacctcaaatatatacaatttttatttgtcaattatacttcaatacagttgggggaattaaaaaataaagtttcaagagaaaaaagaatttatctacttaatacaaaaccatgagtagtatacaaaaggttccaggtaccagtcataaataacaattttaaaatggctcaacaccctttcatgataaaaaaaaactctcaacaaattgggtgtaaaaggaatatatctcaacacaataacggccatatatgacaagtcctcaggaaacattatactaaacagtgaaaaattgaaagcctttcctctgaaatccagaacaagacaaggatgtccattcttcctacttctattcaacatattattgaaagtcccagccagagcaattagtcaagagggaaaaaagggcatcaaataagaaaggaacaagtaaaattgttggtatttgctgattacacaatcttatatatagaaaaccctaaagattccaccaaaaaactgttagaactaataaatgaatatggtaaagttgtaggatacaaaatcaacacaaaaagatcattagcatttctatacactaataatgaactatccaaaagagaaaacaaaagaacaatcccatttataatagctactaaagaataaaataatcagaaataaatataaacaaggagataaaagacctgtacatggaaccctataaaacattaatgaaagaaattaaagaagacacaaataaatggaaagatatcccatgtttatgggatggaagaattaatatcgtggaaatattcatctacccaaagcaatttacatagtcattgccatctctatcaaaatcccaatgtcattcttcacataaataagaaaaaaatcccaaattcatatggaaccacaaaaaaaatagccaaggcaatcatgagggaaaaaaaaaaaaaaaacgtagaggcatcatactactaatttcaaactatactacaaagtgataaaaatggcactgacataaaaatagacacattgaccaatagaataaagagtgcagaaatgaactcatacatatacagtcatttgacattcaacaaaggtgccaaaaatacacaataggaaaaggaaagtctctccaataaatggtgttgggaaaattggatatccaaatgtagaagaatgaaattggacccttatctcacaccatatacaaaaatgaactaaaatgggttaaagacttatacacataatgggaggcagaggttgcagtgagctgagatcatgccactgcactctggcctgggcaacaaaagcaaaactctgtctcaaaaaaaaaaaaagacttacacagaagacctgaaactgtaaaactactacaagaaaacagaggggaaaaaaactacaggacattggtctgggcaatgatttttcagatttggcctcaaaagcacaggcaacaaaagcaaaaatagacaaatgggattacattaaactaagaagcttctgcacaataaaggaaacaactaacagagtgaacagatgctctacagtttcggagaaaatacctgcaagccatgtatttcatagggggctaatattcaaaatacataaggaattcaaacaactctttagcaagaaaacaaccccatttaaaaaatggacaagggacctgaatgtttctcaaaagaagacacacacatggccaacagatatacaaaaaaaaagctcaatgttcctaaccattagaaaaatgcaaattaaaaccacaatgagtatcatcttgagaggtgacaacatgctggtggccctcgctcgctctcagtgctatcttggcctcggtgtctgttctggctgtgcttgagaagcccttcagcctgcagctgcactgtgggagc

SEQ ID NO: 382 - DNA, 30822 bp, Homo sapiens
agcaagaccccatctttaaaaaaaaaaaaaaaaaagatttccctgtagcatttagtatcagaattgccaattatcatttgtcagtaggctccgaaatagactttgggcatgtttttaagtagtagtgatagattcttcaatacattcatattccctctcatcatgtaagagtaaatagaatcaaggatatgctactataggcccatacaagataacagagggatgctatgcgttttttgtagtaactgttcaggttgtgcccgtaagaaggtaaatgtacgggcagatcacctgaggtcaagagttaaagaccagcctggccaacatggcaaaaccctgtctctgctaaaaatacacaaattagccgggtgtggtgatgggcacctgtaatcccagctactcgggaggctgaggcaggagaatcacttgaacctgggaggcagaggttgcagtgagccaagattgggccactgcactccagccctgggcgacaagagactcgtctcaagaaaaaaaaaaaaaaaaaaaaagaaggtaaatgtagacctagaagcagttagacaactctagttattaagtcaggtgtggttgtcttaaatttggaattgaatcttaaaattgtttcactcaatgttttggcaatatcgtaggaagaaaacatacctgcttattcttaccaacaagaatgcttacttttgattcaggttttctaaatttaattattaacctgtagtttccacaaattttggtacattatttcagtctattttctaaacatagtagcctctagcttctggcaattcattgttactgttttttaaatcctttgctgcctttggaagttttcttgaacagcagttgaccaacaggtaaatatattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgttcttctcttttcccccctcactactgtacttggctagtctacaaaaaataataaaaatttaaaaactaaaaaaaaaagttaaaaaaaagtttttaagttatcactttggattatattccagaagttaaggtttgatcacaagaaaaaggatagcttattgtacagggcttatcattatgtttctttattatttaataaaaaaccaaaattctgttgtcttaattgtttctttcttctacccctaaagattcctattctagaaataaaattgaagatccttccagttcttggatttctaggtggagtaatattttcctgttcaaattatttccatgttatcctccatggtggtgttggcaagaatggatccactatagcagtaaggcaataatttcatcattcagtgtcaattttatgatacattttcttatcaccagttataaaaagattaaaatatgccaaagttcaagaatggggaaggaaactaagtatcttaaagaattcattttaggcacatagtacaaaagcattttaaaaacagtttaaactgatattttcctctttctacaagcttgctctgcatagacttttctgacatctagtttcattactgcacataattaagagttgccatttgttttcctgcattttgtgccttgaactaatagcagagaggagaaagggtagggaatgtatgagttcctgattgaaagcaggaaagtggccagaggtcaatggtttcacatatggggggatttattactcatcaagtaaattttattgaaatttcactgaaatatatttaaaagaactattctaatatttcaaaaggtaaaattttaactttaattcttaagtgggtatactttgtgcttgtgttctttacaccttgctcatgcaagtattaaatataatgcttttgtattttttcacatttgttttttaaaacttcagtacttttaagtgggcaagagttgggattcctgcaaactttttaaacaaatataacacctatgtttttaaaaagcctattgtcattttcaaggtagttgaacagaagaagacaagtacttattccagtgataccatcttataccaaaccattgttataatgcctttttcagggccgggcacagtggctcatgcttgtaatcctagcaattttggaggccgaggcaggtggatcacttgaggtcaagagttcgagaccagcctggccaacatggtgaaaccctgtcgctaccaaaaatacaaaaaaattagctgggcatggtggccatgcttttgtaaatccagctagctacttgggaggctgaggcaggacaattgcttgaaccaggaggcggcggttgcagtaagctgagacggtgccactgcactccagcctgggtgacagagcgagactctgtttcaaaaaaaaaaagaatgcctttttaggattgctttaaactatagcatattcactttaatttcttttgttgtatagttcaaaatttctatcctttaaagtcatttggagcaaggtctaataagatattaaacattagatatagcatttttagtaaaaaaaagtctcattcttttaaaagacgtgtaagtagactttcgagacaatttcaaagggatcctcataattgacaaattgtcaatatttatgaatacactttatatacataattcaaaagcaaagtatacaattcatctagaaatataagttctgatatatttggaaaagttgtcattttttgaggtgttttgtcagttgatctcagtatagtactgtgcttaggaatacatgttgcttgactgtggatgataacatagaacaatagttggaacgttaagttccattgaagaaaacaagatgtagtaatgatcattgtctactctaaagaatatttttgaccagatgcggtggctcacgcttgtaatcccagcactttgggaggccgaggcgggcagatcattaggtcaggagttcaagaccagtctggccaacacaatgaaaccctgtctctactaaaaatacaaaaattagctgggcttagtggcgggcacctgtaatcccagctactcaggaggctgaggcaggaaaatcgattgaacctgggaggcggaggttgcagtaaggcaagatcatgccactgcacttaagcctgggtgacagagctagattccatctcaaaaaaaaaaaagaatattttcattaaaaaaactgttagatgtttgaaggatgacttaaacacaagttaggaagtggttggtttcaaactcttaaactggtatttttccaacttttttaggagcagattttttttcttgaatgagatttaagaatcataatataaagcactattagatttttataatttattactatacagtgtcatgtatataattttataatatggtattactgtaattttatagtaagttctaacttaaaacatgtaaacttaataaacaagagtaaagctgttcttgtgaacccatttaaattggttatagatttaataacctcaataccaaatttatttcaatattttatttaggataagcagtgccgagaggatactaattcacatagataaaaatgtaatggtctggattttacaattttacataaaagaacatttgcagtctgaatgcaaaaagaaaggaggtggggatgttggtgtagaaagaaactaggataagctgggtgtggtggctctcgcctgtaatcccagcactttgagaagctgaggctgggaggatcgcttgagcccgggagtttgagactggcctgggcaacatggggaaaccctgtctctactaaaaacacaaaaaattaaaaaaaaaaaaaaaaaaagaaaataggaaaaaagaaggaaacctgaatagaactaaactattcttactcttcttcatcagtgatattttgtagaattggcagaataagctctatttcagtatctccacaaaattatgttaatttggcaatccacatgtggactgccttcgatgtagtaaaagttgatatagaataaactgcattaatttttagccagtttaaaacgtgtgtgaatatcaaactggaatcagacatctgtggcactgtattatgtctctgtcaccctcaggttctatgaaaccttggaaagcacaactcaggtttgtatactcctgtaggccatacactacatcacactgttctttaggcctcttgcacaaaatagatggtcagaaaatgtctacattgtaataaatgcagtgttaaaatgtgatactgattttctgctttatcccttagggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtaagaaatttttattattcatgatataaataatatacttagtcgtcaaacacaaagctggaaattatttcataaaatgtataggttttcttttgtagtgtaaaatcataataattagctatttgtgctccaagcaaaactgtgataagagttatattcagttaaattgtttagctgtagttatcatttacaactttctgatatcaagaaatttaaacactggaaactttaataagctacccagttgtgaatttgagaaggtgtagaaaagtattcttaaatgtgagattaaatggtctgttttaatactgaattaaagttataattaattctgtcgtaaaagctaacacatttaaaacttaatagtaaaattattttgtttaatttttttataggtagctcacatgaccaaaagtgaactatatcttcaagacactgtctttttggggccaggtcttttgtttttagaccagtactttaataactttatagacgaatatgttgttctatggatggcaatggtaagtatttttctccattttatttattttttaacaatgcttaagagctatttcagtgagctatcagtagcctcaagatctagtctaggccaggcgtggtgactcacgcctgtaatcccagcactttgggaggccaaggtggacggatcatttgaggtcaagagtttgagaccaacctggccaacatggtaaaactctgtctgtaccaaaaaatacaaaaaattagccaggcgtggtggtgcatccctgtaatcccagctactcaggaggctgaggcaggcaaatcacttgaacctgggaggcagaggttgcggtgagccgagatcatgccactgcactccagcctgggtgacacagcgagactgtgtctcaaaaaaaaaaaaaaaagatctagtctatacaatatatacaataaatgtttctgagtatttaaaattacttcttctaagctgtgaataatattatattgtgtgtagaaatggccacatatctataggccaggtttccaacaacctggattcttggaaacacaactgtgtacctaaaaatagctatatttttctcccccaaaataccagtacaaagatgccaaaaaccactttactctgcccaaagactttattcccagtttacagcaagtaacaggaaaattagatggggttagtactagcaaaggtgggcactttattgcatcgagaattgtcagctaatattgaggaaacaaaacagaatagacagtgctactaaatacaggattctcagaccattttatgctagatgtaaggaaccctttttatgtgtatggcccttgaggatagtgtataatttgtattaatgatgactcagtcatcaattaaattaaattcgctttgattatatcctgcttaaggaaacgacgtggatgacataatttctattcaaaatgattataaaatacagaatatagtgcttgagagagacacgttagccatctaaggaaaagaaaatcaatattggtaacacttcaattacaaagttggataaatggagcattattacattttttttctattgagacatatctttatggttggtctccaattaatggtggctttgaatagttttcttgtatttctatctctggacccactggttgtcaccaaattcatagtgatatataaatataccgaagtacaccaaaacaaaaccccccaaaaccctgcagtgaatcttttgataattcaaataatctcaccgtatttgttagagttggatatttaaaaaaatctgtatctattctgtgcatggattacaggagtacatctaatggtcccttactaggttgtgtagtatgctttttctggagtaacttaataacgtaatattcattcatagtccattcagaagtcttcattcttcctatggtggcagtgagatatacttaattctttgaggtggacaatgaacgttttcaggcaaaattaaaaaaaaaaatgtttaaaaatcagaataatgtcctttaatttggtatccactataaatatttttagggctcccaaacaatccagtttaaaaaataggggataattaatcaaaatatctaaaaactcaatgtaagttttcttttagtgaacttaggtatgtattaccaagtggaattgctgaattaaaataccaggtgttaaaaaaatcaatcatctgtcgtaacgagtaattggcctggtttacacctgtgatggagactggtaaactgaggaagtcaaattcaatttttatttaaaacactatgtggatgacaaaaaaaaaaaaaaaaagccacacacacaatgtggtacttttcaagtaagcttttaacataaatgatagagattttcccctcatgggtgagaattccctctccaagggcagagctatgagtctcctttttctcctgggtttcattttctgaagagaagcatttgactgtagactctgggcaaagtttctaaatagaggccatctttaaatttgtaaacacaattctgtatatgcttcaagtatggtatcttttctagaccttttaccttcttacaactaacctcaaagaaacagaaatgtatatgatggaattaattcattataagatgactgataacttcttctagaaggaaatttgcagcttcgtggcacagcaggaagttgaaacaatgtggagtcaggagagttgggttctgttactttctagtttctgtattttagtcgtcttttttacctctgagcctcagtgtctataactgtgaaataacctgcattttccagaggactacagtgaggtccaaatttgaaatgtattaaagtgctttaaaatgtagtatttttggtgaagaattttaggttaaggtttgatatttgggggagaaacagaatagtgctacttgagaaaagatagatcataatcgattttatattttcttttttgcttctaaaggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatcaaaaaaaaaaaaaaggagtaatttgtgtactacatctgttttaggcaagaaaaaggtatattgaagaaaacagtgaaagatgatattccttaaaagcaaaaaaacatacttatgggaattaagtacacagaaaacactggagtacttattttgcctctaactaactattggtaaaacttcccaaataaggactttcttacaaggatgaatagtacttatgatttatattctaataatatatactttggcttaaaaggaaaatcctttacaaagttcaaaaatttaggaaataatgtcaaatattcgttaatggtggaagactaatttcttcctgtacaagtaggttgtcacaattagaaaaagtttatctgtaggcacctgtttttttaaaacttggaaaaccttattataactaagataagggtgagttatacaggcaaaaattagaatttaaaacatagaaaagcaggaggccaggcatggtggctcacacctgtaatcccagcactttgggaggccgaggcgggcagatcatttgaagtcaggagttcgagaccagcctggccaacatggcgaaaccccgtctctactaaaaatacaaaaataagctgggcgtggtggcaagtgcctgtagtcccagctacttgggaagctgaggcaggaaaatcgcttgaacctgggaggcggaggttgcagtgagctgagattactccactgcactccagctggggtgacagagtgagactccatctcaaaaaataaataaacgcagatgtgatatatataaaccataagaaattaggtatgttaatgatgtgctcttaatttaattgcagaccaagcccaatgaagtgacattatgtctttgtggcaatgacatattcacaaatccatgtcttaaaactgttatttatatattgttctattgctagtgatttaatgttcagaggttaatgattttagcaatttattccagaacacaaatttaaatgcatcttattgtcattagaatcggttgtacaacttaagtatatagaaaaggatgtacatgtaaaatagattttgtattccgttttttccttaaagaacataaccttctatacttggttttctaccttttgggattgatagagatacaatgaagccaaacctaaaattaaatcgtctttatttaattgacagtgttagagagaaaaattcactatcattactaaagagctgaaagcttaatacatattctttaggaatagttgctaactaactcataactatttagatttgacttaacagaaagggaggtcttacaatgaaacaggtttatgattaaagatgttacaattaaactattctaaagacttacaatatgcttcttagctaacgttataattgtatcatattacttaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgcttatattaatccttattttttcaatttcaatatgatcacttacagtttccatcataatttttttttgcaacatagccatttcttttttaaattcattttgtgcaccagtaagtagattatcatgattcttctccaactcttccatactctaaaaacacaaaagacaagttaagttacaaaggaccacttttcatctcaggttctaaacttgtacaattaattttcaaaagtagtaatttttgaatattcaaatgctcatctatttgaaataaaaatattctaagtaatacatgaataccaaaatacctactaaaaaagaaaaaatataagacatgaataaaatgttataggaagtacaatgtagtatactttgcccacaatgggtttcctgaactgttaaggtcaagataaaaaagactggaagtcccacatcagtaaaaaccatttctattaagctttccaaatatcaagcaataatctacttatgactaatagtgtgccatgaattcactagagggaataaaataatctatagtacaacctctttcacattatgaaaaataaaaattatgtcttacgtctttattattcattcaacaaacagttaatctggtgcctactatgtaaaaggtgtgtattaagtgctgtagagaaattaaaaaacaataatacatgattgcttcctgatggcaatgagaaaaaaacataggaacaaaacaaaaattttataataggaatggaagcacaacttgctgtggtgatatagtggaaaatggggattaattccaatttagtgggcaaaatactaagatttcaatagataaagaaaaaggagttaaatatattctaggggaagggcataagcagaagcatggaagtacatagtgagctgagagaaagcagttatgtggaggggtggggtaatgaacaaatgtagtaaatgaagcttaaaaagagggtcatgtcatagggggatcttcaatacctaagaatttagaacaggaggctactgacagtttttcaagagggaagagatatatttttaaaagataatatggcagatctaggagggatagattggagaacagagacatcagttaagaattttaatggtacaagcaaataataatgaggtcctaaactagggtagtagcagtgggcattaaaagaaagaaccactgcagaagtaaaaattacagggcctagtaataactggatgtgacagagaaaggagatggaagagtcaaaggttatactatagttcctatcctaaatagtaacatttagtgataacatttagaagaaatctttatctagtactttatcaaaacttcacaccaactaccaaatggttctcagagcattggaacaagacaacaagttttccacttggaaatactttttaaaataacatgtgtgtgtataattttttttttttttttttttttgaggcagggtctcgctgtcgcccaggctggagtacagtagtacgatttcagctcactgcaacctttgcctccagggctcaagtgatcctcccacctcagccttcccagtagctgggactacaggtgagtgccaccatgcccagctatttttgtttgtttgtttgttcttaatagagatggggttttgtcatgttgctcaggctggtcttgaaaccctgggctcgagtgatctcgccttggcatcccaaagtgtcagccactgtgctcggccatatatattaaagttattctgaaatatttattttaaaacaattttgctagtttacttagagcatcccaattcctttaatgttattttaacatgtatttgcacaagactatctaaaggaaccaccactgaaaaaaagtatatgcaagattccattgagcttctatgaatagttactaaaaagtatatttctgcctgaacaagaggggtacagactacaatttgctaatatgtatgtgtcagtagataattatcaatccacagacttttaatcctcagatgtctattatatctgttattttatgttggatataaattcatttttggtcactgtaataattctaaaagcaaatgtgccataaaatacttctataatacatttgaaaacaagagaattcaataatttgggtactttctatttaacaaacactggggataaaaaaacaagtaaaatacaacctaaaaatgattattatagagtctattttcacttaaacagagaactatgactgaagtgttattaaagtatggattttatgcatgataagtatatttctaagtaaaattcccaatttaccatttcctgtcttgaataatcccaacaaaaccatttgaatcctcaagtaaaaatatatttatcacttaaatcagaaacaatgaattcaaaatggaaaagtagttaaagtctaaaatgttttttcccataaacttagaaagaattatcttctacttccataaatatattatgttttataacgatgtattgtgttaccacatacaacaaacctttatgaactgctcatataactgtttaattgttttcaatctctggctctgaacaattctagattgttgaagaatcttttgttgctgtcgaaacatattctacaaatataaaagaaaaaaaactgtgtaataacaatttgggtaaaattttaaatttagaaaaaataattctacattaaacttaaaagaaagtgttaaaaatcaatgcttttaaaattttaacaactattatgaccacatttagataatttatgttcaccactaatatgtaacaatatattaattctaccagttgctgaatgggaaattttaacaataatcaagtcatgtcttaattcttggtgatttcaatgtccacacagatgatccttccaataataatggttttccgtttcgtgacctgtttctcaatgattttggcctctaccctactttagccattgacttacatactcccaccctagattttgtcattactaataattctaaccactacacagtattagtaatggtaaactttctaagagatagatactcagcattcccctttcatagatgagtaaactgaggcataatctgtccatggtttcacagctacaattgctcaaacaagaatttgatccaaaacagtattgttgctggcatccaggctctaaccattatacatactgtttctctgtctatcctagtatttaaccactacttctttaccattctaacttactctttttagtactacagctcaataatctatcagtgccacaaatccatcctatctattttacactgtcatccctacccccaatatcctcacttgcaggtaacacaagtctggccattaaaagtcaacaatgttctgactacagacatccttaggtatcctggggggaccagttccaggacacccaacccctcaggagaccaaaatgtgcagatgctcgagttcctgttacaaaatggcatcatatttgcatataaccaatgcacatccttccacatactttaaatcatttctagatctcttataatacctaacacaatgtaaatgctgtatagttgtaacactggattatttttccaatttgcattttttcttttttctttttttttttttttcaagaaagggtctccctctgtcacccaggctggagtgcagtggcacaatctcggctcactgcagcctccgcctcccaggttcaagtgattctcccgcctcagcctcctgagtaacttggattataggcacacgccatcacagcccggctaatttttgtatttctagtagagatgggttttcaccatattggtcaggctggtctcaaactcccaacctcaggtgatccacccgcctcggcctcccaaagtgctgggattacaggcatgaaccaccaccacgcccagccttttccaaatatttttcatccacgattggttgaatacacagatgcggaacccttatatacagagggctaactatacaatgattggttcaagaatgggcaaatgatccaaactcccatcagtcatattttcccagaggaattttttgccagagctattgagaaagattttctcagtccactggggttactaaacttgtaataagcctaggactgtaaaaactatcttgcttactacatcaagacaccttactaagtactgatgacagaacccagatgacactacatgagcaaccccctccctgttcccatctggctatgcctgaagctaaactgccccgacttcttttacataaaccaatgatccttcttttgtactttgacaaatttctgtcacttggaaatgcaggaaccccaaacaatataaatgccttttatgagtatggtatgtgcctatacgtctgtggtttacagttcagtaggtttaaaacacatggccagcaatggttaatgaaacctggctcagttccactggtcacaataaaaggctaggttgtccattcctacttgagacttggttgattataaacctaatcatgataccaacaagtattttttcttcttgttcctcagctttctgcatatctaaatcccactgctgaaacaaagtcagaaactgctgagaatattcttggttaagcttctgcctgtaaaacataatgatgaattattgtcatatttcataccaatataaaaagaatttaaaacaaaactgagttgacacagttatactatataagaaaaggaaatacctgcagcttaagtcttctgatgggaaaccaaaaagtaaaattatgatttacactgattccagaagtattttttttctaacaaactaatagaagaaaagccctgtcacaagctttagctcttgaaaactaaggaagttttattgtatatataaattttcaaaaagaaattcatctgatctctaagcagtttatttttcatttttttcctattgaatatagattctgatataacaaatacattaaataaggtgattgtatttatcctataagatttctaaatagaaatagttcgcttaatttttttccctattttggcttaacaaaagattttatacaaaagaagagttaagtcagctaaaacatacaaattatatacgatacaagattggtgttcttctacattgttgaacataattcaccatcataagactaacggtttttatgacatttaccttttattcaactagtgtatttctagaatgaacataaattacttttaggctgggcatggtggttcatgcctataatcccagcacttgggaggctgaggtgagaggatcgcttgagcctaggagttcaagaccagcctgggcaacataatgagacccccatctcataaaacaacaacaaaaaacgaaattacttttataacctcacttgttacctaaaaggaaaaaagtgatctttattgattttttaggaaataatgtcaattctatgaaggagtgaggttatagggctacaggactatcatacttagagaaaaatcaagccaaatacattttcactagaaaccccagtaactagaatagtatttttcttttcttgttttttttgacagagtctcactctgttgcccaggctagagtgcagtgtcacgaccttggctcactgtaacctctgcctcctaggttcaagcgagcacgcctggttaatttttgtatttttagtagagatggagtttcaccatgttggccaggctggtctctaactcctgacctcaagtgatctgcctgccttggcctcccaaagtgctgggattactggcatgagccaccgtgccgatcctagaatagtatttttcataagtaatttataccagtaaatactaagaaatgtggctctaaaaaaaaagcaaccaccttacctttgatcttgttgtgttttccaaacatgttcaattttctggttactagttttgagagaagccttggtatacatttctagtctctttctcttggcaagaagagccttgttaatgtcaactagattgaaaataaaaattcattaaaatttaatgttgaaaaaagtattttgttcccacatattcaagtaaatatgggtaaggttggttcaacaatattggaaagacatttaaacttaaatttagaaataggcataatttcaaaatgcagaattgtttgcttactttttttttctgagaaaactctcagctactagcacccaaattctgattttcctaactggagataattttttaacttaggaacaataaaaaagagctaataaacaaaacaatgtgtcaaggacagactttaaatttccccatgagaaaacactgttaataaaggctaaatgtaggccagacgcggtggctcacacctgtaatcccagcactttgggagtctgaggcaggcagatcacaaggtcaaaagatcgagaccatcctgaccaacgtggtgaaagcctgtctctactaaaaatacaaaaattagctgggcgtggtggcgcacacctgtagtcacaactacttggcagactgaggcaggagaatcgcttgaacccgggaggcagaggttgcagtgagctgagattgcaccactgcactccagcctggggacagagtgagactccgtctcaaaaataaaaaaaaatttttaaaaaggctaaatttatctaaatttataaaatacaccccaattaaaaggacacatttcaatgaattattgttagaactcattatagaaaatatgtaaaagtactctattagaaagaatccaaaaaggataaaaatagttaaagaagaaaactatttttaatataatcaattttatatatatatatatatatatttttttttttttaaagacacgggggtctcactatgttgaccaagctggtcttgaactcctggcctcaagcaatcctcctgccttggccttccaaagtgctggaattacaggtgtgagcccctgtgcctggccatcaatgatacttttaaatacattttttactaagagacaaagaccaaggacagaaaaaaatcttagtttaagtaaatttctagataaattaagatcactttatttttcaatgagaaataggtgaataagatcagttttaaatgcttttgtggagctctttattgggcatttttacccataagaactgcatttcataaaatgtttactacttcaaataatgctttgctaaacataagcctttatcttatggatctaccataaataggtatctttcagtaatcatgctgtagctgcactattacataaatattttatactttcagtattatctataataaatttataaaacaagcactgtttcaccaccggacagagcaaaggtttcaaaaaagagttgactgtatgaacaatccatttagaggagctaaatattaactcttttttaagataactaatctctaacaaagctcatattattgatacttaatatattatttaaaacttgagaatttttgaacctaattataaaactctatctagcaaaattgtctttagtatcaactacatagtttattaatgtaaaaagagttattttagaggcttaatttacactgtcctccctaaagaaaatagcataggaagtcagaaaataactaaactgaaaaaatgaaaaacttatatacaaatatatgtatgtatgtatatgtgtgtgtgtgtgtgtgtgtgtgtgtgtgtgtatcacttagtctgtgaatacaaagaagggtaaagacttttcctgtgcatttttcttctaaaattccatagtccattaaattcacatatgtataaaataccattcactcttaacatcatggaaaagattaactatgaaaatctgtgatgctaaatcacaaatacttatgcagaatcttctatgtgagaacaaggcattaaataacagtcttatagtccattattaacatttgttattatacaaattatatggcttaaaacaattttctttaaatacaagtatctcctaaaacctacctccaactccttccagcatattctgcacttcacccctggaaagaaattacattttaaacactttagaagatccacaacataccatgcttgttttggaagaaataccagatgccaagtattttacatatattatttgttagcaacttttcttgaagtgctttatctaagaaacaaaaattattttgaacacgttaccccatatcttcaactactcctgcagaagaccttttcttcctacgtttctcaatgactgcagtcttccctgtattgacaattaaaaaaaaaaaaaaaaagcttttgaaactgaataggttattttggtaaattttaatgaaacatcttcatttggggatttttaggctttttgccaacatacagtttcaaagcagacataaaaatgcaatattctctgcaggttaggtgaaattaaatcaggattcaggaccattttataggaataatttttcaagtctccctgggttaatgtcacagtaagccacatactatatatcagatattttggaaataactgcaaaagcaagagttgccgaataagcttctgtaactccgatactgcaatataaggatcaaatgagaaacacaagtacagctggccatccgtgtcagcaggttctgtaaccacaaataccgggggagggaagaccatacctgaaaatgctttacaaactaagttgtacgatagtctcaatgggttcaaaacaaatgaactgaaggacatcactgcccaacatgagatgtactgcaccttcaataacatcttcctctgatccactcagatctttcttatcttcagtctcaaagtcataggctctcgtaaactgatcttccacagacggcttcccagatttcctggaatacttttttccggaggacaccatatttagatgcttcctgactttaaaaaacaaatttctttaaccttctgaatgcaaagacatcattttaatacactggtaaaagtttaaatatcaaaggagatatcgaacaaggattgttgaatacaattttaacagtttcctcatttatttggggggccaaaagttaagaagataatgacatttgttaaaaaataataaaataaataggccaagcacggtagctcacgcctgaaatcccagcactttggaaggttgaggcaggcagatcacctgaggtcaggagttcaagaccagcctggccaacatgatgaaaccccgtctctactgaaaaaaaaaaacaaaattaaccgggcgtggtggcacgtgcctgtagtcccagctgctcaggaggctgaggcaggagaatcgcttgaacccgggagacagaggtcacagtgagccaagatcgcagccactgcactccagcctgggtgacaagagtgaaacttcgtctcaaaaaaaaaaaacaacaacagaaatggccgggcgctgtggctcatgcctgtaatcccatcactttgggaggccgaggtgggtggatcacctgaggtcaggagtttgagaccagcctggccaacatggtgaaaccccgtctctactaaaaatacaaaattagccgggcgcggtggcgggtgcctatgatctcagttactcaggaggctgaggcagaagaatcgcttcaacccgggaggcggaggttgcagtgagctgagatggccccactgcactccagcctgggcgacagagtgagacttcgtctcaatcaatcaatcgatgagagagaatgacagtgtccaccccgactccaagcgcgcagtgctggagaggtggcccctgaggcctgggagttccaaattttggggccgcctctgccagattctggctaaatctgggcaactctagcagggcgctcagtcacgcggggaaattatagttgctggcgggacacgacatgaggatgccagaaataagctcataataatcaagacaaataataaaaacgtcccgcaatttaggtctcggaaaatgaacacaggcagaagatttcgacaacaaatacatcgaggaaccacgaaaggcgccctcggcgtggagcgggcaggagggagacgcgcggagcgaggtagggccctgcccggccccgccgcgtccctcctgtaagtggtcccagggtgtagcgatggggcccagccccagcccagcccgcccgctttccactaggccctatcctgctcaaggccctgtcctcaggttcgcggcctccgttttctcgtcagaggccccaggcgacgccaggaggtaagatttacctcactggtcaagggcagcctctggcctggacacctgcgatagacagacgcctcccctgctcacacctgaaacacaccgcaatggccgaggaccagttactggtcgtcgacaggcgtcctccacaactcctccacaagcgcgcttcacctgaggtggccccttctccgcgacgcttctgaggcaagctgggattcgcacaggagaaaagccagtcccgcctcatccggacacgtcgctgattggctggacgcagagcgcaggcgtgaactgggtggcgaggctccgcccccatggggcgattgcgcgcccaaatagctggcccagggtgctttggccgccggagcgggttgcgagtacacttgaggcctggtgccttccagtttttaagttttaaatgtttataatcgaaaattgcagctaggcgcagtggctcacacctgtaatcccagcactttgggaggccgaggcagacggatcacttgaggtcaggagttccagaccagcctgtccaacatggcgaaacccatctctactaaaaatacaaaaattagccggacgtggtggcgggcgcctgtaatcccagctacttgggaagctgaggcaggagaatcgcttgaacccgggaggcagaggttgcagtgagcaagaccatgccattgtactccagcctgggcaacagagtgagactccatgtcaagaaaaaaaaaaagaaaattgcggaataatatgtaaattatgaaacatgatgaacataccacctaatttatgaagtagggctttaccaacattcactgaatctcctcaggcaggcctttccatccgatcctcaccaggaccccacccttccccattcagggatataagaaaattatcctaaatttatgtaaatcattcacccttccttattttctaagttttattaccacatgaaaatgtgtcgttaaacaacacggcttagtttcgttcgcgtttggcattacaaaaaattgtcccatagtctatgtagtgttctgacagtccactagaatggcaaaactacaaaatatgactacacggagtgatgatgaatctatgtaacaaagggaacccattcagtgggtgggagtataattgtaaaacaattatttggtgtaactggaaatcacctatcaattgcaaaacaatttttgaagatacaatttatgaaggaaatgaaactcacctataatcccactacccagaaataatatacagtttaaaattgggggtattattgcctttcatccttttttctgtgcttatatgtattttcccccaaataattttaaaatatatttcaacctttgtacctgccttagtttgctcacagctctgcaatcctttttctatttgaaatcatacattttactttttttttttttttttttttgagacagggttttgctctcttgccaaggctgaagtgcagtggcatggcatgatcacggctcactgcagccttgatttcctgggcccaaatgatccccctgtctctgcctcctgcgtagctgggactcatgcacgtgccaccatgcctggctaattaagaaaaaaaaaaaaaaaaagtttgccgagatggggtctcactatgttgcccaggctgttctcaaactcctaggctcaaatgatcctctcacctcggccttccaaagtgctgggattacaggcatgagccaacttgcctggcctatattttacttctttaatatttggcaaaggcttcaggatcttattgacgccaatcacttttcaactgcctagttcaagtaagagattcaaaggaaccctcctgtttactgttttgctttgaatcctcttccttatgatgctcagcattccactggctcgtttaaatacaccagtgtattgggtaaggaatgacggatgacgactcccagacttgttcctgtaattccattcactacatcaaacctgttgatacaggatacagtgaaccttgtaaatttttcattactgaaaggattcaaaaaagtttgtaaagcgttagtacagtacctgccacataataaatgtgccataaatggtggcttttatgattgacaattggtcccaattggaatcctgcttttcctctcttgccagcctcattcttggcctcatactgcatcagccacattgcgttttcccaaatgtgctgtgcactcttatgcctccatacccttatagatgctgttcttattaagtagttccattcactacatcatcatattcagttgtttttcctacagtgacccttacagaagagcatctgtcatttttcttctttattcgtaataaaaatttcccaagattatctccagcaccttggcatttcactgctgtaaagagcatgtctggagatttcaccatgtgcttcagcaggtaatttatagatgatttttaacccacacaccaatatttcatgacctgtctcagcattcattcttagatgaccacattgttaatacttccccatatagatcatcacccatttattccaatcatctggattcctaacaaaacattttcccattttctttagtaaccaatggtgtagaatcttgtcattattgtttgaaaacctaaatattacatcccttgtttccttactcagtctcaaagaactcaggtaatatagtcgaaatcttagaggccaggagcagtggctcatgcctgtaatctcggcacttttggaggctgaggtaggaggatcgtttgagcccaggagtttgagaccagtctggacaaaatggtgagaccccatctctatttataataatttttaaaaactcatagaaatgtctccatagataaactactcagtaggtaataagaacagcatctttaagggtatggaggcataaaagtgcacagcacatttgggaaaatgcaacgtggctgacacaatgaggccaagaatgaggctggcaagagaggaaaatcaggattccaactggcaccaattgtgaatcataaaagccaccatttatggcgcatttattatgtggcaggtactgtactaatgctttacatttttttaaatcctttcagtaatgaaaaatttacaaggttcactgtactctctatcaacagatttgatttttccaattgctttcaagtatggcagcttgccttcaccttgagtacctaatccaggaacttggtcttccacctgcaccatctctaatctgtgaagctggaaggtgatgttttgtaagcccagcatccctcccctccttccttgggtaaaaatctccatccctctggctacagaggtgggcacagagcccagaatgagccaatcacagtaactcatctcccaccaggattttctatattgaagccagagaggaaacttcctgcctctctggagtatgtgagccaggaactgccatgtcctcaccaaggagagaaaagctgatgtgcatagagaagcacagatagacagtgctgagcaatggttcaggaagagtatcttcctcctgtacccctctttgtttttccttaagaagcttgagttagatttgtcccttgcaatccaagtttatttagtggctaaaaattaattttgtagagacttgggtggaaaagctgtctcttaacttaatagacctgaggtgaggcactaaacctagttaggccccagttccctcactgataagtggggatatggtgtggatgaaatgagattatgaacataaagcatttagcacatagattgtgtacagtaagatatagctgttattagggcaagtgagaggagaaaagcaattagactgacaagaagcccccttcacatccctttaaccaccatggctctgtactcctgtcacaaggaagcctgggatttcccttaaaacatatcacaaagaaaaacggagcatgaataaatgtggcaaagtcttgataactgttgagcagatgagaattcatctattggtctttttaaaattttttatgatcttttttaaagaaagatctgttgagattatcatccagtttcttttggtcctgctgatgtggtgaattgattttcaagtgttgggccaaatttgcattcctggagtaggccccacttgactgtgaagtgttgttcttctgggaataactgaatttggcctgttagtattttgtttgggattcttttgcagtagactgcccatggtttttgtcttgtggtatctgagccaagttttactgttggggttgtgtttcaagggatgagttggatgatactgtattttgcttttttctgctctctggaagaatttgtgtgggactggtgctgtttcttccttagatgttttgacgtaagtagtgattaccctttagtttaaatgcttaatctgttattatttgtatacttcttggtatatgtagaaataattttcaaaatgaacacttttgccaggcacagtggctcacacctgtaatcccagcaccgtggaaggtcgaagcaggagtattgcttgagcccaggagttcaagacagcctggataacagtaagaccctgtctctacaaaaatataaacaaaattagtcaggtgtggtggagcacatctgtggtcacagctgctcaggaagctgaggtgagaggactgcttgagcctgtgaggttgacgctgcagtcagctgagatcacgccactgctctccagcctggggcaacagagtgagatcgtctcaaaagaaacaaacaaacaaaaaacacttttgaagacataaggtaggttaaaaaaatcctttgtaattagaaaatgtgtcacttttttagctaagagcaatataatcatctcaccctaatgactagactaggagcctcacctctggcctggacaacagtctttaacacgaattttcatcattaccatcatcaccactgacatttagcaggcaggactatttgccaggcactgggctgcgtgtgttgcacatgtcatttcctctaattatcaccataagcctctgtggtagctaccagtattgcctcccacattttggcagagaaagctaaatcacggcaagcagtgtccaggatccaggacttgaactcccgtagtctgactgcagagtgtgctcttcacccacatgtgccacagtcctggggaggcagcatgggctggtggggacaggaaagagggacaacccgggttcccaccctacctcttcctctaactggttgtaagaccttgagcaagtcatgtcatccccgtggccttggtgtccttgccgataaaaagcaagggttcgtccagacagttgttttgaaactctgcccgaagggcctgggagctggagggaacaccttgagaatcaggcaggagaagcagccttccttcttttgtatcacagaatttttatctgtccaaaattcatgttgaaacttaactggcaatttaaaagtattatgaggtggggctttcagagggtgataagtcatgggaacagagccctcatcaattcaattagatgtctttattaaagggcttgacagaggcagtttgtgccttcttgcccttctgctctgtgaggacacggcattcaagaagccatcttaaaagcagaaagcagccctcaccagacaactaaacctgctagccccttgatcttggactctcggcctccagaactgtaagaaaatgaatttctgttctttgtaaattacccagtctgaggtattttgttacagcagcacaaaaaaactaaaacacagagtgaccttttctataggatttgaacaaatggttctgaccatctgactgctcatcaacttctgaggttcctctgttctaatgattctactgaatcacagaatcattagaatgagtctatgaatagcctatgattgtattatccatcccattatcaagctcctaattaggtatggactatattcatctaaccacagaaatcgtcattacagacaaatgttcatttctctaacttttctagaataaatctcagcttttataatgatacccagatatcctaaattttaccatatgataaattccatttagaaactattttccccccataaagcaacattcttctgtataatactaatctttccttactttccacttaattttagtaatgttcagcacagaacctgatacacagtaaaggcactcaagtgactgctgaatctgagtaacagtaaactcaatcctcaaagatttaaaaatcaaagtgtcagacaaaaatttaactttttatgagatttcagtttttgaaatacacaactcttacagcacaaacacagtatttacatttcaagttctttgtacaaaagatgtatgccattttggaagaatattgttgagatcatgatctaaaatacctgtcagagttactcatggaatctgctcttcacaaatccattgtattatgacataaaatatggctagacgccaaggtttaaccatacataaaaatactaattctcggctgggtgcactggcttatgcctgtaatctcagcactttgggaggcagaggcaggtggatcacctgaggtcaggagttcaagataagcctgaccaatatggtggaacccccgtctctactaaaaatacaaaaattagcagggtgtggtggcatgcacctgtagtcccagctactcagaaggctgagacagaactgcttgaacccgggaggcggaggttgcagtgagctgagattgcgccactgcactccagcctgggcaacagagagagactctgtctcaaaaacaacaacaacaacaacaacaaaaactaattctcagtgattggcaaatgatggcctgagggtcacatctggctggtgggcagtttttgtacagctgcaagctaaacatggtttttacatttttagagggttgtttgaaaaaaaacaaactaaacaacagcaagaagaatgtatgacaaagacacaggtggcctgcaataatttactaaccagccttttacaaagaaagtttgctggcctctgttctatcaaaaaccaactgagagagatagctactggaatataccaatgagtattaaacaagacaccactgtaatgtgccagtgccatcagcactactcatttctaaaatgaggcacttctgtttgaatatgtacatttccaaaacataattacatctggtaagtagtactaactctagccctttgaaattagacctgcacgtgaaatcatagcattcttaggggctgaagtcaataattacaaagcatttcagatgtcaatcattgagctcttcagtagttagtggtttaagaccatttacagtcttaaatattaataaaactcataatttaggtattgtcaataagaggtgatattgctgcattatttaaataacatctataaaaataggtttagacatcccaattcgttatactcagaagcaagaataactagttaacttagtaactacttaaaaatgggaaatgaaaaaaaaaaagtgcaaaactttagcaaaaggctttggaatgcaaagactggagcctcttagcaatcactcccagctggcataggcttctcctaataaagttagtctgcaatgattgctgtgggaaattaacagctgtctcttgtcagtgagcctttttataaaaaggatgacaggtccatgagcaaattctttaaaagtaaaatcagttcagagctgctcaacacacaagttttcagtgggttggttaaataattcctggtcagtgggctatattcatgccacaaaacagcatggtactggatattttccttcttcgggccaaactgctaagcatcacatcacaaagacatctctgtgaagctgagttttaaaatgctcagtaaatgctgaggtagatggttttcaaatgaagatcttctatactctgattcgattgggactagcttctttgtgtatcctccttctgggaaatatcttccgcttaagtgcaattaactaaatgatgaaagacagaaaatacattttaattctcacgttgatgaaagaatataagtgcatcaaactttctaagagccatatgaccttaatcatttccacaatcttatacattaaaaagacaacaaacaaatctccatcattcctcttccaaaacaaaaacaaatattagttttgtttagctttgtagggacagtatgcctagatatgtgcccacaaagagacccaagaggattaaaattatttcggcccatgcttcatttttctaagacctacaactacagatttttacacagctattaccaaagcatatttattttcaagatgtccatttgtcaagtctttctattgaaggaaactggctctatttagccataagacactgtctctgggttgatatgatggcttattccttcatctgtaggaggaggcagggctttgcccaaacataagacaccacggtttgaatgatgagctggaatttgggaggggaggaagaggcagcattggctgctttgtttgtgaaggtggcaggtatggcaggaggaaggagtttgactccagtagagagcagagtgttgggatttaacctgcccttcccttccctcttcctgcctctctagttccctattctctactggtatagatagactggtatagatagaggaaagactgcctctctagttccctattctctactggtatagatagaggaaagactgacactcctcttcctttccattaatggctgctcctttgagtcagggctcctttccttccccatcctaggtcagcacagcagactcaaaggtttctcactggaccctgttctaaaagcaggtacagcctttctgagatttttcataagacttttacctgccaggaacaatggtaacagacatcaagaacaagatgtacaatccctggaaagcagatgaaggttaagttgctgtcctgttcacctgcccagtctctgtttcctgaatttccttccatttacagcaagaagcccattcatttatcctgaagctctcagtacttaggtgcttgtccttcttggtataagtcaacttggtgtacgtttcatttgagtgacagctagaaaagctccactcaatagtcaccttgattggaggcagaggccaagtcacttgccacacccaagtcaggttggtaaagatgcccattcccctccttcaatcctttttcttcagagtatttgatatgtgaatagcctaatgaggactctcttatccctttctctttacctcacaaatctccctccgacttctggacactcacctcaaggaggctgcgtgtgtacatgcatgcagaggaaagcccaggtgtagaggggctgacaaggagaggaggaaggaggagagaggagggagaactcctagcgattgaaagaaagataaatgggagctactggtgtgagtgggacaacacaacggaaccgtgggatgtctgaagacactgtgctcactcaaggaagcgtgaaagagaggaagaaaattggagacccatagaaaattaacattagataaggattctagatggttttttggttataaatacttagagctacttggttttagcctgatatctacaagttaatctgttgagttccagataaaaagaatactggtaatggatttagaagagaaatgaataaaagactgttatatttgctgcctgaatattgtgaaacatatttaacatattcacatatgagctataagacaataagagaagttaaaattttgattgtaaatgtgtatcattttctaaaacattcagatgctagtataccaagaaataccatttaatacccacataaaatatataaaacttacctgctcagcaaaaaatgagaatatagtaaacataatcaatgttgctagtacacaatgggtccaaaacttcaatttgtctcgataagccctcctgtgcagagagaagaaagcaactatgtacttctgtatatggtttcactaccattagttaagcattatttatatactagttctataaaaacaatgttgggaaacacaaaaacattgtcttgcaattctaaaatgctcacacaatatacatttccaacacgagttcagattttttattatgtcatagtaaatattatacttgaattagtgaagttatccaggcaggagagaggacttcaaaagaaaattacttctggcacttaaacaaaaccactcttt

SEQ ID NO: 383 - DNA, 30077 bp, Homo sapiens
ggtttcaccatgttagccaggatggtctcgatctcctgaccttgtgatctgcccacctcagcctcccaaagtgctgggaataaaagcgtgagccaccacgcctggcctaggctaattatttggcttgtaagaaatctttcctaagtaccctttacccctacatcctcacaagattctctggcctccttccctgcactctgggacatttctttcgtttggctatacctaattcacaaaaaactgcaggctggacaaagtggctcatgcctataatcccagcactttgggaggcccaggcatgaggatctcttgagcgctgaagttcaagaccagctaggacaacatagtgaaaccctatttctacaaaaaataaaaaataaattagccaggtatggtggcacgtgcctgtagtccctgctactgggaaggctgaggtgggaggactgcctgaacccgggtggtcaaagcctcagtaagccatgatcatgccattgcactccggcctgggcaagagagagagactctgtctcaaaaaaaaaagaaaaaaaattacaatgttcaaaaataacattctgggccaggtgcggtggctcacgtctgtaatcccagcactttgggaggctgaggtggaagaatagcttgagcctaggagtttgagaccaccccaggcaacatagggagacccatgtctctacaggtattttaaaaatgtagccgggtgttgtgacacgtgcctgtggtcacagctacttggcaggccaggaggtcaaggctccagtgaactgtgatcacaccattgcagtccagcctggatgacagagctagaccctgtctcaaaaaataataataataggccgggtgaggtggctcacgcctgtaatcccagcactttgggaggtcgaggcaggcggatcacgaggcaaggagatggagaccatcctggctaacacagtgaaaccccttctctactaaaaatataaacaattagccaggcgtgttggcgggcgcctgtagtcccagctactcgtgaggctgaggcaggagaatggcgtgaacccgggaggcggagcttgcagtgagccgagatcgcgccactgcacttgagcctgggcgacagagagagactccgtctcaaaaaaataaaataataaaaaataataaaagattgtgggaaatagggattattttggaaaatataggaaaaatgtttgtagtacccatatgacttagttctttcttttatttttattttttttgagacggagtcttgctctgtcgcccaggctggagtgcagtggcgcgatcttggctcactgcgagctccgcctcccgggttcacgccattctcctgcctcagcctcccgagtaaatgggactacaggcggctgccaccacgcccggctaattattttgtatttttagtagagacggggtttcaccgtgttagccaggatggtctctatctcctgacctcgtgatccacccaccttggcctcccaaagtgctgggattacaggcttgagccacagcgcccagccatgacttagttcttaagattattaaataatacacctatacttcaaatgggtgaattgtctggtatgtggactatatctaaacaaagcttttttttttttttttcactctgtcacccaggctggagtgcagtgacgcgatctcagctcactgcaacctttgcccgggttcaagcgattcttgtgcctcagtctccagagtagctgggactacaggcacgtgccaccacacgcagctaatttttttgtatttttagtagagatggggtttcgccatgttggccagggtgttctcgaactcctgacctcaggtgatctgcctgccttggccccccaaagtgctgggattacaagcatgaaccaccacacccagccttttttgttgttgttgttgttttgagacagaatcttgtgctgttgcccaggctggagtgtagtggcatgatcttggctcactgcaacctccgcctctgggtttaagcgattctcctgcttcaagcctcctgagtagctgggactacgggtatgcaccaccacgcccgactaatttttgtatttttagtagagatggggttccaccatgttggccaggctggtctcaaactcctgacctcaggtgatcgccctgcctcagcctcccaaagtgctaggattacatgcgtgagccaccgcacccagccaacaaagcttcttttttttttttttttttttttttgagagagagtcttgctctgtcgccaggctggagtgcagtggcgtgatctaggctcactgcaacttccgcttccctggttcaagtgattctcctgccgcagcctcccaagtagctgggattacaggcacacaccactaagcccacctaatttttgtatttttagtagagatggggtttcaccatgttggccaggatagtctcgatctcctgacctcgtgatctgcccaccttggcctcccgaagtgctgggattacaggcatgagccaccgtgcccggccaacaaagctttttttttcaaaaaaaaaaaaaaaaaaggctgggtgtggtgcctcacgcctgtaatcctagcactttgggaggccagggcgggcagatcacctgaggtcaggagtcagagaccagcctgaccaacatggagaaacccagtctctagtaaaaacataaaaataaaaatgaactggcttggtggcgtgggaacttgggaggctgaggcagaagaatggcttgaacccagaaggcagaggttgcagtgagccgacatggtgccactgcactccagtctgggagacgtagcaagactccgtctcaaaaagcaagcaaaaaaacaaacaaacaaaactacaggctacagaaaaaggctgagaataaaagaaaaaatacccaagcacactccacctagattaacaaacgtttaacattttgccatatttaaatcagacttttaaaaaaagaaacaaaaagttacagatatatttgaagccccttctaatctcattccaggtcctgtttccttcccttcctcaccagaggctgccacaacagggtattacaagtattttttttacacatctactgtctttcccatggaactgagttccttgagagcagggacaatgacttacccaatgttgtatctctagttcctggaacagaaaggggctcggatatcatagacaagtggatggaaggagaggtgggtagatggatagatagacacatagatgaaaggtagaaagaatagatggaggtggccgggcatggtggctcacacctgtaatcccagcactttgggaggacgaggcgggtggatcacgaggtcaggagatcgagaccatcctggctaacacgtctctactaaaaataaaaataaaaattagccgggcgctgtggcgggcacctgtagtcccagctactcaggaggctgaggcaggagaatggcatgaacccaggaggtggaacttgcagtgagctgagatcgcgccactgcactctagcctgggcaacagagcaaaattccatctcaaaaaaaaaaaaaagaaagaaagaatacatggaggatagatggctgatagaagaaaggatggataaacaggtgagtgaatgaaaggatgggcagatggagggaaggaagggtggctagatgggaaaatgcaaggaggaatggatgagtggctagaaggacatgtagatggatggtggaaggatggatggatggaaagacagaaatgtagaaccctagcctacaacacaatgctggcctgggaggccaaaagctggtctagcacccacaggtacatgctctcttgcaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggtggggatggagcctgggcccttgcggatgctccctgtccccttccacacaccaggatatggttggagggagggcaggctccaggccacaaaggcatgaagggtgtccaagcgcagagcctctgggtgaggtgacacctgggctcaggggagagtggcctcagggccatgaattttgggatttgccactgcaatatctgtttgaaatccaggctttgcagcatggcttccaaggataaaaatgcctccttccacctaggattcattatacacacatagataatcaccctgtgtacatgacaccctataaggaccaaactaattaacaaatcactaccagttattgagtgtttactctgttccaggcagtgttctacagacttcacatttatgagacaggtcatataattccctcaattttacaggcacagggaggttaagcaacatgtctaaagccagctatttttgtttccccctccattgtattttgaaacagtcagctattattatcactgaccagatgacttacttcctctctagggattatctcaattttgtcatctttcaaatgggaatgtttgttaactaagtgccctgacttccaaagaatgctgcgaagacagtcagttccttatctgagagttccgggctccccagcctccccagggcacagaacaggggacactgcaaagtgagggatgtttgggtcttcagaggacttgcagcaaatgggctcagggtttctgctgctggctcacttgtccatttaccccaaatgcctcgacacccaccctgtgccagggcctgggcatagcactggggatgccctccagagtgcatggcccatccccaaagactcattcgcttctccctggacaacaggagaggcttctacagccaggacctgcccccaggagcctctcaggggtgagtactccgggcaaggggtggggaataagaggctgggaccaggaccttgggcccggggggtggggccttcagctctggcctaatgggtcttacactggaggtcagtaggtgtcccatgtagaggctgtcatgctaggttggggcactggctagcatgggcctcagtctacctagcataagatgggggtgaatcctttgaccccagcctaattcctggacattagttgagaagcacaggtgacagctaacagaggggtctttggagtcctccttgggcagcccaggcaggggggtctcagcattagaggccgtgtaaatgggaggctgtctggggtgatggaaagagcctggacggacagtcatgaagttgggctgtggtccaactctgcttcccgaccaaatagagaattttgaggccgggtgcggtggctcacacctgtaatcccagcactttgggaggccgaggtgggtggatcacgaggtcaggagttcgagaccagcctggccaacatggtgaaaccccgtctctactaaaaatacaaaaattagccgagcgtgatggcacacgcctgtagtcccagctactcaggaggctgaggtagaagaatcacttgaacccgggaggtggaggttgcagtgagatgagatcgtgccactgccctccagcctgggtgacagagtgagactccatctaaaaaaaaaaaaaagaattttgagctagttactctctgcatcagatgctaattaattcctgcgtggcccccacccctacccccatgattgttggggaataaaataaaatgaaggccaggaaggtatgtattattaccagtaagaacggaggctagacaccgggaaggactttccctggaggagggggtgaaggggacgggcaagggcagaggacaaggccctctccgccgttctctcctggggtagggggctgcgggctcctgcgggctcctgagcggttcctcctcgcagggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctgagggcagggctctacctcccctgcgtcacactgtgtgaggctgtgtctctgccatccaaaagggggccccttgagaatggtgatccacccagttacaggggcatttagggagcagatgactgagaacattaaaaaagaacttaaatgacacagcaaatgaaaaatatttgaattcatgtctatcctgggaggaaggaatttggcagagttagaagtaggaaaaatccaggaaagctcccttgaggaagagggcttcctgagacagaacttgggaactgcagagtgggactggtggctgggaaggcggctgtctcctcccccaacagcaagcggggaggccccctcttctcctcaccctggcccaacctctgtgagaggtcagggcagagagcccaggaacccaggaaggtgggtggtgggtctgatgtgaactctcgtacagaggtgaacagggccagggtttctggggaacaggatcgttttcaataacaagagtatgagatattaattccaaacttacagtttattaatcaattaagagtcattattcatttgacaaatattctttaagtatcaaccctgagccaggtactaaagaggtttggcttttttggtctggttgttacataaagaagattcttgtattgatcaagtatgaggcttccacagtagagcataacgtgtgcgtcccctgcttgcccagcgctggcaggaaatccagactttcccaagggttctctgctagtaatcactccaagagactctgggtgctgtcatgtaaatccacctgtcccttgggccccataggatagtctgctggatcaactttagtcttccttcccccagggaggggatggggaactatgccccagcaccccaacacatggtttcaaggacaccctcagctcccctgagcctctgtgctctctcagctactgttccataaaaactctcactgcctcctccactgctcatctctcaccagcctgaaaggagattctcccacttgttttggggattcttgggtgctggtggctggggtgggagggtcccatagcttctacggatgaatctgtccaccatccccacaaggcatgttccttctctgacacacagactgagggagggtgtgggcaggggcccaactatagcctcagactttctctggccactatcccttcctagctgtccggccagatgctgagcccaggcttctcaatctccactgtcaggctggcttaatcttatttcccaggagggcttctgagccgaggtgaatcaagggccatggccaagctctgagcctacccaagtattttattttattttattttatattttattttattattttattttttgagatagggtctcactctgtcccccagggtggagtgcagtggtgcgatctcaactctctgcaatctctgtctcccaggttccagcaattctcccacctcagcctctcaagtagctgggactacaggcacacgccaccatgcctggctcatttttgtattttttggtagagacagggtttcaccacattggccaggctggtcttgaacttctgacctcaagtgatccgcctgccttggcctcccgaagtgctggaattataagtgtgagccactgtgcccagcttgagccaacctaagtcttatcaagcctagaaaacatggaggaccttaggagggtgtcctgatcttgtacactgtggaattccacatgccacagcccctgcctatccaaagtgctttgttaccaacacagttttggacaagaaactaaagtcagaaagtggcaaggcctgggcctcagtgctctgaagtcttcataaaatagcataaatatccaacctctaggaaggaaacaagaaggtatcagggaacagggttttatggccaatttgcagacaacttcccagagaagcaactttggtctgtgtgcgtctgtaggacactgagttcaggggcagcctaaagaagaccaagagtgctcctctttatttttatttgtttatttttattttttgagacggagtctcgctctgtcgccaggctggagtgcagtggcgcgatctcggctcactgcaacctccacctccagggttcaagcaattctcccgcctcagcctcccaagtagctgggactacaggcacccaccaccacggctatttttttttgtatttttagtagagacagggtttcaccatattggccaggctggtctcgaattcctgaccttgtgatctgcccgccttggcctcccaaagtgctggaaatacaggcatgaaccatcgcgcccggcatttattatttttgagatggagtcttgccctgtcgcccaggctggagtgcaatggcgtgatctcggctcactgcaacctccatctcccaggttcaagcaattctcctgcctccacctcccgagtagctgggattacaggcgtgtgccaccacgcccggctaactttttgtatctttagtagagatggggtttcagcatcttggccaggctggtcttgaactcctgacctcgtgatccacctacctcggccttccaaagtgctggaattataggcgtgagccaccaagcccggcctcctctttattttttattttgatttatttatttttgagatggggggggtgtctcgctatgttgaccaggctggtctcgaactcctggcctcaagcagttctcccttcttggcctcccaaagtgctgggattacagacattagccacggcgcctggcctttttcttcttcttcttctttgttgagacagggtctcaatctgttgcccaggctggtctccaactcctgggctcaggtgatccttccgcctcggcctcccaaagtgctgggattacaggcgtgagccattaagtgttccccttaatgacacagcagatgagagttttactgagtatctccttgtgccaggcaccctgttgttgctggggaagcggaagggagagacaatcgttaatcggctaaatttctgccttctgagagctcagaatcaagaaataaataatagggcagtaaaaggggctgggattacatacaaaaagaaaattaatgcctgaactttttacaatctgctcgataagctttaattctattaacctatttgagcttcccaacaacaggcaagctcccacagcagctaggaggatcactttgtcgtcatacaaatagaaacaggctcagagaggaagtcatttgttctagttctcactaggacaaatctactggctactaaaaaagtgtgaaggctggggacagtttgagtcgtcctgcttgcaccttaagcgcctacaagagtgcccggctataacaaccacaataccaataataaaatttaaaaacagatgttcagtaaggacttgcggcattaggaccccaggagggaagtgacgttcgaggaggcggagaaagccgcgaagacggccttccccacatcttccagcacctgcgcgcctgaatccgtcccacccaggcccagacgcaggcttcttctcgggtcttggtcctgcatcctctctctcccagagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaaggtgaggaggcggggcccgtggggcgtatcctgccggaggggctggctccagcggtggtgcttgcggagcagcgtcgggggttgcaaggttccgagctctgcagggtgtcttccttccttgaacaggcttgcgccgggacgctgcggcggacgagagatctggtcccggtacccctggagttcacacattggtagaaacaagcaatgataattcagagtagtagatgccatgataggggaggtacagagcttccttttgggggccggacgaggagcatctggtctagcctggagtgggggagggggtgggcgaaggctgtgtgcagaggggagtcaaagagggcttcatacaggaagcacgaagaggcattaggagttagccggatgaagagaagtggaaagagaggggcccactcaggaaactacagaggcagaggcctgccggctgagaagctaagaacgagtttgaggaactgaaaagctccagatgactcatcttgggggaaaaaaacctaagactttccccttttgccctcactgcaacccaatctgtgtagttgtctgttgcacccactaacaactcctcgaaggcaggaatttttgtcttagatacgtattcacacagtgtctggtaggcactcaataaatgttttgagaatacagatgattaaatgggagactgtgggtgtgtgtgaggaggaggatctggatctgaggagccctttgggggaacaatagagcctatggggaacttgaaagaagattttaggactttggagaaaaggtgagtcccaaagacataggcgttgaggaactacagagagagagagagagggagctaccagcgagccaggactataaaggacctatttctttttcctcaactccgtcccttagttttctcctcagaccttacagtcatgcctgccttcctagccccgtaaccccagggcccccagaaagttggctgtgaatctctcatctgaattgaaagcctacatcaggccagatgttccctaaacactggaaagtgggtttggggtaagtttcggacacataatccttccattagagagattaaaaggatgctttagagataagccgacttcactggtagggcacccagtatgagttcaagcctgtgccttcccccgtacattcttttctttttttccttttttttttttatgagactgtctggctctgttgcccaggctggagtgcagtggcgagatctcggcttattgcaacctctgcctcctaggttcaaacgattttcctgtctcagcctcctgagtagctgggattacaggcgcatgccaccatgcccagctaatttttgtgtttttagtagagatgggatttcatcatattggtcaggctggtcttgaactcctgacctcaagtgatccacctgccttgggctcccacagtgctgggcttataggcgtgagcctctgctcctggccgccctttcacttttcgctcttcctctagtcctgatagcttttttttttttttttgagatggagtttcgctcttattgcccaggctggaatgcagtggcgcgatcttggctcaccgcaacctccagtgacccaccctcctcggccttacaaagtattgggattacaggcatgagccaccgtgcctggccttttttttttttttgagacggagtcttgctctgcccagtctggagtgcagtggtgcgaccttgactcgctgcaacctccgtcccccaggttcaaggattcttctacctcagcctcccgagtaggtgggactacaggtgtgtgccaccactcccggctatttttagtagagacgggttttcaccatgttggccaggctggtcttgaactcctgaactcgggtgatccacccaccttagcctcccaaagtgctgggattacaggcgtgagccactgcacccagcccagctaactgatagcctttcagcgtttcgcttcctcttctctttcttttctgtcttattattattattattatttttttttgagacggagtcttgctctgttgcccaggctggagtgcaatggcacaacctcggctcactgcaacctctgcctccagggttcaagtgattctcctgcctcaacctcctgaatagctgggattacaggcacctgccatcatgcccgggtaatttttgtatttttgtagagactgggtttcaccatgttggccaggttggtcttgaactcctgacctcaggtgatcctcccacctcagccttccaaattgctgggattacaggcatgagcctccgtgcccagcctgtattctgtcttattctgatatcaaagagcccatactctccctcttattattctcatagcctaaggagctcacatttattctccttaggcaacattcacagactcacggaagcatagagatgcccaggatctctatatctctatatctagagatcattctagtctaccctcatttggtaactgatgaagattaattgaaaagggatttgcagtcacaggatggcttggcaaactccaaccgttaggttcatcttaatagtatatttgtttgtattattattacacctttgttattaaatgctgactgtgtctagcccaccaagcctgcctcctggctcagtagcctgagtggaacaggcctcggcacagaggaaggagaacctgcccggaaaaaaagagtgggtggatgtcagtgagggtctggtgtctgtgccgtgaatctcctgtgagtctggttctgggtgggatccgcagaggaggtcttgaagaggtaatgtttggaagagctggaaagcaaggctgtggttgatgggtatgagagagaaaggatgttccaaacctcccctttccccactcctggggagggcgtgggaggaggggcaagtggtgctagaaaaatgatgtgcctgcacagagtacaggacagaagaggggagggagcccagatggtcctggatggagagctggggaggtgagacatccccagttcattgcagacttgaagatcaccagcttattacttggaatttgtatgtgtttcaaattctccaagccattgattaatttcaccaagcaggcctccaggggatgtatttatttttgtggtaaattggtattctagcagactgtgctgtcagtgttaaaactgctgatggcatttagccttcagactggtattccattcagaggcatcagaagacggtctctatcaacaagatttatcgagcgtccagcatatatcaagtcccaggctaaggaaatacgaaaaaatctaatacataatgcacattttggggacccttgtggtctatgtggagagacacatcaaatgactgagggtccttagggagagcatggatcctgcagaggcccagagtgaaatctagagcaattggcattagtgcagaatggcttcctgggggagaggcttataatgcgaggtgggcaggatgggcagagaagcccttagaaggcattaagtattttcctagggcctcaggcacttcacaccctcggtggtagcactgtagcactctatacagtggtagttatttgtctacacctttatctgctgcattagactgagtatctggaagggaggggaccttgttttcatctctgtatccccaggctgacacgtaggagttgcctaatacctatttgaggaagggtaagaggaaatgaggaaataaatgtgcggagacagtaggaacaagagctctctggagggcatggagcaaattaacttggtagaaatagagctgatgttggaacacatatgaaatcaagtaatctaacaaccataaaagatgttttggggacaattaaggaaatttgaatatggactactgggtgatgttggaattgttaattttccaagtatcataattgttctatggttatgtaggaggaggtcttttttctcaggagatacatgatgatatatttatctcaaaaggtcatgtttgccacttactttcaagatggtgtagcaaaagaaatgtatatattgttgagatattataattatatattgaagagagaatgtggcaaactattaacaactgttgaatacaagtggaaggtattcattgtgttctttcagcttttctgtatgtatgcaattttagaaagtaaaatgatagaccctggcgtggtggctcacgcctgtaatcccagcactttgtgaggccgaggtgggcggatcgcttgaggtcaggagttcaagaccagcctacccaacaagatgaaacctgtctctactaaaaatacagaattagccgtgcatggtggtgcatgcctgtaatcccagctacttgggaggctgaggcaggagaatcgcttgaacccaggagctgagatctcatcattgtactctagcctgggcaacaagagcgaaactccatctcaaaaaaaaaaaaggaatacgaagaacaattgcttaagggcaggatttacagtaagtacatgctcttacacaagaaacagtagataaaatagaaatcctagaggcattcctgaaactggggttaatcagaagtcaacatggcacattagcatccaagatggagttgctttagcctccacaggttctaactccttccctgccttgagtgctgattttggtcctccagtctaggaaaggatgcccacctggatctgttttgctgggagctggcctcccattagactcatgtgcactcagtgggctgtgctacctccctcccccagtgtgtaaatatgttgctgtggagctgaagtcagcctttgaggaaaccggcaagaccaaggaggtgattggcacgggctatggcatcctggaccagaaggcctctggagtcaaatacaccaagtcgtaagtgaatggggactcactggcctggcctgcgttgctgctggaggcttcaggggtttggagttcccttctcctagctaggcaaaccccctacaagggcatcatttgtaaccaagacctgagtttgcccactgattctgtccccagctaattgggtgacgtgcataaatctcttaacttctttatgcttcagcagatttctcatctctaaaagcaagactgttggactatatcattgattctcagacgcttggatttcacagagcaatgcaagtttttttttgcgacggagtttcactcttgttgcccaggctggagtgcaatggcatgatctttgctcactgcaacctctgcctcccgggttcaagagattttcctgcctcagcctcccaagtagctgggattacaggcatgtgccatcacgcccagctaattttctgtatttttttagtagagatggagtttcaccatgttggttaggctggtctcgaactcctgacctgagatgatccgcctgcctcggcctcccaaagtgctgggattacaggtgtgagccaccacacccggccacagtgcaattttttaaaacattagtaacaggattaccagctttttattttgctaggtacaaatatagtttttaaaaacccaattctgtcagctgtgatcatcctttcaaagagaatgatattttactatcaaaatttaataattttgctttatcaaaaaatctaaatactgaatcatttagctttataaaaaattccttcccttagagctgttaaaattttgtctctctggtctgtgttccagcatttcagatcccccagaccagatgacctatcttccttccagctctgagtcacttcccattggtgagatgtgcaggtgttggggcacagggctggagggacagaccactaacccactgcggctaggaggggaactcagttcctcatcctcctgtcttggcagggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctgggatcttccttcattgcctcttcccattctttgattgccgtttgtgctcctcccctcttgagtggcctcatttttcaggcacatgcatgagggtctgggcctgttcatgagggtcctgcttcaatctcagacacaggcagaaatgctccacagttgctgcccccgtgggaacctaaagacactagaacggggagaactcagcaagatccacgatgtgcagaaaggtgggggtttaggcgaggtgtcagaggacacctcggtgggagtgactgcccagtcccatctctgggtccacacagcacctcccacaaccccgctgggatgcccttgtgatggcccatgtactcagtatgtgtacgagtgcttttctctctggagaatgagctgcttacaacaaggcccatagttcttactctctacatcttcagtgcctggcacagggtaagatagttgccacccacatttttctacctaagtttccttctagcaaaggataccattcataaactcctgggatacctaagggaatagtctcaagcagcagaaatttgtatgaattttgcactcagtaataaatctgtgtttgctttaataaaaagtgtttaagaattatttttcatagcaggaaaaaaatgagaaacaatctaactctaccaataggggattaaatacgttgatccagccgtttggtggactagtatgcggctggaaacgaagcatggggaggctctttaggaactgaattcaattgattttcaaggtttttgtgtgtttgtttgttttggagacagagtctcacactctgttgcccaagctggagcgcagtggtgcgatctcagttcattgcaacctccaccttccagattgaagctattctcccacctcagcctcctgagtagctgggattacaggcaccgaccaccacgcccgactaatttttgtgttttttagtagaaacggggtttcaccatgctggccagggggtctcgaactcctgacctcaggtgatcagcccaccttggcctctcaaagtgctgggattacaggcatgagccactgcacccagcccttcaaggtataagtaaaaagggcaagtgcaaaatagtgtgtatgctataccactgcttgtgtaaaaaggcggggggaggatatatttagatattggtatttgtatgagttatctctgggaaaatagaggaaatggatagtatgttttctctggggataagacctaggcagctagcagagatagtttttacagaataaagggtctacctgcctcagctatgcctttttcccactgaggaaagacacaacccaggaagaacggaacagcaggtctggatgatatgggagtgtttccagccatagtgaggggaaagagctaagacaaacctatttcctggaaaagaagcataaagccaaagggcctgagggcagccgcaggtctttttgaagcgatgaggtgtgcagaggcagatcagggggtatatgtgcaggggttgtgggaagcaggcctaaaagagggaagaggaaggtcaggtcaaggatgaggccaggtgcggtggctcacgcctgtaatctcagcactttgggaggctgaggtgagtggaaaacttgatgctaggagttcgagaccagcctgaccaacatgacaaaaccccaactctacaaaaattagccgggtatggtggcacgcctttgtagtcccagctgcttgggaggctgaagcaggaaaatcgcttgaacctgggaggcagaggttgcagtgagctgagacgctccaacctgggcgacagagtgagactccttctcaaaaaaaaaaggatgaggatccttagagggcgttgagcattggtcttatagctgggttcttagccaccactgggagacgagggtgggagggagagaagggagctccgcctgccatatctggtcgcttcttccagggcatgtcagagacctttgagacattacacaacctggtacacaaaggggtcaaggtggtgatggacatcccctatgagctgtggaacgagacttctgcagaggtggctgacctcaagaagcaggtacaggcccttcagcccttggaagggttgctgtgcccagtgaggggctggtggggattgggtctgctctgaggaagtccacccaggccggggtggctttggtcaggtcatttcacctctctggcctcagtttccttaggtgaaccgctgccactgcctaccttgcagtgggttgcgaggcttagctgagctcctctaggagcgagtcaggtgctggggctttgccaatatgaggtattatgattaacagtgtgatgtgctggtggaagagtttgaggaggtgatcgaggactggtacaggaaccaccaggaggaagacctgactgaattcctctgcgccaaccacgtgctgaagggaaaagacaccagtgagtttggggaagcaagggcaggctggctctggatgatttgtttgctctcccttgggggaggtgggtaggaggagaaacagagggcaccagagggcattgtaggatctctgcccttgaaaggcttgattggcaagacatggtgaagtaagagtcactgaaaccaggtgcagaatgatgggcagacaagtcagatgcccccagaggggcctggtggccacagcgagaggcaggaggcagggaggctgatgtcaagcacagtcccagttgctactcccacggctccctgctcagtgctccttgcccagcaccccagccctgaggcacttctgttgagggtctctctcctccacaccctaggttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctgagtcctctgcagccctcagaggtgccctggagcctcttgttctttcctgcccctcgccttccagcccgtggggctgaggaggggaaggctaaaacccacccactctcgggagcagcaagtgctgggaaggcccagggttgtcttggggtgaggggaggcatgggcataggatgaggcccagggcagtgcactgaccttacgctgctccctcgtgtcctggacacctggctgccgttccctccctccctctctcctgctgctcctcttcccaaggcctcccatttgttgtgtaaaatgcagtgtttacctggccagctcccgcccctgttcctacttccacctggccttgactgttggtcctgaaccttgttttctgatgaccacacttgatcactctgaggttcctagctgttgtacctggagtgcagttgggaggacacccggttcccaacaccatctggtcacaccatgttcctcagggccaagggaggagcagagaggctggcctctagggagaaggggtggggaagctcaggcacctcccagtttgtcctgaaggcagggatcggggcaattggtacagtagtgatgacaattgtatgtattcaaattgtatgctttaacttttactattaccacactcttgtgaggtgtgctgttaacctcattgtgtagaggagaaaacaggctagagtcaagtgatatgcttggagtcaggtgaccttggagtcaaggtcctgctgttaaggagtggtatagctgggacgcagacactggcgttcagattacaaatccatggtacttccactctccacagctgccagggcctcttcccccaacccctggcactgacagtgtgagttgtatcgaactggtttagtttcttggccttaacctgtcaccaccaccaagattctttttgttttgttttgttttgttttgtttttttgaggcggaatctcactctgttgcccaggctggagtgcagtggtgtgatcttggctcactgcatcgtctgcctcccgggttcaagcaattctctgccttagcctcccgagtagctgggattacaggcacctgccaccacgcccagctaatttttttgtatttgtagtagagacggggtttcaccatcttggccaggatagttttgaactcctgacctcatgatccatctgcctcggcttcccaaagtgttgggattacaggtgggagccactgcgcctggcctaaccaccaccaagattcctaaaaggcgaataggaagcagctgtggcttattggaaggaaagaatggcagcaagtcctgggggagctgtgcccgcaccagatctcccgtgagcacccacactgcaactctacctcacacttccaggctaggcccagtgggtaggagggatacactgctgaagcctccctgcgtccattgcagcggctctgggggctgaactgggagtgaggggccccctcatagcctggtcccagcctctccccctctaccaggttagggcagccaaggccatagagagtggaacagaatggaatctgtctctccttaagctgttgaggatgacgccaggtcctgggaaaatgatactgtcttggtccagcctccacctctgcatctccaggactgatgttccccctgttaaaggagctggtgagcagtgagattacagtctagatgcaggtcttgtcctggactttgttctgagcatagaaaatggctgggggtgaggtggaggggctggtacccagggcagggatgtgtttcctgccccctgaactgtctaggatttggtggccaccctctgattcccccattctatcactaacagcacttcaaggcctggcttacttctgtccccacagcttcattgattttttttttgttttttgttttgttttgagtctttttttttttttttttgagacagagtctcactctgttgcccaggctggagtgcagtgtcacaatctcagctcactgcaacctccgcctcctgggttcaagtgattctctgcttcagcctcccaagtagctgggattacaggcaaccgccaccacacccagctaatttttgtattttcagtagagacggggtttccccatgttggccaggctgttctcgaactcctgacctcaagtgatccacctgccttggcctcccaaagtgctgggattacaggcaggaactaccatgcctaaccctttcccctacctttcttttttggaacaggatctccctttgtcacccaggctggagtgcagtggcgtgatcatgactcactgcaggcctcaacctctcaggctcaagtgatcctcctgaatagttgggaccataggtatgcaccactgtacctggctaatttaaacatcttattttttgtataccaggtgtggaggctcacacctgtaatcctagcactttgggagaccaaggctggaggatcgcttgaacccaggagttcgagactagcctaggcaacatagtgagaccatgtgtctaaaaaaagaaaaaattatttaaatacttttttatttgtttgcaagagtctcactctgtcacccaggctggagtgcactggcacaatcttgtctcactgcaacctcttcctcctgggttcaagtgattatcctgcttcagcctcccgagtagctgggattacagccacacacaaccacgtctggctaatttttgtatttttaatagagacggggtttcaccatgatggccaggctggtctcgaactcctcacctcagatgattcacccacctcggcctctcagagtgctaggattataggtatgagccactgtacccggccaataatttttttaatttttaatttattttttgggcctggggtggtttcagcctcttatttgggaggctgaggcaggacaattgcttgaaaccaagaggcggaggttgcagtgagccgagattgcaccactgcactccagcctgggtgacagagtgagactccatcccccgcaaccaaaaaaaaaaaaaaatttgtagcaacagggtctccacatgttggccaggctggtctcaaactcctggactcaagcaatcctcccatctcggcctcccaaagtgctgggattacacgtgtgagccaccatgcctggcctcattgatttttaaagtaggacaaggtaaagatctaacccccaagccaggtgtggtggctcacggctgtaatcccggcactttgggaggctgagatgggcggttcacctgaggtcagcctgggcgacagagggagactccatctcaaaaaaaaataaaaaaaactccttactgaggtgttggcccagtggcccaatcccaggccctggcccagtcttgagggcaggcagtgttgtcactgctttgctctttgacctgtggttactgcttcccaagggccaggcttgttgcatactcactagctttcacgcagcccacccagcagcagcttactctggccctgcctagaaaggcagaatgcaggaaacctggctttccgggtttttttctttccctttttttttttttttggtagagacggggttttgctgtgttgcccaggctggtctcacacttctgggctccagcaatccccccacctcggcctcccaaagttttggaattacaggtgtgtggcttagcgcccagcccaggtttttcttttcttctccccaccacacaagcctttccgaacttgggcgttgcctcccactttcctataccccttcccatccatggcttgtttttgttttgattcagaacaggcagaaattaatctacctgatatacagaaattcatatagatgaatttctacctgttctgaatcaaaacacaagccatgtgcagtgcatgcctgtagtcccagctacttgggaggtggcttgagaggatcacttgagcccaggagttccagtccagcctgagcaacacagtgagaccctcatctctaaaaagcgaataaaaacaaaaaaaacaccaaaacaaccaggatgtctcccatttgcactccacttaagtgtggagacttaggctgatcacatcactgcactccagcctgagtaacagactgagaccctgtctcaaaaaacaaaatgagacaaaaaacctgctcgtaataaagtgtgaaattataaaaagaacctctgtttttaaaagttttctatttatataaatttatagggcacaagtataatcaggtaagggtactgcctgcactcaagttaacctgatttccgtcttcctgtcagaagcctcattagaacaagattctaaacttaactcacctggacatgagagtcacctagaatacttgttaaacatacagatgtctgggtttgcctcagacttgctgggttgagacctgggagtctgcatgcttagcaaacatctctcacggtccttaagaggaggcagctagaactcacttcaccaagataaacccagggtgttgtcctaagatggggcaggacttcagtgaatttacagtgggtcaatgtcttgtcctcagaaacacaaacagcagaatggctccatctctgttgaagacttccatcaactagaaccacgagggctgatggacagaccacaaggccagtttgttccagttcaatgattaaaagaaccacagatgaccaggcacggtggctcacgcctgtaatcccagcactttgggagcccgaggtgggtggatcacgagatcaggagtttgagaccagcctggccaatatggtgaaaccccgtctctactaaagatacaaaaaattagccaggcgtggtggctcacgcctgtaatcccagctattcaggaggctgaggcagaagaatgactcgaacccaggaggcagaggttgcagtgagccgagatcatgccattgcactccagcctgggcaacaggcaagactctgtctgaaaccaaacaacaacaaaacatgctcagacagtaaaatctcacgagtgctacatcagggcttccatattcatttgaaagggcaggtcctaggaggcaggctcctctccttactttgagactgctgggtggcatttccatagatctttatgcaagttaggaaaaggtgctcttcacacctttaacttccatctgtcagaaaattgttttgccgggtgtggggtctcacacctgtaatcccatctctttgggaggctgaggcgggtggatcacctgaggtcaggagtttgagaccagcctggccaacttggtgaaaccccgtctctactaaaatacaaaaattagcctggtgtggtggcatgcgcctgtaatcccagctacttgggaggctgaggcaggagaattgcttgaacctcctgccactgcactccagcctgggtgacagaatgagactccgtctccaaaaaaaaaaaaaaagaaaattgttttaattacatttgttaggaaaagacacttcactgaatgcctgccagaaaattatcatcttaaatctacaaacccatggggtttgtcctgtgaatgggagccccacactcccctctagtgtggagacttatgctgtccagatgttgaccgcagccctgcatcactatagttcccaaatatgaacaaaattccccttattttttgatcttgaaagaaaagcctattttttatgacagatatatatgggtccatgctaagtcacttgtttcaatgagatggaccctactgccagctctggtaatagcaatatgtattagcaccaactgcccctaagtggaaaagattgcccaaaaaagacattaaaaagccatattggctgggcatggtggctcacgcctgtaatcccagcactttgggaggctgaggtgggtggatcacgaggtcgggagatccagatcatcctggctaacacggtgaaactccgtctctactaaaaatacaaaaaaaaaaaaaattagccgggcgtggtggcgggcgcctgtagtcccagctgctccggaggctgaggcaggagaaaggcgtgaacccgggaggcggaccttgcggtgagccgagatcgcactactgactccagcctgggcgacagagcgagactccgtctcaaaaaaaaaaaaagctacagaaaaaatgttactaagaaggtcataagaaaaatatatttactgttcgttaagtggaagtggatcatcttaaggtcttcatccttctcatcttgggagaagctgattttgaagtctcggggtggcagagacaggagaaaatccacatatatgtgggcccacatagttcagctccatgttgtgtgtttgagggtcaatggcaatctggcttttttttttttttttttgagacggagtcttgctctgtctcccaggctggagtgcagtggcacgttctcggcttactgcaagctccgcctccttgggttcacaccattctcctgcctcagcctcccgagtagctgggactacaggcgcctgccaccacgcccgctaattttttgtatttttagtagagacagggtttcaccatgttagccaggatggtctcgatctcctgacctcgtgatccgcccacctcagcttcccaaagtgctgggattacaggcgtgagccactgcgcctggcctctatagctttaatgtaagattacactatataatacgcatacaagctatgtgttattggcctggcatggtagctcacccctgtaatcccagcactttgggaagccgaggcggacagatcacctgaggtcaggagttcaagactagcctggccaacatggtgaaaccccgtctctactaaaaatacaaaaattagcctatgtgctggtgcacgcctgtaatcccagctactcaggaggctgaggcagaagaatcgcttgaacccgagaggcagaggctgcagtaaggcgagatcacaccactgcacttcagcctgggcaacagagtgagacttggtctgtctctcaaaaaaaagatatgtattatcgactttatgttataggtaagggttctggtccatagtaagttattagtaatcgagtttttggggagtcagaagttatacatgggggccagacacagtgggtcacgcctgtagtcccagcattttgaaaggctgaggcaggcagatcgcttgaactcaggagtttgagaccagcctgggcaacatggcgaaaccccatctctacaaaaaaatagaaaaattagccaggcacggtggtgcattcctgtggtctcagctacttgagaggctgagatgggaggatcacttgagcacaggaggcggaggtttccgtgagctgagatcatgccattgcaccctagcctggttaacagaacaagaccctgtctcaaaaaaaaaaaaaaaacaaaaaacaaaaagttacacatggattttcaactgtgtggggagtcagggcctctaacccccaagttgttcaagggtaacctggactcaccaacccagtcttggtgttttagatgtaatggcgtgtgctacgtcacctgtttcaataagcaatgtttagcctgttatcagggcctgaaatagcatatcatatttatgttgaataataatagctcagtgaacagatctgtgtgtactgaagagatcttactggaggttagcactccttaaaaccgcctttttttttttttcttttgagatggagtctcactctgtcacttaggctggagtgtagtagtacgatctaggctctctgcaacctccgcctcccaagtagctgagacctacaggcacgcaccaccatgcctggctaatttttgtattttttagtagagatggggtttcaccatattggccaggctggtctcgaactcctgacttcgtgatccacccgcctcagcctcccaaagtgctgggattacaggcgtgagccactgtgcctggctaaaactgcttttaacagccaggaacagtagctcacacctgtattcccagcagtttgggaccagcctgggcagcatagtgagacctcatctctactaaaaaaaaaaaaaatagctatgtgtgatcccagctactcaggaggctgaggtgggaggatcacttgagcctgggaggtcgaggctgcagtgagcatctgtgatcacaccactgcactccagcctgttttttgagaccctgtctcaaaaaaaaaagaaagaaaaccctgctttttttttttatgagacagagtctcgctccatcgcccaggctggagtgcagtggtgcgatcttggctcactgcaagctccgcctcctgggttcacgccattctcctgccacagcctcctgagtagctgggactacaggcacctgccaccacgcccagctaattttttgtatttttagtagagacggagtttcaccatgttagccaggatggtctcgatctcctgacctcgtgatccgtccgccttggcctcccaaagtgctgggattacagacgtgagccaccgcgcccggccaaaaccctgcttttaataaagtgtgaaatggtaaaaataacctctctttttttttaagttttctatttgtataaatgtatagggcaaaagtatcgttttgttacatgcatagagtgtgtagtggtgaattcagggcttttcgggagaacctctcttcttacacatcagtggagtactcactgataacactacgcttaatagtaatgttgccattattagtgttacgacccactgatatagagacctatttgacaactaacaggactttcttaaaagtccaaaaaaggatctgctttgataattctgctaggagatccaagtgggtgggtggatctgctagcaccactcctcaagtgtttcaatgttcagtctggggtagatccaattagcagagaagaatttttatgcaatggcttggactagagtttggaatttggcagtcatcactggaaaaatgaatttctgcctgttctgaatcaaaacaaaacaagccatgtgcagtacacacctgtagtcccagctacttgggaagtgacttgagaggatcacttgagcccaggagttccagtccagcctgagcaacacagtgagaccctcatctctaaaaagcaaataaaaataaaaaacaccaaaacaaccaggatgtctcccattcgcagttattgtatctacataattcacaattgcaggattttaatgtgtcctcaaataggacttggagtttgtccagttacagccacattcccaagatgaagtctttttgcaaacatgtcacacatttaggaatgaagaatttagtcttttcagccaattccaaataatgtgtcccacatttaaaatatcacctgttcttcttttcttttcttttttctttttttgagatggagtctcactctgttgcccagggaagtgcagtggcgcgatcttggctcactgcaacctccaccttccaggttcaagtgattctcctgcctcagcttcctgagtagctgattacaggtgtgtgccaccacacccggctaatttttgtattttcagtagagacaggatttcaccatgttggccaggctggacctattcttattttcagtgaagtcaaacagtaaattgatttatattctgtgatcttttccatggcccagggcatctaaaatttacagagagatggccaggcatggtggtcatgcctgtaatcccagtactttgggaaaccgaggcaggtggattgcttgagcccaggagtttgagaccagcctggataacaaagtgagactgtctctacaaaaataaaataaaatttatagagacgaattaagtaaaataaaaagcagttttaatatattttagtgggcaggacatggacaatttgtagatgaaggattgcaattatttggtatattttggcaataattaaagaagatataatagatataattagatacaatattctacctaatgaaatatcaacgaataatatgtaaagaagagttcaaacacgccgggtgaggtggtttatgcctgtaatcccagcactttgggaggc

SEQ ID NO: 384 - DNA, 24033 bp, Homo sapiens
cctaaaatgagtcagcagcctagggctcacaccctgactgacccagcaggccctgctgacctttccagctaaaccaactgctcacagctccttgagcactgcagcctgcactgggctccacctttgctcacactactcttgggactggaaagaacatcgctacggttgattcccctcccaaacctgaagaaaaggattcatttctaggacgaagattaccagctgcttcctccaaacagcctttcctgatccgtctcccaattagaactgatagctcccatggatgggtgtggtggctcacgcctgtaatcccagcactttgggaggccaagatgggcagatcacttgaggtcaggagttcgagaccagcctagtcaacatggtgaaaccctgtctctactaaaaatacaaaaattagttgggtgtggtagcaggcacctgtaatcccagctacttgggagactgaggcaggagaatcgctttaatccagttgtgggagattgcagtgagccgagatcgggccactgcactctagcttgggtgacagtgagactgtctcaaaaaaaaaaaaaaaaaaaaaaaagaactgatggctccacaattcatatcccacaaaactcagtacaggcatttcacacacctgtgacactggagagtcctcatcatttttttcctttccctctaccctgcaccccacaatggaaggtctccaggtcaagaactattcctccctccagtgaagcctggagtggagaatgttcacccagacattcgttagttaactgactaaaaacctatggactcaggcctggggagacacggttgggagaggcctaggagacttaccatacaggtccctggctgttggccctgatacacacggaaaacctagacaagaagacagggaggtgagggctggcactttttgcaaaagagataaaccggtgttctgcccttaacttcatgtcccagtacttttgtttaaaatatgcttttttggccaggcatggtggctcacgcctataatcccagcattttgggaggccaagtcgggtggatcacttgaggccaggagtttgagaccagcctggccaacatggtgaaaccccatctctaaaaatacaaaaaatcatggctgggtgtggtagctcacacctgtaatcccagcattctgggaggctgaggcgggcggatcacttgaggtcaagagttggagaccagcctggccagcatggtgaaacctcatctctactaaaaatacaaaaattagccaggcatggtggcgggcgcctgtaatccgagctactcaggaagctgaggcaggagaatcacttgaacccgggagatggaggttgcagtcaaccgagatagcgccattgcactccagcctgggcaacagagcgattctccgtctcaaaaaaaaatgctttttttcctgtttacacagtaatatattcatgtagaacatgtaggaaacacaaggaagtacaacaaagacaacaaaggtagtgcctttttcatggcggtggaaacagctgcggtgtgaaattcctcctgcgtcagccagcgagcacctggtggtacggtggtcactggggtctgcccttccaaggccagcccatatacttgatatgtcagcttgatgtgagagaaggtgtggacaacctggaggaagggtcaaggggttcaaataggcctgtggatatagcctcaaaagccaacatccttggctattccgctgctcacttacctccccaaggtgccggaggtgcgtggctgggaggggcccagcccaacgctgtagttcctgcagcagggccttgcgctgaagctgctctgagggctcccaggtcacggacgggaactcccacagtcctgccagcagacctgagagggagggcagccaggcaggggtcaggcctcagctgccgattccctccattctctcttgttactcatgccactgccctccacgcccagtatccaggtacctgagttgggcctctgcaccagcagaatttgggccccaagggccccaggctgttccagaacacaggtggcagagctctcctccctggggggcttgcggctggcctttctggggaagttgaccactcccagggtctggtcccagggctccgagggaggcaggcacaggtggcactgtccagtgttgggagctgggaacggagatccccgaaccctactcaagccaagagggctttaggggccaacctagagagtgggctttggccgggttctgcagaatcttactcaggttagaggaagaactggaatggggcttctgactgggccaggaagggttggggtgggggctaggtttggtgctcaccacactcctccacgtcaggactgcccgacaggctccctgaggctaagagctgttcctgctccacctgagaggcacagggttgagtgtcatagggcagagtcactccttaggacttctcactgccccttccccagtaggcttactctctggcgtgcccggcacaggctctccacagggcactggctgcacagtgggcgctgtggggtacacactgtggcccctagctccatggctgcttggttgaaatctcctggccgggctgggtccaccagctgctgggctagacccctaaaagaagggaacactgctgtgaagcagagctcctttgcagacacccctgaagcacccttgttaccccaacatcctaccagagctgctgggaaacaagggtgctgctgggatcagcaccaatggctcggacacggcacagcacccgtgctacgttgccatccaccacaccggttgcctggcacagaggggccaaagagttagcctgggctgggaggaaggaggctgggcacgcacaaagtgggggtgggctgtgagatcacctggccaaaggcgatagaggcaatggccccagctgtgtagcgccccacgccaggcaggagctgctgcagggtctctgctgtacgtggcatgtggccccctagctcctctaccacctgattggagtgcaagactcaagattataagacacccaagactcctgggttcctaccctcctgccatccccttaccttccgagctccctcctgcagccgccggccacgagaatagtagcccaggccagcccagagttgattcacctcctgtgggtaggatcagaggtcaaagagatcacccgtcagtccctctattgttcctatttcccctaccctagggtggctctcacctccagggaagcactggccaggtcctgcagtgtaggccacttctatagccacaggcaggcagaaagagacaaggtcaagggtgaaggtggtagaggaagccttctctacacccaccccaaagtagaggctctcatctggggtctgacccatgacccttcccttcctcccctggagtcacctgcatccatccggtatagtagttgatcacagtggcaacctgggtctgctgcagcatgacctctgagacccacactgggggaaaggggttggcatgaggacactgctgacctgcccctacctggcccacagcccccagacccaagggcctcgaggcaaagtggccctgctctcaggagatgtactgaccagcatatgcccgcctgtccaggtccatctcatcttctgcctgtcaatgcaaccccagatgaggagttagggtggagggggctgggtgcctgcctcccacccactgtccctgctcctcgcctgcctacccgtcttctccatggtaggtcccgtttctcttggtcgtaccagcttagcaggctccctcggaaggctgtgacttcagctacgtctctgaatagatggtatgaggagacagaggcctgcaataccacctcttccggctgcctggccaggcctgctggggccccaggacactcagcaatcatccctgcacaggctgtgcatcagggtcttgggacacagcagcctgtggcagtatgctcccacttagggcttcccccaactaacccccttaagctttggagctggagtcagaccagagttatgtaattgtgtgtagctgtggctaagtttctggccttaattttctcagggtggtactactggcttgtctctgagccataatgaaaacctaatagttttagccagctagaatgtatactggtgcaggaccttcctattcacaaaacactttcaggctcataaactcatttggtcccatgaaagccacatgagggaggaaatgctgaactactgctccattttactggtaagaaagcagccattcagagcaattgtcccaatgtcacacagcaatacagtcagaattacaccctcagtgagtctcttttgttttgagacaagagtctggctctgttgcccagactgaaatgcagttgcattatcttgactcagtgcaacttctgccttccaggctcaagcgatcctgtcacctcagcttcccgagtagctgggactacagacgctcaccaccacgcgagcatagagaggggatttcgccatgttacccaagctggtctcaaactcctgggctcaagggatccacctgcctcggcctcccaaagtgctgggattacaggtgtgagccaccgcacctggcccttagtaagtctcttaatgtcttgatacgtatcacaatcccttcccagcctgaatctgcctttcatggccaatgagccttgggccacaacctagttccttaccatcacaggcagaaggcttggcctgactgttgttcttagcatgcttctgcctcccttcctggctggctgcctgcttcctgtgaccacttcccacggctgctcgtggcttcctcatgatggcctgaaacaaaaagacccagccaaagcagtcagtcacaatgaggccaaattttgaggccttccaagggtgatagctatctccctctcatccaccattcacatggggtccagcttctctcaagcactctcaagatgctcacgggtttactcttggctggctgcagcactgagatacaactagtatagctgagcaagtggcctcaagggggccggcgttacagccctggagacatgcaaagactgtgaggccagggctgggatgggtcaaggatgaaagcctcctgtttgggagcatttgtgtatctctgatgcttactgtgactgtgtgtgtggataggggttgtttaggtgtgtctgggagaatgggggtaggcggtttctctgcctcttagagatgtagcatggttacactgaaacagcctgtagtagtcattaagtccaaaaccttcattttatcctagaagaaaccaaggatcagagggacaaaagatctgtctgagaacagatggcaaatcagtgggagaacagagattagctatttttattcctaatctagtaaaccataggtggctgaccatcaacaatgagaaaatgtgcctggttgattttcactgctccctaactgttataatggccgccttttctctaacagctaaaattagttgatattttgtgagtgcctactctatgtcagaccccatgaagagctttaccggatctctcaatctcctggtgactctatgaggtatgtactagtatcacctccaccttagttataaggaaattgaggtttatggagattaagcgacttgttctttcaaatccacgaccagcattcttatactgtgataaaatgcagtccctgctaagcctctgtatcaaactctccccccaaacctttgactttaccacctcattttcatcaaaagagcttgcctcctccttcagaaaaaaaaaaaccaacttcaaatctacctccatttgcactgtcttaccctcctcctcttcagggtcctgctcctccaatcccgtctaactgttggaactcagaaactaataccccaggccaggcacggtggctcatgcctgtaatcccaacactgcgggaggctaaggcaggcagatcacttgaggccaggagttcgagaccagcctggccaacatggcgaaaccccatctctactaaaaatccaaaaaaattagccagacgtgctcgcttgaacccaggaggcagagcttgcagtgagctgagatcatgccactgcacagcctgggcaacaaagacagagcaagactctgtctcaaaaaaaaagaaaagaaaagaaaccaataccccaaaatatggccctctgacatgctgaactcaagaagccgcaaggtctctctgatccttccaccccagactctcccaaagccaggataaagttgttctctggaactctttatctgcctaaagtccaaactcactaaaaagaatacttgttttttcttcccctcccaataagactaacatgtaaccacacctgaacaaaccctttcacaggtattgtgtacctcaggatcactcaaattccaaagagaactattaacaagtcaacctctgtccccattccattctctctagtaatcctttattgcccttcaacagaatctccttctggccaaagttcggtttatttaaaaacaaatagagctggacatgctggctcaggcctgtaatcccagcactttgggaggccaaggcaggaggattacttgagcccaggagttcgagattaggcttgcaacatagcaagaccccgtctctacaaaaacagaaaaacagaatttctcttctaccccttgtcaggcctctgagcccaagctaagccatcatatcctcagtaacctgcacttatacatccagatggcctgaagcaactgaagatctacaaaagaagtgaaaatagccttaactgatcacattccaccactgtgatttgtttctgccccacgctaactgatcaatgtacttggtaatctcccccccacccttaagaaggttctttataatctccccacccttgagaatgtactttgtgagatccaccccctgcccccaaaacattgctcttaactccaatgcctatcccaaaacctataagaactaatgataattccaccaccctttgctgactcctttttttcagactcagcctgtctgcacccaggtgaaataaacagccttgttgctcagacaaagcctgtttggtggtctcttcacatggacacacgtgagacacccctcccataatctgttttgccagatggtatataaactcacgaactctgtagggagatgggtaatcactttatggttctcccaatgtgcatgttaataaatttgtatgccttttctccagttaacctgccttttgtgagctgatttttcagcagatcttcagagggcaaagggaaagattttccccttggctcgtaacacaatcaaatcccaccctccttcccttcatagccaaacttccttcaccaaacctgcttacttccacattcattctacaatctattctccaaagagcaaaggaatcttttccagatcacgtcacttccttccttataaccttcaatggtttcccattcttttttttttttttgggatggggtctcactctgtcacccaggctggagtgcagtggtgtgatcttggctcactgcaacctctgcttcctcggctcaagcaatcctcccaccccaataccccaccccaactccaagcagctgggaccacaggcgcacaccaccaccacatccagctaatttttgtatttttgttagagacagggtttcaccatgttgcccaggctagtctccacctccagagctcaagcaatcaacccgcctcggcctcccaaagtgctgggatacaggcatgagccacggcgcctggtgacaccccattatattcttttattttctttcttttctctttttttctccctccctctttccttccttccttttttcctttttctttcttttttaaatactgtaggcctttactatgggtcattaaattcttgagcaagctggttgtggtggctcaacactgtaatcctgctactctggaggctgaagtgaagaacagcttgagcccagaaggtcgaggctgcagtgagctatgattgtgccactgcactccaccctgggctcagcaagaccttgtctcttaaagaaaaaaaaagattgagcaaatatttatagagccccctaatatgtgccaagcagttttaggcacttggcatacttcagtaaataaaacatcaaaagttcctgccctcagggagcttatattctaatggggacagaaaaggaataatgaacataagtaaattccataagatgttaggtgataaatattagcataaaaagcaaaaattagaccaagaggggaaaaaaaagagtgccaaggtggggtttaatgttgcaattttaaagactgtggtcaaggtagacccaaagcattctaagtgagtgcaaaggccccaaggagggtgcctggtatgtctgtggtacagtaagtaggtcaatgtggttagaatggaatgagatgggactgagtggtagaagaggtcagagaagtaaaccagatgaggtggggagaggagggtcacaaagtaccttataggccattggagggatttggctgccacacccttgctcttagaaggcagtcctcttactacagccttgcaggtccagtgatccgggcaccatccgcctcatcccctcactatgctctagccaaggttgactgaatttagttgcttaaacacctcaagtgtgtctgcccaccttggggcctcacacaatccatttcctctgtttggactcttttatgcttttacctaacaccttatcatttttcaagtcttgactgaaatgtccaaatcaggtcccctcatcttatcctatcacatatttctgccttgtagctcttacctaatgtaattttacattactttgattctttccatcagtgtgtacttcctgaatttgactgtaaaaaacgacttgagtgcaaggactgattctcttgttgattggtgtgtgtccaaagtcagtgccaggtaaactgtacacaatagatacctgttaaatgaattaatgggatgggggatagtcaaaagagtttcccttttttaggataggagaaatccaaagagtttttttatttttgttttttttttgtttgtttgttttgtttttagagacagtgtgtccctcactttgctgctctgccactcaggctggagtgcaataagaacatggctcactgcagcctcgacctcctgggctcaagccatcctctcacctcagcctcctgtagctgggactacaggtgcgcaccaccatgcccaactaatttttaattttctttttgtagagacaaggtttcactatgttgcccaggctagtcttgaactcctagggtcaagcgatcctcccaccttggcctcctaagatgattacaggccataagccactgcgcccggcccaagcagttctgaataatgatgaaatgggctcagttgagagaagctgaagattaactataaacaatgagtaacaaaggagcactggaaggcagaggtggatgggaatcgtagtgtttacggagggactagtctccaataggaattttttttttttttttttttttgagacggagtttcgctcttgttgcctaggctgaagtgcaaaatggcgtgatctcggctcaccgcaacctctgcctcccaggttcaagcgattctcctgcctcagcctcccaagtagtgggattacaggcgcccgcaccatacccagctaattttttttgtacttttagtagagacggggtttcaccatgttggccaggctggttttgaactccggacctcaggtaatccgcccgcctcggcctcccaaagtgctgggattacaggcgtgagccaccgcgcccggcctaggaacctctttcaaattcaatcaccctctaggtcgactataccgcctagctgcttcacaatttgtcccttcctcgccatccatactgccagccttaattcaagttcacattatcacttgattggattattacaaaagcttccctaccaatcggtcgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtgagcggcttcccagaggtagccttcaaagcctctgcgctctgggagaggggaaggcctcgggctcatagttctagaggctcctcaagcttcagaggactgctccttccgcctgaactagccacgaggagactacaagttccgttgtacaccgcggctccggctgcaaaagcctggagcgttgggagcatggggctgatggaggcatggcgggagatgtagtctggagctcataacggttagtagtaatagttgtgattcagttcagtggagtggattgagcgttgtgatccaaaggaaggtaggacgtattgggagctctggtgtggggcactgccaggctctggggcttactgggagctgttgcttgtggcgctggggcaccatgagaacagtagtatggatccctgtgggatattaagggagctgagatcctcaagccctacaaaatgtttcctgcaggacatgggaaaaaagaatcaaaggtcgtctagtccaactttctcctctacagattgtgaaagcgaggtgggaagtaatttacccaggctcatacaagccagtagaagactcaggcttcctctccccaaattcagggcattctccactccaaggcctgtgtgtagaacacgtgggttacaaaggcttgtgggaaaagctaccaatggaaactaccccccttaccaccatcaccgtggcctagcttggtgtctgttcccctgggctctttccttaagcatgaacatccatcaccctcctaacccccaggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggtgagagttgggaaacaaggagggcaggtggttgtgaaggggctggtgctagaggcctgtcacaactctccctttacctacccacaggagctgagtgggcttggggacaggaagagtttgctgaaccagtaagtataagcccttttctctttagtgccagccctcaactgtggagtgggggggtcacagacctgggtggtttgggtccttcataaggctaactcctagccacagcaacccccatacccaaccccaaggtgcattgaggaacgttacaaggccgtgtgtcatgctgccaggacccgttctatcctttccctgggcctcgcctgcttcaagcggcagccagacaaggtatgagctgatctcaccccaatcctaggtgtggctgtggggtggagggtagagagattctagggaacatcagataggaagcatttctctcccaaatctttttttttgacttgatagtttttttttttttatttgaataggtttatggggaacaggtggtgtttggttaaatgagtaagttctttagtggcaatttctgagattttggtgcacctatcacccagtgtacactgtgcccaatgcgtagtcttttatccctcacctgcctccatcctttcccccctgagtccccagagtccattgtatcattcttaagcttttgcatcctcctagcttggctctctgaaatcttgatatagcagacttctctttctcccagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaaggtaggcctctagcctccctagccttgagtctgccctttctgtgactttatttcttcctaccctaggctggatgtctggggagaatctgcttcttagggagtatggggaatcactagtgacagggcttgggaaacaagactggtatgaggagggtgggcagcattgggtaaggtagagagagagcgttccaagtggggaagtctgggataagtgcccagcagaagaggctccctgggggactctgtcctcctcattgacccctttactttcatctagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatggtgaggaaatggttgagggaaaggggtggggcctgatacgagtttatttcattcacttaagatatttattgagctcctaccatgtgcccaggcagtgttttaggtgctgaggattcagcagtgaacaaaacagaccacaaaaccctgctcttatggagcttatatgctagtggaccattaccctcttgcgctgttgcagtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggtgagagcacccacctgtttcttgggagggaaggttctgatgcctggagcctctttctaagcctctttcccacccctaggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatttgaccagcttcatctttggttatttcttattgcagctctgtaaggacagactgttcccaaagctccagccatggcaggaagggaagcaaatcagtccctgtataaaccatttaaccaattgaatgtatcacatgttgataaatacatagaagcaggccctagggcctacaaaaccagccccactcccaaccacaaggttgaaagtcttatggggcagaacattaagactcctttataaatatgaaaatagattaatcaacaggaaaaggtctttgaataggttagctaagagccatgaccaccacgctgccttgctgtccccttgcatagaaatgtagtgacgtggtctgaccatgcagtaagtgcaaacagcaattactcaaatgtcttagaatactggcaagaagcaccccaatattcaggtctgggaaacagccatgaccattacggcctcttgatcagctccatgttccactcagtagcttatatgccccaagaaaaggcaagagacagacctggggtggggaaagaaccggggtaatagctgcctgccagctcagcctagaactagacatcctctggtcctatctggggaagtacactggagagggtctggtgggaggcagacctccttgctggatttcagaggcttggtatcagctgttggccctaactaggaaggcctctcactgctgcctcccgtcatacacagccaatgggcactgggagcccagaagttgagcctggcttggcctagcctgcctgctctgtaggctccagggaagaatcaaggctgtgcacctagggggccatatggtttcagctgaaggtccatccccaaggtgaggcagggactaaaccccctcacccatcctgctttccctgggtttgcaggcctatgcctgaggtggagaaggtggctggagttgagcctgctggcctttcttctacctccatctcctcagaagcacccgcagggcatggactggtcccctggggcctggacccaaaaccattttcttcctggagaatggagcagtccatagcctcatgggcttgagcagctggtagggcagatgcccggaatggtgggatctctttaactctgtacttgagactacttaggcgtggtgggggcccatcagatagcgattcttcccggcccacaaatggacaagcctcttgatgcaagaactcaggcgaaccaggcaaggaacgccaccggcgaataggtggggccaggggctcctgccagtcagccaggggcatagttccgggccctggtgcatccaggtcaaataccagagagatgacagacttgctgggcaggtcaaaaaacttgatcttgccccccatgaggtcctggcgagcactaaaagggttgactttgggggtgcgggcagcaccatctcgtggccggtagtatgggtccaagacactcactgtacgtgggggcttacgggaaaagatatctgactggcttcgagacagccagatggtacgtcttgggcatggtgacttgtgggggatcttgtcatccagtgagcttagtcgcttcaccccaggtgctttctccaagagtcctgaagaataatcaagtctgggttactctcactagtcataacaaatacaagcagcattttaccacagaatgttttcactcatgaaagcaaagctgataccatggccctgttttaccaatgaagaaacagactcagagaggggaagcagtatgccaagccacagctcttaaaaaggccagtactttctgcatcatctccttcccctcccatttgtttctggacctgggatcctggcaatcacaaccctaagaggagaaggccccacatccgaatttcctcccttagggttaggttgggctccctggtctaatctcttacccctggctgtgggctgcagcttcctatccctctcctgctcttcttcctgtaggcggctcagaatttcctccagggtcttcccaatctccacaaaagatgggcgcagtttgggatccatctgtaggtatccacaacagccatgagctctgccctccatctcccaccccaaagatggcatttgagtctatttctggcatctttgaagattcagatgtgcagctgagagaccttttctaaaggccccagacaatgaaggtgatccctacagttcaggtcagggaaaacactactgtctactaccctccctgtcttagtgtttgtcttatcaccttgtcacagaaccttccaaaagtatgctcatattagtttattctgttcttgagttctgctcctaatgtgtttctgggaggtatctgaacaaagcccacctaccccttgatcctaacaggtaaggtccagccccagagctacatacatgaaggccaagaagagcctttctcatatgcctcaggaccagttggatccacagtccaacaataaaaccggaccagagttccatcaacacctaacgcaaggagtgatgggtctaccctacaggttgaggaccagataatacaaaacaacttctttctttcctttgtccagagctctgaataggttagctgccagagggaggaggaggaggtgtggttgctgtcactacagtgaaaatgaggtccctcatgaagctaattagcagcctctctgtacagtcctaaccaggtgaaaagggttcagccagcccctgatgaaaggcagagggagaaagacactcacgttacagcagttgaaagtaagttgcagaaaatctgggggacagtctcccaccatgtgctggaaagcatcatagtccagcccgaaattctgtggatgggtatggaaagcataggtagacagttcattaatccccccacccatcctagcctgctcagtagaagtggttgggagctgcccctgacaaccagcaacagagagttccagcaagtccatcccagggacagaacagttccattgcttcaaactagccccatcagtggcaatgatccccatgcttgcagctcacctctgtgcggggaagatagtccggatcggcctggatgcgggcgatgatctcgcagaggatgataccataagagaacacatctgcctggtgggtagtcggactttggtttccctcttaatgggttgaggggtagggtatctgcccctgcccctgcctcccctgcaccccaccatctaacagcccaggcctgggccatattgcccatacttcatcccagtcagtcactgggcagctgccaggtaccaccactgctcttggtaggaacatcttggacactctgctaagagtggattctagggagaatcagccgagcgcgatggctcatgcctgtaatcccagcacttcaagaggccgaggtgggcagatcacttcaggtcaggagtctgagaccagcctggccaatatggtgaaaccctgtctctactaaaaataaaaaaattagctgggcgtggtggtgcatgcctgtaattccagctacttgggaagctgaggcaggagaatagcttgaactcgggaggcagtaagccgagatcgtgccactgcattccagcctgagcaacatagtgagaccatctcaaaaaaaagaaaaagaaaaaaggagaatcaggccttgagatcctccaaacttaccttttcattatagggctcatctcggagaacctcaggtgccatccagaatggggaacccaccacggccagcttctcactccccatgctgtggggtgagattatacagaaaatgagcttgccaatggctggtgcaatggaatcttttgaccattcctccacctcaaggatgggtacagacgaggactaaacaaatttagggagctgaggttgagctgtgaccaagtcctggcctctggggaggaggctagaattttcccttagcttcagccccctgtcccttggaccccagcatccagtagggctacacacctgacatcggggatcttctcagccaggccaaagtcagctaccactgcagagtaaccattctcatccctctttatcaggcagttctagggttcccaggaaggaagagaaaataatgtggctcagaagcggggatcagccatagagttaccacccattccccccttcctatcacagggcaccttgtcctctgctccttggtgaaccgcactcaagctgaccccactggtcaggtcaggggctctaagacagccaggtgagatgagttagtcctgggtcttgggtggctgtcctaggatacacttcacattccaaacacaattactcatctttgctttctaagtgctaggcataattttaagtgctagaaatagctagatgaaaacaaccaaaacccttgtcctcttggagcttgcaatataggggagaacaacagactatcaggcccctggcctcccttcctccttcctcagaaacacagacccaaagcccaggcctgaccttgccaacttgatataagcacaagacaagtgtctaagccttcactaaccttcactgtccacaagatcacaaccaacctcttctctggcattaaaagtctatgatctggctttatccaactggcctagccgctgtccccctgttcctggtgcccctatgcacatatcctcatccaaacttgtcacagacaagcttgacttaccaaacctgaacaggtccttcaagcctttgcctttgcttacattgttccctttcatttgaaatattctcccaattatccttttcacctaagaaaattttgtattttaaggcaagctacctttttagccatgacctcatctttctccctctcatctcaactcttagctcctcctctatgccactcctcttacagtctagcagaaaagctatgaacccctcaggagcaagttctggtttgccttccttcctcacagctttcaattcatgagacaggctgagaacatgctcactgaaaaaatgctgtcttcaggtcaacccaagtgacctgtaaataaacaaaaagcggcaaccagctctccccaaatagctgctttcaaaatagccctacactgctctggctcaagaggcacctcaccccacccgcttccttcagaatagcagagagcagggatccttggctcacagaaacacttctggagccagcaaggccccatctgacccaaaccagccctccctcttccttgccagccttggtatctagttgctaagacatgccaagtcacctcctgcttactcctgtcaggtacaaatcaatcccttactctggccttgacatgattacactatttcccttccccaagctggaaggagccgtgatttcatcacttctaccctggatcacaggtagacatgcctcatctctggcttccaggaaggacagttcttgtgcttgtcctggctttggctctctaatcagtcctgctggctcagcactcgcagctccctgactttgactgtctgtgagaagatgggccctaggccagcctgcctattagccaaagccccagctatagggcaccagcctgtgaggcagtggcagctcagatatgtcacctatgtctcttccctcctagaagacttttgagtgaggtagccctgcctacactaagcagtaagagaggaccagtcagatttccctgaggcaagaggtgaccttttcagtttcagaaaacagcccaggcactgttgctgcctggttcccattcttcatttcctcacacctattatatcacactgcaacagtgacttacatgtttgcctcttcactggcaaggaatgatttcatttgcctctgtatctgtaacctagcacaggtacccagaaggagcttggcaaaagtgtgttaaatgaaagtttagtctgatgactgaagcaactgggcttcttttaaaagcatgtgtcaagctgggtgtgatggctcatgcctgtaattccagcactttggaaggccaaggcacgtggatcacctgaggtcaggagttcgagaccagcttggccaacatggtgaaaccctgtctctactaaaaatacaaaaattagccaggtgcagtggcaggcacctgtaatcccagctactcaggaggctgaggcaggagaatcacttgaatccgggaggcagaggttgcagtgagccaagatcacaccactgcactccagcctgggtgacagtgagactctgtctcaaaaattaaaattaaaaaaagcgtgtgtcaaacgtatacaataatcatacattccactctccatagtgaggactgagctgacaagagactcaaaagggtggccatggatgcatttcctggaaacctacacaaattcttcagaactgggccagatcagacacctgaaagtgcctgaggtgtcctggaacagctgcacagtcagtattaacactgaataaagccacctgagtgaagaaatgccaagtctattaactcatgttcactctaaagctgtttctgcaacaaaaacaacaaaacactttctatgtggcttcacctctttcccctcacccgcaacaaactgactccctaaacccagttaggatcaggcaggaaaagactaagattctactgaaagactgaacagttaagaggttcttttcatagcacagggagatcagtgaccgaactgccggactcctaaatgcctcagggactgttatatttcaagtctcttagaggattatctgttttggtgtgatgtgtcccatcccttgccctcaatcctaccatgtgatctcatacctttaccatagctcttgtgtaatggcctgctgacttaaatatctccacaactagagtagagcccatggaaggtagagattggattccccaatattgtgccctctaatagcacagcataaatagttcccagaagctgctgatggttttaattataaaaattaactttagggtacactaacagtcattctctacatccctccagcattcaacgttgttcctaattcatgttctcttcactctgaaaattggcattttctattcctcattgtgtggcatagcctaagaccataactgaataggcttttcattccagtgaaatcacctaagtggcttctatgcagtcaacaataacaacagaaaagaactaagaactaaaggtgcaattcataattcatactcattcccaacagtaatcacagaagatcagttgggcagtaatggtattaagcagaagcaaactactttctcagctgcccccaagagccaaggctcgggtatgtgtgtactggttacttctagagctactgataaaagcctgtgtgtggctattggcacttcttcatagtgctcacaaactgaatatttttaaagccacactgcctcccacttccttccaagtaagttcttggccttgccactgcaaaagtctgtttcaggctgtttcttagaagtaattacaaaattagactgaatggctatatctgacagacattttactcttagagcattattgcagtagctgcggacatgagtcctataaaggtaatactactttcaggaggcacgttgataggaaactagggatctttttgcttctaaccacaggcttaggatcatttggaaaaaggcatcttcttctctctgtcctggtttacccacttggaacatgttacctctactttaaatccctcttgttagctctggtctgagcagtgtggactgatcgctcctgcaaagtcaaggacagcatctgttttacagactgggagcacggaggttccaaggtcactgaagtcgttcagagatggggacaaaactgggcctggaacccagaatctcagctctggagcaggcgttttggcctctttgctatcaagcccttcgcccttccctgaaataggcccaggaagactttatactctcataggctctgtgctaggtggtaagaaaacaaaagtaaataagagaagcacttgagaaactcatgctggtgggagatacagacacaacagaacaatcaagtgatatggagtgtataatattaaaatataagaaagcctgatactgtccttaaagaaataagacacagacccaagatggactatgaagagataatttggaaacctccgagccctctactgtccctttagctttatttctcagagatgataaaagggcaatgaacacagacggtatctcaaattggacagtctggttcataagactcacttgtttgtcttcaacttgagatcccctatagtgtacttcccagccttcctctagagtttgcaaacgtcctttgttctcaccacctggaattatcctcaaaacctccttaaagtccggacccaagaaagtacagcccagaaatatagggagttatttctcctatgttcctagtttcttgtctcaagtcagttgacactgggaatacccattccccataaggaaaagcaaagggtagtggtcttatcctatagtccaaaaaggttatttttataatacagcacaacaagcccagacagaaccacacttggacactagcacaatgggacaaagtgcttttggggcacagaagggaatatgatgaactcttagggagtgggggctttcctcgaggaagcctagctaccctggcctagagtgatctttcctgctcagaaaacttgtcgtctatgtagctaaacaattataaaatgctgtgcactactttttagttatttgccaacaaaactgtacatacctctaggtcagaagttcctcttttctaatattccttcatccttggagccaggtataggagacacttgtgtgtgtgtgtgtgtggggggagtatctgtgtaactgatacatattttgtcacaaactccttctatcttagaaaaaatggcgctttctgagtaggaagcaaagatttgatatctgagttgattcagtcccatccatttgcctggaacaaatgcaattttctttttttttttcttttttttttccaagacggagtctcgctcagtcgccaggctagagtgcagtggcacgatctcggctcaccacagccaccatctcctgggttcaagcgattctcccatctcagcctcccgagtagctgggattacaggcacctgccatcatgcccggctaatttttgtattttagtagaggaagggtttcaccatgttggtcaggctggtcttgaactcctgacctcaggtgatctgcccgcctcggcctcccaaagtgctgggattacaggtgtgagccaccatgcccggcctgcacttttcttagtcttggttttccaaaacattctgggggagaagaaatggctaataaagagataagatatcaccttccaggtcccaactgcctaactgtccagttcttacagacagtaatgtagataaagggctccttacaactaggcctctgctggttcccagtttctacttgccagtcttgtgctccttcaggaacagtgcagctgactacaaatgactctgccacacaccaaaaccattctatgtgaggcatccaggtacttactgctttaggctttattgactcagtactgctgcttttgttccctttcaagctttttcttaagatgggctcccttcccctccccttcatctggggcagaaggagtaggagtatgtgcatgcatatgtgaatatgtgtacatgtaggtattgagggtggggaatgaagtgacagctattcttaggcaggtacaaaactcttatacacctccctagcagactttaattcagttcttgggc

SEQ ID NO: 385 - DNA, 67545 bp, Homo sapiens
tgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttcacagatccctgcatgattgggaaggttaaaatgggaccaagtaagaaaggtagaaatagaaaggatattgattgtgcacaattagaaaatgggcaagatgaaaataattaaggacaaaaaaaggggagaaataagaaaaggtgtttggttacctggtaataagggcttttcataatcaccttaaatactttactgccagttcatgtcatatgacaaattctgttcttatctgtgcattggttatcatttttctttactttcaatgaatagaaaacagactgaggtcttttctaccaagatctttgtgtgacccatcatctctcctggcttttctttcccacgccaaaacacatcctcagtattaaaatcaccaaacagcttatgcctcagggctttcacatttgctcttctctcagcatgaaatgtttctctgatgttagtacgattttattaaattctctccttacatgttatattatcaaaaatacctgctctgactaccttatgtgcagtgtaacaaatctcaccatgcactgtacgtttgcaatgattgctcttattatcagcagagtgaatgactgtttcatcaaatgtataaatagacataataagtgatttacaaaaattatttatcttcagtatggtgacctgagatgacctcgtattcagggtcctctttcactggcctctttgctactcttttggttaatcaatgacaaatggagataacagcatatatccaattaatacccagagcaattggggtgtggaagtagaggaatccacaacagctgggaggttctgaggagtctcatcctgaaagtttgccaaggacatttattggagcctaaaggtgtagacatggtgtagagggtgatgatagagaaatactcagtggaccacacatgttggatacttgaaaactagaagcacagaggcagtggatatcagtcttgagagagaagtctcaaaatattagatgagatgattctgttcccggaacaaacggagggtcggctgctgcttcttgcggcccaataacgagatgcagatttactgggaaagaagcgaatttttatttctgcgtacagggagaaggcctagaaaatatctccagaccaactcaaaattacaaagttttccagagcttatataccttctaagctatacgtctacgtataggtgtgcattattcatctaaaaacataagtgattaacttcttcaaatctataactaaggtctgagttttaagaccttcctctggtgcctcagtaaatttacctaatctagatgggtccgggtgctggggtgattacccttatcttgtctctcctgctaaatcattaaggtttgcggagttccttcagaccctcaataaacttgtttgtggaggcctgggagttccttcagacccccataaaacttgtttaatcctaaacaggtcctaatcgattccttcgttatcttgtcatgcttcaaggcccaggaaaggcctgggcaaaactctcagtgggcttctgttacattccagcctttgtataagggcactggctctatcagcttttaatatttttttttcttttttgagacggagtcttgctctgtcgcccaggctggagtgcaatggcacaatctcggctcaccacaacctctgcctcccaggttccagtgactcctctgccccagcctcccgagcagctgggaccacaggcacgcaccaccacacccggctaatttttgtatttttggtacagatggggtttcaccatattggccagtctggtctccaactcctgaccttgtgatccacctgcctcggcctcctaaagtgctgggattacaggcgtgagccaccgtgcccggcttcagcttttaatatttaacttaaccagacgggtgtggtggctcacgcttgtaatcctagtactttgggaggccaaggcaggcggatcacctgaggctgggagttcaagaccagcctggccaacatggtgaaattctgtctctactaaaaatacaaaatgagctgagcttggtgacaggtgcctgtaatcccagctacttgggtattctttccacatgcttctcctgctcttcgtatctcacctaagctctgcttttggggggcagatacggcccacggagagggaggagcaaggttaatgatttttaagaaaatccagtagttccctgagtctggacttggtgccctagtagaggcaaacagatgctgtcaccagggaagccctgatgaaatgactgggaaagttatttttcttaacgtttttctttattccctttatgtatagacaaagttgcttaagaagaagccagactgcccagcatggtccagatcttgacccctgaccagatccaagggggaaattagacccccgaaccagcgtatatactggaactgacaatccctaattgcctttagatcattaacatatcactagagtgttaagttaccccctcccccacacgacaccaaacaagaaaatctccaccattttgtgtgcctgggttgtattgagaggtgacagcatgctggcagtccttgcagccctcactcgctcttggcgcctcctctgcctgggctcccactttggcggcacttgaggagctcttcagcccaccgctgcactgtgggagcccctttctgggctggccaaggccggagctggctccctcagcttgcagggaggtgtggagggagaggggcgagcgggaaccggggctgcgcgccgcgcttgtgggccagctggagttccgggtgggcgtgggcttggtgggccccgcactcggagtggccggccggccccgctgccccgggcagtgagcggcttagcacctgggccagcagctgctgtgctcaatttctcgccgggccttagctgcctccccgcggggcagagctcaggacctgcagcccaccatgcctgagcctccccacgaccccttgggctcctgtgctgcgcgagcgtccctgacgagcaccgccccctgctccacggcgcccagtcccatcaccacccaagggctgaggagtgcaggtgcgtggcatggcacaggactggcaggcagctccacctgcggcccggtgcaggatccactgcgtgaagccagtggggttcctgagtctggtggggacttgcagaacctttatgtttagctaagggattgtaaatgcaccaatcagcaccctgtgtctagctcagggtttgtgaatgcaccaatcgacactctatatctagctactctggtggggacttggagaaactttatgtctagcgaagggattgtaaatacaccaatcggcactctgtatctagctcaaggtttgtaaacacaccaatcagcaccctgtgtctagctcggggtttgtgaatgcaccaatcgacactctgtatctagctactctggtggggatgtggagaatctttgtgtctacactctgtatctagctaatctagtggggactggagaacttttgtgtctagctcagggattgtaaatgcaccaatcagtgccctgtcaaaacagaccactcggctctctgtaaaatggaccaatcaggaggatgtgggtggggccagataagagaataaaagcaggctgcctgagccagcagtggcaacctgcgctggtccccttccacactatggacgctttgttattttcctctttgcaataaatcttaatactgctcactctttgggtccacactgcctttatgagctgtaacactcaccgcgaaggtctgcagcttccctcctgagccagcgagaccacgaacccaccagaaagaagaaactctgaacacatccgaacatcagaaggaagaaactccggacatgccgcctttaagaactgtaacactcactgcaagcgtccgcggcttcattcttgaagtcagtgagaccaagaacccaccaattccggacacagtatgaagacatgtgtttataaacagaggtggcacaactggagttccaccctataggctaacactcctttctctccccgtactcagttcttttaaagccaatgctttccactgttttgggggagggggctttagagaaggagctctcttactctccactcctagcaagaaataaaacctgcttgccttttttcccattatctttgtaaccaatatgaactagggaaagaactccatttacagtgacaatgacaggactacagaactggacagctgtcacaccatgaaggctgatgtcacagagccaggccaaggtgatgagaactgacctgtagagttatgcagaaacactacattagtaaactaataggcattaaatcattaggattccaaggcccctgtctttgcccttgttgttgggagaagacactgaaagagagaattctggctctctacagcaaagttcaattaaaaagtatagagtagggaggggatggggagagagtcagcatggaaaaataaccagccttcgggaaacaaagcccttcactttaaagctctcccttctttcaaatctgcctgcccgccaggcggctctgttcccctcagtcagctctggcagcaagaagtctgtgaactgtgtcttttccccacccccgcacagcttttcagataagttaaactcaccaaggtaaatacagttttgtcccaaagacttcctacttctgccctccacaaaatcactcaatacaccttcagacaccagtgcagaagtggtgattctggggagaagagtgaagacaggccagggaagacgtggttaggattcactcaccaatccacgggcctgatctgcacaaaggaattttcctagaggaaccgcaggaaattcttgctcacactcagggcaggaaagtgaaagataaactatgggccaatggcatttctccacgtagggcctggtgagtcccgccctctgaatgaatcagccgggccgtgtagctgtgctgttcacaggaggagccgtgggaactagaggcattcccactcaatctcccttttctcttgagtctcaggatcttgttatcatgccacttcttctgacatagtttcagattaacccagccaagtattaaaaattagaaaaggtgccctttttcgaaattcttccaatgtgctcctcttgctcctgatctcacagctgagttctgcttctgggtgacagatatggcccaaagagaaggaagaacaaagttaatgatttttagagaattgcagtagatttctggtctggacttaaaaatcttataggacctatgaacagaaaaggagctgcaggtaggagagatgtcatattattaagactccgaaacccagagaggacaggatgctagaaatttatctggagagggccgggcgcggtggctcacgcctgtaatgccagcactttgggaggctgaggcgggcggatcacaacgtcaggagatcgagaccatcctggctaacacggtgaaaacccatctctaataaaataaaataaaataaaataaaataaaaaattagccgggcatggtggcgggtgcctgtggtcccagctattccggaggctgaggcagcaaaatggcgtgaacccgggaggcggagcttgcagtgagcagagatcgcgccactgcactccagcctgggcgacagagtgagactccgtctcaaaaaaaaaaaaaaaaaaaaaaaaaaaaagaagtttatctggagagcgataaagaaataccacattatttctttcaactattcactttcaaagaactctccaacttcccgctgttgtcttttccaaagtatctattgcatccctgagcagggccaggccttcctctctcttctcttctggttactatgcaaaactggtccaaaaggctgaactgtggtccatgtaccatagcctcccttctaagctttcccttactggaacatctcaggaagtccacactggaactaggatcattggtagagaggagtatttagtttgaaaatgaaaatgcctcaggagaaggcaatggggagcactgcagtgggcagcctgttatcacttaattccatcatcagtaacctcataccccctccacactgtacccccgcagctttctgtttcatgaaatcaggtagggggcttttgcattttgttctttattgtctcagatttactagaatatggtgtatataaggagtaatatttaaatagatatgaagatatatagctattaatctaattttaattgaatatcttgatgtcacatttctgttctattcttgctgtaaagataactgctgtgtcacctagtttaattcaaatattcttctggcattagtaataattatgtggcagtaataattatagtaataattataataattagtattattaataattacaattattaatagttacaattataattaatattactaattgttatttagtaataattatgtggcattagtaataattatgtaatgattacatttgcagtggctcacacctgtaatcctcgcacttcgggagaccaaggcgggtggatcacttgaggtcaggaatttgagaccagcctgaccaacatggtgaaacctcatctctacgaaaaatacaaaaattagccaggtgtaatggcagatgcctgtaatcccagctactcaggagggtgaggaaggagaattgcgtgaacccgggaggtggaggttgaagtgagccgagatcatgccactgcactccagcctgggcaatagagtgagactctgtctcaaaaaaaaaaaaaaaaaaaaaaaaaaaaaaaaaaaaaaaaagtaattatgtaaatttttaaacaaattttaaacgattttttaaaatatcctctctgttttcttcctaagtattattcagactctaaccatatttactcttattttgctctttttcttgaagagaaaaatgttaaatatccatggacccaaaggtagagatatttcatttgattccttttcaagcaggaaagcaggatatataaggtttacaggctgggcgcggtggctcacgcctgtaatcccagcactttgggaggccaaggtgggtggatcatgaggtcaggagattgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagatcgcaccactgcagtccgcagtccggcctgggcgacagagcgagactccgtctcaaaaaaaaaaaaaaaaaaaagggtttacagagaaaacacagagctccaacaataatatattttttctacaatttagaacataggttagaatatggagcctgccaacatgctctactctggtgataaactgtgtgtggtgcattcagtttttctattggcccacgttttctggtatcttgtcaggacctaatattactactgttttctctcagctgcaattaatacttcatgagataaatcagaccaggatgaaagttcacttcagatgttcaaagccagacgagaataaaaggatggctatgagatctatggaagtgctgagaagggaagaaataatggacagagaacaggtctctggataaatgagttcattcactttgtccattgtggttgacactcggactccactctgtgcactccagaaaaaacacattcactcactgagcgctcactcccctacaaatgtcaacaagatattctattcaaacatggaatatacctaaaattacatctcttgcttatttatcttcaagaagaaataagaaaatttcacgcctgtcttagtcaaggttcatcatagcaatagaaccactaaactatgaatttatttggaaagaaacttgagaaatgtctcaggtgattctggagactggcaaatccaaagtctgcaaggtaggccaagaggctctggatccaagaaggagtcaacgttatagctcacgcctgaggtttgcctgctggtaatattccctcttctcggggagaagtcagttttttcttctattctggctttcagctgattgaataaggtcctcatagatataagtgagtaggaaagaatttatagccaggattagcttattattctgtgagcaacaaataataccaaaatatctattattgaaataataaacattgatttctcagtcatcctacatgtgtatcattgattaaagtatgaagatggccatgctccatagtgtcagtcagggatccatgttatggaagctccatgagttgcctttttttttctttttttttgggtgtgtgtgtgtatgtgttgtgtggtgtttgtttgtttgttttttgtagagacagggtcttactatgtcacccaggctgcagtgctatggtgcaatgacgcaatcttggctcaatgcaacctccacctcctgggctcaagccatcctcccatctcagtttcctgagtagctgggactacaggtgcacatcaccacacccagctatttttttttttttaatttttcttagagatgggatttcaccatgttgcccaggctggtgttgaagtcctggactcaagtgatccacccacctgggcctcccagagtgctgggattacaggcatgagacaccacaggcctccatcagtttttgatggcattatctggcacatgcagttaaacaagaatacaatagacaacagggtacagaagtatgtgcatgacgtataacatgtttcagtgctgctttttaattgattgtgtaaaaatgaccaaacttttcttagagaagcagggaaaagtggaaaaattatgaaggcatgagagtaactcaatgaatgattataattaaacagcatcatctgttaacttccatgttctcacctgcctcagtggctgggtaacatgacactgacacagttttacctctattactctctggaatccatcctcatctggtctgtctggattaggagcaggaagtgataattaattgatggactcttaagatttaatgacattttgagaacatttttttcaatgggctcacactaaagatccttttatttataaaaataatttttttaccattcacaatgtcagctgctaatactcatcttgtcagcccaaatttgtagagctttataactgagtatcttcctcgtcagactgcatttcaagaagctaggtcccaagtctctggatctttattttcctggcttaggtcttaaatataagataaattcgactaataattataggactgcattggaattctaagtattcaggcaagctgtataactgtaattcacattctttttattcaaatattcttgcttgagtaaaccacagtaagaataaggaagtagtgactgagtgccttgccagtacagcagatgctagaacataatgtagcattactttccccagggtttattgttatgtaagttcttgttcagcttcctttgttttctttcacttctgagaatttaactttcgtttctcactcagctcctgtggggaaactcatttgtggagaccagccctctggcttggtgagtgaatctggtttacaccggctcctgccctgccttcactcttctcccctgattcaagactcctctgctttggactgaaggtgagtggagcaatctgtgggagcatagaatgggaggctttgagaagaatagattgattgtgtctgggtgagtttaatttgtagttctgaagctgctctgcataaacaaaaagaggcagcttgtgaactgtctgctgagatggcagaggaagaaagcactgagtctgggagaggggtaacctttaaagaagagaggtttgcaaaagcaaaaagccttgcttgtttcctagagggaccattcatttcttcaatctaggtacctccatcaccttccttgttggaaataaagctcagaatcttaagggagacgagcactcaaacaaaggatttctcagcaaagcaattttatttctgtgcagaggggtgcttcttctttgccagtcgccatgagagcacactagaacaaaggaggaagaaagtttttattcctgacgcaaatcctacccctttgccctttccccattggctggagtcggccacacaatctaaactagactcagttggctaaacattttaactttctttagataaggtgggcacgtgagggagagaggggagatggggaaggggtgtgtgtgatgagctagataactaatcttcttccaaaataaggaaaggaatgtgagttggtactgataacgcctggtactgtgacatgtctaggcatgtagcaaaagcagaaaggaaagagaagagaagaaaagtgaagtggggaggggcactgtgaattaaagaataaaggattgatcaggctatttgaagagaaaccttatcataccccacattcctattctgtcattttgatttttccattttgccaacgtggatcagaattttcttttattcagaggcagcaaattccttcctcctttctcccgaagaagcctgtgcaatgaagctttgttttcacttttcataaagcaacctcatgatgaggttcagcagggatgagagcccttatctggatctgggtatgaggcgaaggagtcttaggtactcagtcttcagaagtaaggcccttttgaaggttatccttttacttgccttctggtaactttttggatgctgtccatagctttcctgataaattagcagccctctggttagtccgaggagagaggccgcaggacgggcagactgctgctcatctctgcagctccactttggtctcttgtctctgaaggtccagtcacagggaacttgttcttctgagtacccacagcttactcttcctttgtagcaggaccagccacagaaaaaactcctcagacaccgaggtaaagaaggaaggggtttattcggccaggggcataggcaagactcctgtctcaagagccgagctcctcgagtgagcaattcctgtcccttttaagggctcacaactctaagggggtccgcgtgagagggtcgtgatcgattgagcaagcagggggtacgtgactgggggctgcatacaccggtaattagatcggaacaaaacagagtagggattttcacagtgcttttctatacaatgtctggaatctatagataacaaaccaattaggtcaggggtccatctttaactaccaggtccagggtgtggccccgggctgtctgcttgtggatttcatttctgccttttagtttttactttttctttctttggaggcagaaattgggcataagacaatatgagaggtggtctcctccctcaacttctgtagcacccaatgaacctctggtatccactcctgttttagaagttgctattattctaggtacaccttttcatcatgagttacctcaactccctactcaattttcccttgcacagagctaaggcaaggagttggtaatttctcctgagtcttatctcgatcttatcgctgagcattttgtaccttgatgcctatgtcacccatattctgatgtgtccttttctttgtttcacttttcagaggtccaggtaactgtctccttatgtgtctgtaccgcacatcttgtcaaggtccatatctagtatttattcattgtcaagtctagtacaggacccaataaataaaactgtacttttaatttttgaaaaatatttttgactaaattcacaaaacaaaagcatacaggtatagtaaaaaaacaaaaacaaaaacaaaaaaactatctattcgatatataatcaacattaaataccggtaagagattatgctctggactagggaaaaggaagtaaacacgcagtcaaaaaaaggaagtaaaccagcagttttaatgtagcaaaaaggtagcagttactagaggataaatgtaaaaccaataaaacaaaagcaacaaactaaaagggctgcaataggatgtggtatctgtagtgctcttgtcaagggctttgcaactttaaatagatttcacattaggtctcactgtgagacaatgattttgagcagtcttcaataaaatgatggatttaagaactgatgaactaactgtgagagaaagagatgacactggggtagctttatgaaatctgtcctctgttacaaaatgacttatctgaaacatattgaccagagagttagaactcttggaaaaagggtcattacttggggaaaactaaaccctggacattttagtgggtcattgaaaaaggaactctgagtttagacaaataagaagtggtaacggtgtttctgagttctccaggtttctgcatgccaagaacaggacctattttctccattggtagttcctgacccaaggaacaggggaaatttaaaagatgttggctaggccaggcacctggtggcttgtgccaaagcctagccaaaaatcccagcactttgggaagccaagactggaggactgcttgagttgaggagtttgagaccagcctgggcaacgcagtgagaccttgtctcaaaaaaaaaaaaaaaagatattgatggctaaaccccttataatttttctccttattgtgtagccacactaatttaatttaatctttttttttttttttcttttgacggagtcttgctctgttgccaggctggagtgcagtggtgtgatctcagctcactgcaacctccgcctcctgggttcaagtgattctcctgcctcagcctccagagtagcggggactacaagcaactgctgtcacacctggctaatgtttgtatatatatatattttttagtagatacggggtctcaccatagtggccaggctggcctcaaactcctgacctcaggtaatctgcccgcctcggccccccaaactgctgggattacaggcttgagccacagcgcctggccatcttttttttttttttttttttgatttaaattgcacagataaagaaagcttctgtgcaggtaatcagagtattctgaaacaaggaagctacggacctagttagccttcaccgtgtcatagaaacttctacattcgcaccaccttcaaaggggagcatgcattttgtttatgtgtctgtctgtctacctgtcttaggtcggaagggtttcaatggggctacatttcttcaatgttagaataaagaatgaataggccgggcgcggtggctcacgccagtaatcccagcactttgggaggccgaggcgggcagatcatgaggtccggagatcgagaccatcctggctaacacagtgaaaccccgtctctactaaaaagacaccaaaaaatcacccgggtgtggtggcgggcgcctgtagtcccagctacttggaggctgaggcaggagaatggcgtgaacccgagaggcggagctggcaaggagccgagatcgcaccactgcactccagcctgggtgacagagtgagactccgtctcaaaaaaaaaaaaaaaaaaaaaagaatgaataaatcaagaaaaataagcacttgtattagttttctagagctgtcatagaaaaagtaccaaaagtggttggcttaaatagcagaaatatattgccttacaattctggaggctagttatccaagataaaatgtgttgacagggctggttccttctgaaggctatgaaggaggcctctggtccatgcctctcttctagcttctaatagtttcctggaaacctttagcattccttggcttataggtgcatcaccctgatctctgctttcttcttcaccctggcatattccttgtgtataaatgtccctttttgataaggacacagtcatgttggataagggtctaccctaatgagcacatggtaactaaatagtatttaaatatactagtttcaaataagagcacattcacacattaggatttcaacatcatttggggagaaacaggacagactttatctctctgctacatattctcaatgtacttggcctcctttatggattgagacttttctcccatgaccaacagatgtttctttgaaatgtatattgagtctatatcatgtgtgtgatcctataactattttagcctcttttcctcttcccaaaatatatacatctttaggttcctatcaccatccttgccatatgtccaggccaaggtgaaatttcaacatttaaaaccacagcatgccccagaactacatagctggtctggatctctccatttctatacccccaatagcactgggtatcagtatagctcttgtagcctttacctttgttgtctgtataaatctgtgctgcagtggagagaactctgaaggaggaccttggggacaatacattcactcttactctacctattagattagaatgagtgatctttgtaagtcacttgattctattgacacacctgaagaaagggagtattcttatttctcaagggttttgtatgaagaataaagaagtcaaaatgatttctaaattgtaactgcttataaaattgttcatgataaaattattttcctattatggtgttggtggtggtggtgtgtgggtgtgtgtgtatgtctttggggatggagtgtgaggtcatgggaggacttgctatgggtagatgtgttaggatgtaaacacttcttcactggaaaccataattgtggtcccaaaggtcagctattgggaaactgctaattgatggaaagaaaagatgaaaatctgattaaaaggtctaatcatctatggagggataaggaagttgtggctttatatattcgttaaatgttttattcctgtatgtgattcacttttctaggtatagaggacatatcagtgaacaaaaaaagtcccaggtctatgaatggattacttttcaggaggaagaagtagacatttaaagaacaatcttatatattacatagtaaaaataagaagctaaatgtgcagtgagtgacagtactggtggttttgctataagtaaattatagtatgtccttctaagaagaggacttctaagaggagactgaattaaatgtaagagtgagtcttgctaacatcagggggaggatcattttatgcagagagaggagcaagtgcaaaagccttgaggagccatagatttgatagtttaattgaggaggtattttttacatggggaaaaaagtcagaggagataaaccttaacagtataagtaaaataattcagacaccaaagacatatattatgattctatttttatcaactgattaaaaacccaaaggatattagtagtggttgcctggagcttgggatcagaataggagtgatggcattagggtttttttttttcaggtgataaaaataattttaaattgggttacagtaatagttatatagttccacagatttactagaaattattgcatgatacacttaaaaatgatgtttgatgcagtgtttgatgctatgtaaatacaattcaatagcttaaaaatatgcaaatattcatgaatcatgcaaatattggggatacaatcatgccattcagagagaaaagcctgtgtgcaagcccaggggcaggggtgtgtttagtgcatttaacatggaaaatgtgttttgggttggggaacaaaaggcaggacaaatgatgggttacacgaagctcttggtagaagagcctcagtttgtcctctccagtagaagagaaaataacaataattgccttgatggggtgaaatttgtcctgagacaaaaattaagaataaagtgtttgaaattactacaaagtccattttattctgtcattggtttattcttcatgcctttcttttctcctttctctgttaaatattaatgttttgtcctgttctaaatctctgtaaaagcagtattctttctattccttcttttcttaccctgtccccttcaacattctcagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggtaggctccaagatagaggaagagagagcagagagcagaagatggtacctaatgtgaaatctccactttttttgtcctgctttattccccttgtcaccatagaacggagagccctgtgatctctttccatactctttgcttagtttctgatgcctgaaggacactgctgcacattgttttatttaaaaaagagtacaaatttttagcaaggaaaagttgaatgaatggagaattgctttgtaagataagctttcattgcccctccaagaagaacagtatttttgggaacacgtctggttagatgtgggaagagtggcaatgaaaggacgtctttccttactgcagggtctgctttttctctaggaaaagaatcaggctactcttgataagaggatggtgacttccatcatccaggaataaagaatacattcatctcctcagattttcccccatgccataggttctaatcaccagcctcactgtttctgtaaactagtttcttctgagagccatccaatttcttccttgctgtcctctattcaggtgctgagaaagctcataactttactctggtataatttatttcttacaggaaaagctgcaggtagccctgcagaggctgataaaggaggatcaagaggctgagaagctggaagatgacatcagacaagagagaaccgcctggaaggcaggaggagacacctcctaagggataattagacaggaatctgggcaggaccctgggctctatcacaaggagaccccttcctctttgctgtgctagaattaacaagcatagaagtcatttgattaggtctcaatttaactccttccctgttggagtttaggggctggagagtagacatatcataaatcaacactatatttggaagtgaaggcatggagggaaatatctgtgaaaacgcttcctgtgaatcctgtgttccatttgtgtcatcaggtttgaggctccaatccttccagtaaacaccctggagaaagacccaggattccctgtttagggggtttcagtagggggatttttttgtttgtttgtttgttttttgagacagagtctctctctgtcatacaggctggagtgtagtggcgcgatcttggctcactgcaacctctgcctccctggttcaaacgattctcctgcctcagcctcccgagtagctgggactacaggcatgtgccaccatgcccagctaattttttgtatttttagtagagatggggtttcatcatgttagccaggatggtctcaatctcctgaccttgtgatccacccatctcagcctcccaaagtgctgggattacaggcatgagccactgtgccaggccaggtagagggatttaagatacagaaaggcaaagttgttcaggacaggtgtctacaatccaagcctcacccaggcatcacattttgtctcagattaggcctcaataaaactgacttgagtgtattgctttgggaggagctcaggttaaaaagtagaaaaacatggcttcaccagaaattgtgtattggcttttgcctcctattccttttgagaactccctgaggaaaactgttcttatcctgtctcccaggctcatacaaagcaggccttcaaccagccagactgactgcctctttctcttttcattcccaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggtaagacttgggatggagcacctacgtaagagattaggggaaaaacacagaggccgattttccttcccttcccagtctctaggctttcttctgtgtggtgacatgaaatggttcctttggcccggcatgccccttttatgcccatcatttcaggggtcacagagatcattaagtgtatgaatgggaagggaaattcccattattattcacttatgagagcagtgtaaaaatttgagcttggagaggattctttgtaccatgagcatatcagttttagaactttcccatcacatcaaaaacatttctcatgcctgtttgcagtcaatatctgtttctacctccacctcctggcagcctatctgttttctgtctgtatagaattggcttctctggacctttcaatatgaattgaattataaaacatgtagtcttttgcatctggcatctttaacttagcataatattttgaggtttatttatattgcagtatgtatcagcattttgctcttattgctaatactattccattatctgaatatatcatattatgtttatgtattcaccagttggtggctatatgaatattttccagttagggactattatgaataatgctacagtaaacattcacttacatgtcctcatacaaacatgttttcatttatcttgagtagattttaagagtgttgtatgttgtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcaatgaaccgagattgcgccactgcagtccgcagtccggcctgggcgacagagcgagactccgtctcaaaaaaaaaaaaaaaaaaaaaaaaaaaaaaaaaaaaaaagagtgttgtatgttgtttatgtataagttttaagttgtcgtactattttccaaagttgttactcactttatatgagtaacaatacaaaagcttataaaaagcaatataaaaagtttctaggttcttcacatccttgttaatacttgattatttcctttttttttttttttttagttacagcctttctagtgggaacataatggtatctcaatgcagttttgatttgctttttcctaataactaacactgctgaaaagcttattatttccacatgtagattctgtacctttttaaagagttttttctgttttacttttggtgctattgtaattttttttttatttcaaatttcaattcttcattgctggcacatagaaaggaaactgactttagtattttaatcttgtatattgcaaccttgctataattacttattagtcatagaagagttttttttttaatgtcaattctttggcattttctacatggagaatcatgtcatctgagaataaagttaattgtttcatactctgcagtttgtatggttttttttttttggtgtatttttttggagacggagtctcttactgttacccaggctagaatgtggtggcacaatctcacctcactgcaaccttcacctctcaggttcaaataattctcctgcctcagcctcccaggactagcgcacaccgccacacctggctacattttttttgtattttagtaaagacagggattcactgtgttgcccaggctggtctcgaactcttgagctcaggcaatctgcccgccttggcctcccaaagtgctaggattaaaggcgtgagccaccgcgcctggccagcagtttgtatagtttttatttgtctttgcttgttttattacactagctaggacttctagtacaatgttcaacagggatggtgagaggggatatcctttccttttttctgaccttagggggaaagtactcagtctctcacttataagtatgatgttagctataggagtctttttttttttttttttttttcagatttgtaatgaagttgagaaacttcctctttttttcttttttttgagacgcagtctcgttctgtcacccagactggagtgcagtggcacgatttcggctcactgcaaactctgcctcccgggttcaagcgattctcctgcctcagctgggactgcaggccgcccaccaccacatccagctaatttttgtatttttaatagagacagggttttgccatgttgggcaggctggttttgaactcctgacctcagatgcacccggccgagaaacttcctctttattcctagtttgctgagactttttatcatgaatggtgtgaattttgtcgaatagcttttctgcctcagttgatataatcatatgatttttcttctttattgatatgggagattacattaataattttcaaagattgaaccagcttgcataccttgaataaatcccacttacttgtggtgcacaatttttatatatattttgttggatttgttttactaacgtactgttgagaatttttgcatctgtgttcatgagagatactggtttctggttttcctttctcataatgtctttacttggctctggattagggtaatgctgacctcatagaatgtgttacaaaatagtccatctcctttcattttctgaaacaaatttggggagaattttaataatttccttctccaacttttggtagaattcatcagtttaccaataaaacccactaagcctatttttaaagtgttgcttaatattttggagtattacagctgtctgttactgattactagttaaattctattgttgcgtaagaaaacattttgtatgagttcaattgtttacatttgttaacgtgtattttgtggtatagaatgtgttatagcttggttaattttcaatgtgagcttgagaagaatagatatttgcctttagatggaatattctatgaatgccatttaaatcagttgctatatagtgtgctgttcaggtacaactgtagcggtaatcatttcctgtggctgctgtaagaaattgtcacaaactttataacttaaaacctcatacaaaaaaattgtctcatagttctgaaagctcagagcccaaaatcaatgtaccagcaaccaccagaagctaatagggaagcgtggaacagattacagcagggaccaacattaccaatatcctgattttgaacctagcctcaagaactgtgagagactaaatctcggttgtttaaaaaccatacagtttgtgctgctacgttgttagagcaaccccagaaaattaaaacgcctaccatttttcactgttttctattgaccgtacttgctctttgcttttttttcccttcctctctttttctgccctcttttaactattttgtattattcaattgattattttatattattcaattttctttcctctcttagcttattagttatatattactaatatacatcacaaatatagctatattagttatatataatatacataactaatatatattagttatatattacatatacataacgaatatatattagttatatattacatatacataactaatatatattagttatatattatatatacataactagtatacataactaatatatattatattatatatagttatatataatatataactaatatgcctaaaggtatatatataaatataactaatatgcctaataatataactaatataactaataataatataactaatatgcctaaaggtatatatataaatataaaacaaacatacaaatatatttgaaatataaaaatattttaaaaatataaactttttataaatatataaaaatatattttaaaaatataaataacactatacatatatatataaaggcttagtggtttccctggagtttgcaatatgcatttacaactaatctaagtctaattacaaataacactataccccttcacatgtagtgcaggtaccttagagcagagtatcctcaatcttgagtaacgttgctgtcattcatttcacttatccataagctgtaatcgcccactacattgttgatattattactttaagccattatcttatatattagttgagaatcagaaaaacaaaatattttatttacctttacttctttttcagtgctctttctctctttgtgaagatctgaatttcagacatatactcttcttccccctgaataatgtcttttaacgtttatggcaaagtatttccttcattattgcgggacaaaatttctgaatataaaattcttgagtcatgggtgttattctttcaaaactttaatatttattccacatgctgaacttttactagttttagtagttgtgtgtttgtgtgtgtatattctttgagatcatttacatactgaatcatgctgtctgtaaataaatatagttaattttaaaactgcaacttttattttagatacagggagtatatgtgcaggtttgttacatgggaatattgggtgatgctgaggtttgggatacagatcccatcacccaggtaatgagcatattacccaatcagtagtttttcaactcacacaccctcctccctcccctagtgtagtctgtagtgtctattatttccatatttatgtccacgtatgctcaatagttagcttccacttataagtgagaacatgcagtgcttgattttcagttcccgtgttaatttgcttaggattatggcctccagctgcatccatgttgttgcaaaggacataattttattctttttttttctttttttttttgagatggagtcttgctctgtcacccaggctggagagcagtggcgcaatcttggctcactgcaagctctgcttcccgggttcaggccattctcctgctgcatcctcccgagtagctgggactacaggcgcctgcaaccacgcccggctaattttttgtatttttagtagagacggggtttcaccttgttagccaggacagtctcgatctcctgacctcgtgatccgcccacctcagcctcccaaagtgctgggactacaggcatgagccaccgcgcccggaaattttattttttttatgactatgtagtattccatggtgtatatgtaccacattttgtttatccagtctactattgatggatacctgggttgattccatgtctttgctacaagcaagaaaacaaagaaccccattaaaaatgggcaaaagtcatgaacagacatttatccaaagaagacatacaggtggccaacaaacatatgaaaaaatgctcatcattgctaataacctgagaaatgcaaatcaaaaccacaacgagataccatctcacaacagtcagaatggctattattataaagtcaaaaattaacagatgctagtgaggctacagagtaatgggaacatgtactctgttggtagaaatgtaaattatttcagccattgtagaaagcagtctggaggtttctaaaagaacttaaaacagagctactgttagacccagcaatccccctgctgggtatatacccaaaggaaaataaatcattctaccaaaccaaatatagttttacttctctttcatgctagatgtcttatttctttttatttttactcttttcttctttatctttctttttttttctttattgcacttgataaaacttccaatacaatgttgaccttagtggtgaaaccacacacgctagtctttttcttgattttaggaggaagtaattcagactttcactattaattatgttattagttgtatactacttatacatgtttcttatcagtttttaggatgttctcttttattatcagtttgttgagaggttttatctgaatggatgttgattttcttgttgaattttaggagtcatttatagattctggatattaataccttatcagacatataatttgtaaatatgctttcccattctgtagattgccttttcgctctcttcatagtgttcttcataacttaaaagtgatttttttaaagtttcattttggtaaagatctgtttatttatttttttctcacattgcctttactttttgtatcatagccaacaaatcactaccaaatccaatgtcatgcaattttccccttttcttctaggagttttatatctttaggtctttgatttatttttagttatagtggttatatggtataagttatctatttttaatgttattgtagccattgtattatattgtgccctgtttcacaaacagtttggtaataagggtgaagaggtggcagagagctgaggaatgtgccattttttgcaaacagtttggtaataaggctgaagacgtggcagacagctgaggaatggaccatagaggacaatatttgtttgtctgtctaacctctattccttttgattgtttctttataataacttttgaggaaccatccctaccctgcctcattccctgcagttggttaaagtagacaaaattagtagcattaggcatgtatatgttactcagttctggcaaatcattatatccaactcttatatttttaccaactttacagtaattattttaagatatatacttgactcaattggagtcgatggtttgcatgccttagaattttactgtcatgagtaaaaagagccgttgtcttttctgatgggtatcatatcagggataataatttaaaccaggagagtcaagctgatgccataattaatctgaaaataagtcaatataataggtatgaaatataatttttagaagaaaaaccagattctgatggcaagattttagtttaaagatgtagctatgagtaaaattatacttgaccccttgaatttgttttttaaaaatttaaaccagttttagttggttttgtcagatattacaacaacaaaaaagctaatacaggcagtgaaactatttctgagggtgtgaagtcaactggaggtcaagtctttgttggtataaagggggtcagatcagacagcgggagatcaaatatattggtacatacttgttcaaaaaaataaaggaaataatggttatggtgagaaagaaaagatagctaaaaacagttaaaaatgtaaactagtctaggttaataaaatgttggaatccaggataaaattttatagtttcaaagatgatgactaagtggatattgacactattcgggacagtggggtgtaaatagttgggaaatagtaagttacatttaagacctactcagttacttggtcctgtggcttgtttcatactgaaaaatgtatgagatcacctacagtggagtttagtcagcatacacagtgagtacatggaggccagacaaacttttagttgaaatgcttgcttgcttttgctcacggcaacagtacacttcttaaggacttttattattaattttcatcattagatccctaaagcctgaaaaaatatagggcaaacgtatttcgctgttttgtgtctgttgatgtataaaataaaaacacaatgaattaatgaggttttctcattaaaaatgtataaaaatattagagctcctccctctttttaaaatatattccttcttgagatacttgaagcatcttcctaacaccctcatcttagtcctctgcagtggtcagtctgaatcttatctccacactttgtccccagtctgtgaccatctatttattcccaccatatccagggatagtaagagtgtggggaggaaggtggataaaactttgtaagataggagggcctattacttttttgagcattgctagacaaaatacaggatgctcagttaaagtttaatttcagataaaagaaatgtaatatttttagtataagaatatcttaaatattataagggtcatatatataacaaaaaatatattgtttatcccaaattctaattgaactagccacttttatgttctaaatctggcaaccctatcttgactcatgttttctatcttttccccaggatgtgattgacgtcatgaaaaggtatatgtggaagagagatgtggtcttatttgtctgaaaagagaattatagtcctgagagatatcttccttcaatcagaacaacttaaaaaatcaaaaggctgggaaatttgtgtattaaattgtcccaaattgctagtcacagattaaagttttcaattgtaagaaattttggtgttgggagatcacagagttagggtcgacggaggccttaggaataagagtttgcaatatcagaaccccatgacttcactcactttattcaaacctctgtctctgttgtttccatattgcatagatgcctgtcttattgcagtgaggctctgccctttttatatgccagactccaaatttttcagagacagcgcctttatgtttgttttcctccctgagaataaaataaacaataactttctaggtggtgctttttagatttctagaaaaatagattcaagtcttgaggaatagtggctttggtcctggtgctagcataaccttttcttgctcacatactttaccgtcttgtaggaaaaaataatattcttgtgtctaaagttgcccacctacttggcaacatcaaagtttttttaaacacatgaaaatcagaccactattaattaatttagtcatcgtaatttgtctttccccaaataacttgaaacctcagacattattctctaggtctcatattgggataacagattttggaaaccctttagctcttcaatataggatcctactttgatatctctcaacaactcaggagacagattctatggcctccttaatgaccacctgtctaggaacccacatctctggcctcttcctggtggacccactgagatggcaatgacttttctaaatattaaataagttttttagaggcactgaatatcttttaaaagcattattggctgggtgcagtgggtcacgcctacaatgctagcactttgggaagccgaggcaggcggatcacttgaggtcagaagttcaaaaccagcctggccaacatggtgaaaccctgtctctactaaaagtacaaaaaaattagctggatgtggtagcaggcacctgtaatcccagctacttgggaggctgaggcaggagaatggcttgaacctgggaggcagaggttgcagtgagccgaggtcgcgccactacactccagcctggataacagagtgagaccccatctcaaaacaaacaaacaaacaaacaaacaaaagcattattattttatctaattttatattcatttttaagaggtagaaagcatggggttaattattgcattttaaaagtaagaaagcgaacatcgttgaagtgaagaccttcccaagattacacagaggggaagaccttcccaagattacacacagacaggtagacatgagcacatttctctggactccagtgtcaggcatctcccctctactgtcctcagggaagagggtccaagtgcgtcagcaagtatggtgaaaggtgaaagagacagtgatcttggatggagagaaatagggcaaaggtgtaaaggttatcaatttttgttatcactaggagtgaaagctggacattgaagaagccaaaatctgtttccaagaaactaaagagtgtattccgagtaccagatctgagtgggatgctgcaagttcttaaaggtaaggggattcaggggaaggctgtgaatgtggatttcttagtatcagggctcaatagggaagcgggaggtttttttaggttaggatataggagaggaggtgggccagagaaggaggaaaatcctgtgctgtagatgtggtcctgtcttagggggaatgaccaggtgtctgattcatcctctcattcaccagtgcaaagaatcccagtattccccctttcctttccctactctggagaagagacaggtgtcagtacttacttatttgcttctaacaacatcactgaaacttttgtcgtttcagagctgacagatgtccagtactactggggtaagatgatatggggttttcaaatcacttcctttcagaattgtggttactattagatctcataatctgagtctcatgtgttcctccccaaacatgcttaaaccatgtagttctttttttttttttttttaagatagatttttgctattgttgcccaggctggagtgcaatggcgcggtctcggctcactgcaacctctgcctcctgggttcaagcgattctgctgcctcagcctcccaagtagctgggattacaggcgtgtgccaccacgcttggctaatttttatagtcttacaccctgtatttcttaagggtcctactaacctctgactatcaacacaagttccgtttgatatcgacacaagtttcattttcaatatgtctcttctcaatgctgtaagacacacctatcccatatccttcacttgacttggtaattttttctacagtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctactgaagtctcattcttcagtttccaaaatcttgctgcagataatatgagtttccatatgtccagtaaagaaggtcatgtctaggctcagctgtccttgataagagacagccttatgctgttcagatctgtttctcgtaatgaaacacttgtgtgtaccattgcatttaccatcctaggtacttttctttttttttttttttaagtcttttttcaaacacaggatgagtagtagaactacctaggatagcaaagacacaaaacattcttgaagaaatatattgtattagtcggggttctccagagaaacagaacaataagagatatgtatttattatgaggaattggcttacttgattatggaggctaagacttcccattatctgccatttggaaaccagagacccaaaagctggtgatataagtcagtgtgtctctgaagccctaagaaccagggagctgatggtataaatgccagtacaaaggcagaaaaagatgaggtgacatgtctcagctcaagtactgcggcaggaaaagaagcaaatatcttcttcctcaaccctttctcctactcagatcctttatggattagatgatgtccagcaacttgggggagggcaagctttggagaggtagccattactgagtccagctattcaggtgctaatctttttcagaaacacccttacaaatacaaccagaaacacccttacaaatacaaccagaaatacccttacaaataccaccagaaataatgtttaatccgggcaatctatgaccagtcaaattagcatgtaaaattaaccatcatgtatacattataaattagggcaggttatgccattgtacagaattcacatcaagatttgttggactttgaagaaaggaatagtgtgaaagtgcctggcttgagattgatatagacatgtatacacattcattcatatatctatacatataggtatatatacatataataatatgtataaatatattatagatacacacatgaacattatccaagataatctgtacaaatatcataaaaaggagatttttttttttttttctgagacggaattttgctgttgttgcccaggctggagtgcaatgggacgatctcggctcactgcaatggcacaatctctgctcactgcaacctctgcctcctgggttcaagcaattctcctgcctcagcctcccgagtagctgggattacaggcacgtgccaccatgcccggctaattttttttgtatttttggtagagatggggcttcgccatgttggccaggctgatctcgaactcctgacctcaggtgatctgcctgtcttggcctcccaaagtgctgggattacaggcgtgagctaccgtgcctggccaaagagaaatttatataaaggggttgaaggagtcaataagctgttagagttttcctgatggtcccaaagctattgagtagaagaggcaggattaataccaggcctgtgttactaagcacctatgctcactcctctgtaccacactgccatggagaaggccgcagccaatttcccaggagatggggacagaagggagagcccaggaaatgctgatctgcaggagttttaagaaaaactttaggtgccatcaaatgtaaattgataatctgaatacatatagccataaatgaggaagaaggacatggaagcactttatgacaagtaggctattgcagatgacatgacgaaaatgttccctcctcttggtgtagaggatgaactttataattgaatggttacaaacttgcattctgaaaacaggtggaattttacataatgatgacatagccacctagtggcccttataagacctacctggcagtgatattatgagaattaaataatagtatatttgtaataacttctgctatttcatggaacatatgcactgacacaagagtggtatatgttattttttttcttggattcttttctctgacttgagaaaaataattttaagaatgcatactaatttagttttgaaataattaactgttttaagaaatagaataatctgagtaaagaatcaaagtccttaacatttttcaattgaattattaataaagattatattaatgtacagtattttacccatgcaggtaaaagttgcattagctttctttgctgcattaaaataggctattgcaaatttagtagcaagataaatgtaagataacatttgttatgttacagtatctgtggatcagaagtctggacccagcttagatgggttttctccttcacgatctctccataatgaactcacagtgccagctgggatgagttttcatgtggaggtcagagtagggaaggacctatttccaagctaacttaggttattagtagaattcagttccttgctcgtgtaggacctaggccctctgatcctgaagactgcctgaagtttcttgctacatgaacctctcaataggtagttcatactatggttgttgcctcttcaaggccaacaggagaagaagactattttagtgagaaggccttacataatataagacaaccatggtagtaacatcccatcacttttgccacataatgttgcttataaggaattcagaaattctgcctactctaaaaaggaagaaattttataaaggcatgagtataaagaggtggaaattagtgggtgtctgttcgttacagaggggtttggagaaagctagtgaaacagttctctagccactgcttagggccctctgtcaatgggaatgggcagtgggcttctgcaagccacataactctactcaggtctctggccctgataaacaccctgtagtgcagcaagttgttgcaatttcataggaaagaaaagaggtgtagagctcctcgagatcactttgcccagcagccctaaagagaccttagagacttacgtaaatgccctccagaggtaatcttgctatagttagtaagcaagactagcacagtatagggtgacttattacagacctcattctttagagcgccctgacagcggctgctgccttgataacagcacacaagcagcagcagcaaccacatccttctgggcagtgccagaaagcctgtgggaagcctaagctgagctcaaatcagccatccctgcacggttcccagaagttctggccataaaacagccatctacctgggccactgctccactcagctctccaatctcttcctgcaccccagaaaacatgtctaaatctttatagacagcctctgtgactcatctagggtgcttttcccctgcctctctcagtgggtctgggggtgagttagagggccttgttttgcccagatttctcagcttgcagaaataaacaaaactgatggtagtttgcatttctgtgggatcggtggtgatatcccttttatcattttttattgcgtctatttgattcttctgtctttttttctttactagtcttgctaacggtctatcaattttgttgatcctttcaaaaaaccagctcctggattcattaattttttgaagggtttttttggtctctatttccttcagttctgctctgattttagttatttcttgccttctgctagcttttgaatgtgtttgctcttgcttttctagtgcttttaattgtgatgttagggtgtcaattttggatctttcctgctttctcttgtgggcatttagtgctataaatttccctctacacactgccttgaatgtgtcccagagattctggtatgttgtgtctttgttctcgttggtttcaaaaaacatctttatttctgtcttcatttcgttatgtacccagtagtctaccatcagagaatactacaaacacctctatggaaataaactagaaaatctagaagaaatggataaattcctcgacacatacaccctcccaagactaaaccaggaagaagttgaatctctgaatagaccaataacaggagctgaaattgtggcaataatcaatagcttaccaaccaaaaagagtccaggaccagaaggattcacagctgaattctaccagaggtacaaggaggaactggtaccattccttctgaaactattccaatcaatagaaaaagagggaaacctccctaactcattttatgaggccagcatcatgctgataccaaagccgggcagagacacaaccaaaaaagagaattttagaccaatatccttgatgaacattgatgtaaatatcctcaataaaatactggcaaaccgaatccagcagcacatcaaaaagcttatacaccatgactgagtgggcttcatccctgggatgcaaggctggttcaatatatgcaaatcagtaaatgtaatccagcatataaacagaaccaaagacaaaaaccacatgattatctcaatagatgcagaaaaggcctttgacaaaattcaacaaccttcatgctaaaaactctcaataaattaggtattgatgggtcgtatctcaaaataataagagctatgtatgacaaacccacagccaatatcatactgaatgggtaaaaactggaagcattccctttgaaaactggcacaagacagggatgccctctctcaccactcctattcaacatattgttggaagttctggtcagggcaattaggcaggaaaaggaaataaagggtattcaattaggaaaagaggaagtcaaattgtccctgtttgcagatgacatgattgtatatctagaaaaccccactgtctcagcccaaaatctccttaagctgataagcaacttcagtaaagtctcaggatacaaaatcaatgtacaaaaatcacaagcattcttatacaccaacgacagacaaacagagagccaaatcatgagtgaactcccattcacaattgcttcaaagagaataaaatacttaggaatccaacttacaagggacatgaaggacctcttcaaggagaactacaaaacactgcccaatgaaataaaagaggacacaaacaaatggaagaacattccatgctcatgggtaggaagaatcaatattgtgacaatggccatactgcccaaagtaatttatagattcaatgccatccccatcaagctaccaatgactttcttcacagaattggaaaaaactactttaaagttcatatggaaccaaaaaagagcccacatcgccaagtctcaatcctaagccaaaagaacaaagctggaagcatcacgctacctgatttcaaactatactacaaggctacagtaaccaaaacagcatggtactggtaccaaaacagagatatagaccaatggaacagaacagagccctcagaaataacgccacatatctgcaactatctgatctttgacaaacctgagaaaaacaagcaatggggaaaggattccctatttaataaatggtgctgggaaaactggctagacagatgtagaaagctgaaactggatcccttccttacaccttatacaaaaatcaattcaagatggattaaagacttaaacgttagacctaaaaccataaaaaccctagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccattaaaaagtgggcgaaggacatgaacaggcacttctcaaaagaagacatttatgcagccaaaaaacacatgaaaaaattgctcaccatcactggccatcagagaaatgcaaatcaaaaccacaatgagataccatctcacaccagtgagaatggcaatcattaaaaagtcaggaaacaacaggtgctggagaggatgtggagaaacaggaacacttttacactgttggtaaacagtactgaaacagtagtttacagtactgtttacagtagtaaacagtactgaaacagtagtttacggtactgaactgtaaactagttcaaccattgtggaagtcagtgtggcgattcctcagggatctagaactagaaataccatttgacccagccatcccattactgggtatatacccaaatgactataaatcatgctgctataaagacacatgcacacatatgtttattgcggcactattcacaacagcaaagacttggaaccaagccaaatgtccaacaatgatagactggattaagcaaatgtggcacatctacaccatggaatactatgcagccataaaaaatgatgagttcatgtcctttgtagggacatggatgaaattggaaatcatcattctcagtaaactatcgcaaggacaaaaaaccaaacaccgcatattctcactcataggtgggaattgaacaacgaaaacacatggacacaggaaggggaacatcacactctggggactgttgtggggtggggggaggggggagggatagcattaggtgatatacctaatgctaaatgacgagttagtgggtgcagcacaccagcatggcacatgtatacatatgtaactaacctgcacattgtgcacatgtaccctaaaatttaaagtataataataataaaaaaaaataaaaattggattgttttctttttacagaaaaaaaaaagaatgccaaaactgctagtccccaatctagttatcagattcaactttgttttaaaaataaattttattgtgtatatttaaggtatacaacacgatgttataacatatctatatctgtagtatatatatgttccactgtagtggaacaaattaacatattcatcatctcacatagttatccatttttcctcatgtagcgaaagcagctacaatctactcattcaacaaaaatcctgatacaatatactgttattaactatagtgcccatgttgtacattaggtgttttgacttgttcattctgcatgtttgctattttgtatcttttgactaatatctctatttcctctctgtgaccccgaccctggtaatcgttttattctctatatgtttgaccccccgtttttccaaatttcacatgtaagtgaggtcatgtggtatttgtctctctgtgatgggcttatttaattcagtatcatctcctccgggtccatttatgttacgtcaaatggcaggatatcctccttttttaagcctgaacaatattcgcattctacatatactccacagtttgcttatttatccatccatccattgattcagttttatcttcaccctctctctcttcaaactcctccaagattggcaaagtctggaacatttcctgaattcctaagactaattatcctcatctcttgggagctcaggcaacctccagggtcagttttacacataataatagttgtgccttgtcttttgggaggtggaaggttggggttggcagaagtaagcaaagagctaatgctgggcaccctgagggcctttacttaggttacttaaaagaccacaccgtggattctgggtgcccagaagtgaagtatggagagatgcaaggccacgggtgtgctctccaagagtcatatgggtgtttaagatatacctacatacctatgtacacactcacacatacacattctcagaatgtgtctgggaccagctgcctatcctctcactgcctctctttcaggtaagtgttcttgatgagggtgggctttatgttcatattctggtgagcctcagctgtccagcaccccattgcccacttcattcttcatcatcattgcaccattctcatcaataaggttcccactccctcatatcctgtatctgctgaaaatgtgtattctttaatttttggatgcataattctactataagcttttaagtcatcttaattaaaaaaaaatctgttgtgttgaatacatttcatcttttggtttccgaaaggagtatattgcattttgtcagctcctctttgtatgccatgcatttttgctgtacatacttcaagttctgttctttaagttgatacatgtttatttcttaatatattaaaatttatttaatattttattaataatgaatcattttgtccttaataaaaacatttagcataaaatatatcctcttggatatgaatgaagttatacttcattattgctactgtactattacaactataccctatgatacatagcgtcatgatttcagaatcatttgtgtgtataacatttcgatctttgttttccatgttgaagctctttttttaaattgaagctcatgtagcctctttgttgttctccacaagtacttcggcagggtgccaccatgactgcttgcaatgcctcacagggccacccttctttcttcattctccaaggaattcctggcatggaggacaaacacagatggatatctatccccttctcctccatgtatttcgttatggtgcttgggaactgcaccatcctcctcaccatctccacagagcgctccctgcacaaacccatgttcctgctcctctgtctgttggccctcacagacctgggcatgtctacaaccaccattcccaaggtgctgtgcattttctggtttggccagagtgagatcagctatgaaggatgcctggttcagctgttcttcatccactccatctctgccatgcagtcagctgtcctgatgaccatggcctttgaccactatgtggccatctgcaagcccttgcgctatgccaccatcctttccaatagttgcactggactcattggcttagtgagtttggtgagagctatcctctttattctccccatgcccatcctccttcagcaaatgccctatcatgccaatcgtgtcatccccaccacctcctgtgagcacatggctgtggtgaagatggtttgtgtagatactacagtcaacaggatatatggcctggtggtggccttgttggttgctggctggatctctcagctattgcttcatcttatgtgctaatcatccaggctataatgcatctctcttctaaggaagcccaccacaaagcagtcaacacctgcaccacacacatctgtgtcatgcttatttcttatactccctcacttttctcttttctcgctcaccgctttggccaaggcattccaccccatgtccacatcattcttggcaacctttacttccttgtacctccaatgctcagtcctataatttatggagtgaaaactaaggagttctgggacaaagtgaccaaatagggttgctggaaagaagaacccacaaccactgaccatggtcagaaacttgtctggtaatccagcagctgtgagtatgaggaaggaatgttaagtagatgcaattcctgggggaatcagctagtggtagaaatatgttatgttggcagatttagctgccaagatgtttatccttggtcagagaagctaagggacaggagaccttcttgatctcagtaattccaaagcaaggaaattatccccactgtgaaatgaaaataatgacatctgctttctatacttgacagaggggttggacaaattacatgttataatgtctgtaaaagcattttgaacaacacatgctgaacacacataagatgaggtagaatgtttccatatggagagaacacatgggcacccaatgacttgcccagcatcaaatcaatgagttgtagaatgctacttactttgccaagataaggctaagctgtgtgtgtaggtgtgtgtgtgtgtatttgtgtgttcaaggggaaggtaaaatggagaagattgcttaggaggagtcaaaaaggacaatgaatgttcaagattgaatttagtcactatgttatccttactgcagaagacttacacttgagcaacagaactggttccttccttataagcctagggaatatgtacagaaaacataatctgaaattcccagagaaatttcaaaggaaaaggagaaaatgggaaactcttactcttagaaggtggatatgcattctaacaaattttatatttataaaaattcctagagtcaactgttctgcttgtctcaactaattccagcatatgacaagaatctctagcaaagagaaaattctgagaatgttctgtgaagggtcatagttataaaagtcagtgttatattggaagtcttggttacagaattctgccaggccatttctctggaaatcaaggaagaaatcatgaacaagcacttggagtggtgtgtagagttcagatcgtgtgccaagatatgtgaatacattaagttcaggagatattgtttatcacttccagacattgatttggaatatagtggcaaatattttaagactcatgaagtttgtagcctgaaatattttaggatttttcatcatattgtatagctaatatgtaaaggcagaattcagtgaaaaagacacctactttaaaagccacatgaccactatttaaatgagactcttaaaatgtcaggaaaataaatgcaacttttccagagtgttgttctagttatactaataattaaggcttgaagtaaacaaaaaatttaataacataggctcagaaaggtgggatatttcagagcttgaaacaaacagtccaaccttcaggagaaaaaaaaaagagagagaactaaccaggaagtgccttttctataaatggaagaccagagatcaaggaaaatttgcaggagcattaatggctgaagaacagagtactgcttgtctgaaataagtactaagcacatatttaagccactacaaacctacaaagaaaaaaaagtcgtcagcaaaatgttgtgcttaacaattttttatttttatttttatttttttttattttattattattatactttaagttttagggtacatgtgcacaatgtgcaggttagttacatatgtatacatgtgccatgttggtgtgctgcacccatcaactcgtcatttagcattaggtatatctcctaatgctatccctccccccttccccccaccccacaacagtccccagagtgtgatgttccccttcctgtgtccatgtgttctcattgttcaattcccacctatgagtgagaacatgcggtgtttggttttttgtccttgcaatagtttaccgagaaagatgatttccagcttcatccatgtccctacaaagggcatgaactcatcattttatactcataaaaaattccataattttttataatttttgcttatctctttattttgaacttgtatctatcaatcttgttgaaatctttatagactaacaaattctctgtagattctcttatactttctatgcaaattgtaataccattcatgcttcctattttttaattatcttttcttcttattgcatggctgtgacctttggtacaatactcaatatggaaggagcagggggattgcgtactcctttttattcttgctttagaagcatttagaaatgcttctaacatttttaccatttattacacatttctaattttttagttcagcaatatctcatactacttgtgtctcgtattttcttaaaaagtaatatagtcagtctaagattacatacagattttcactgggcttctgtagtaacatcatattatacttccatttttgcagtgtctgatttgtgtcttatttccatttctagtgcttattgctaacaccccaaattccttgcagaatacaataatgacatagtaaaataaatggagaaaacacattggtttctttattagtcaagattcaatcacaaacacaaaaccattaggagagatatatacatacacatacacattcaagggattggcttacataactgtggaggctggctaggcaagtccaaagttcacagagtggacagtcagagaaagtaaaaatcacgagcatgctggaatctgcccaggcatgggatgaagctggtttctagaggtatgagtctttctttttccaaggaagccctaagccccttttaaggtcttttaaccgattaagtcaggcccaccccagataattcacctaacttaaagccaactgattagggtattctggtatatctccgcaacaactttgcagcaacacctgtattcgtgtttgaataactgagagtggtgtgtgtgcaatgcaatggctgttatttcccttccatcttaagtctcacaagagattatttccagtagtccacttatctgaaaagataatagaaagtgaattccagggaatatagttttgcctgtgcaagttgacactccacagggctattacattctccatagaatgcattattcacaaattttcccagaagttgctgagaggtagacttgttttgtgggatgaacaaaaaaattcccagtgggttgaaggcttttggaggcatctttagctctagaaaggtaaaatttttcaggtcaagattctaggaaaggaaagttgctgcaagcctattctgctctagatttttaacatgacttattaaggatatttgtggtagccaaattgtccagtagaactcatgaagagtgcagaccagatagcagtttggggagaaaaactcaatcaaaaaacttaaaaaaaattttttttgggggtggtgtttctttaaagtatgatctcttgaccaacagcattccctttaattggaaatttgttagtaaaggaaattttgaggtcgtgctccaaactcactgaattagaaactctggggatgtggactagcaatctgcttaacaggagcggtaagtagtttagaagtacaagaacattttcaaaccactggcttagagagcctctcaggagctaagatagagtatgatcaccagaattcagatccagtccaggtgtgggcactgttcatggtaaggatagatctctttagatagggtgtggctgaaggagaaaataaccaggggagcttttggaaagagaataaggagaccgacttaagtaaagatgataaggagtccaactgccataaactgtggaaaaagactacagttctacattgacaattctccaaactctccctgcataatgtggaatccagatcatggcaggagctacttttctgagaggtttaagacactcattcataacttgaagaaggtcagggatgcatggtggagtaaattacagtagtggtagggctataccaaataaatatttgagtattagagtattggtaccaagagtaagttagtccatagaaaaattaggttttaggtttaatgcaaatgagctctttgacaatatagtttactgaaataagtacagtggacaggttttcagcaaaggccaccaggagatataggtttggtaatgcttaatgcatgtcttctctggtgtgctcagttcgtaagataattactttatatggtgaaaaattgtctttaataagtcacatctcctagatatcatgtatgggtacaatttcctattgagtttcattaccatcttgctacatcattcacaggcaatataaaaaaatcagcagagcattttacaaagccagtcagcaagtctgggaacatgtgtagtaaattctctacagtattagagtcttaggaaaaagtaaacatagcagaatgcgccagagataatcacagaaaagagtggaggggaaagaaagcatgtcctggaatcctttgggtggtagaactgccttcaagtaaccacagtatttgtatcctcaatgactctaaaatgttagctgcccttatggaaatggtgccagtactgatatgtggggagttaaaaccaaaccaaaacaacaggaaaagaactccaagggaacagactacaaatatgtcttccctgaatctttaacaaaagcctctggcttcaccttcacattctgatctggactgcattcagaagagtagggcgtgaatgcccaatttcctagggaacacagaggctccctaggcagctctagccttaaactcagtgcaagccagtacactcccagggggctgtgaaatgtatttcagatagttgagggtgagcagagacttgtaatgttcttgcaatcttctgaggatgcttctacactgtggtgccttctcttttctgctctcctggaatcctgtgagtttggctaggaaaagactctggaaaaggcatttcttagccctcaagagaagtttttctgtgcaaactggttatggaaagtttgcttgaaagcatggagaataagatttaaaataaagatttaaagatttgcttgaaagcatggagaatatccaggaaaggaaatttccccgagtaacacctctgtagagtctaatttggaattttagttagcaggcatcctgaaacagaaattatagtttggcgttaagctgagtagttggaaaggggaacacagtggggaactacctggaaaggaagaagcaagtgatatgttaaccagatgaaagacatgcgaggcattgtgaagaaagtttatggcattcactataatattcctgaaattactaacaagcagtaatttctcatgaagcatggaagggggaatttgtgtgcctagtgagatggacagacgctataaagatgaacagcatgaaactaggcagagggaatcagcagaaccttagatttccttgagctttttttgcccctagtattctgacatcaggcacattagtcatcactgtccaggtaaagtcaaagtactcttgtaaaatcgcttcttgccactgtggaatggtaacattgagaaggatttgactatgccctttcttagaaattaccaggtacagcagatggaatgtgaataaaggattgaccaagatgtgggctgaaaaagcttggaattttcagtttcataaatagaatgaagtccaaaagggttaccttcaacattttggggaaaggatagctgaagcatcttatgaaatttcagatgaagattgagcggatatatgtgaaaatatatctatagcttagtaaaaagagtggaaacgactagagtaatattaagttcaaaaataattactaagtacagggtcccaaattagaatctattccaacttaaaggacaagaaaaaaaaagtccaagattacccagtgaactatgtttgtagtttgtgtcaccaaactgatagtcatgcctaatttcttcttatactccataaaagacagtgtgtatgtatgtgtgtgtgtttctttgtgtgtatgtatgtattcaggtatatgtgtatagccttagctaggagacaattctagtttatctaaaggcttatttgagccttttctcacgttcatttattttatttaataagcattatatatcaggtattattcaaagctctttagaaatctttagacatattaacccatataattctcttctctatagggaatagatatgattattattgctattttatggatgatgaagctttctaaacatgatatagccagtaagtgttactattctctcattcctatctctgttctatcttgttcctccagataatgtgatactatgtggaggtttctgaccacagagaatgtccagcactcttggccacaacatggaatctcctcatcacactgatgttgacccttcttgtcttcttcctcctgggcatcccaggtctggaacaatttcatttgtggctctcactccctgtgtgtggcttaggcacagccacaattgtgggcaatataactattctggttgttgttgccactgaaccagtcttgcacaagcctgtgtacctttttctgtgcatgctctcaaccatcgacttggctgcctctgtctccacagttcccaagctactggctatcttctggtgtggagccggacatatatctgcctctgcctgcctggcacagatgttcttcattcatgccttctgcatgatggagtccactgtgctactggccatggcctttgatcgctacgtggccatctgccacccactccgctatgccacaatcctcactgacaccatcattgcccacataggggtggcagctgtagtgcgaggctccctgctcatgctcccatgtcccttctttattgggcgtttgaacttctgccaaagccatgtgatcctacacacgtactgtacatggctgtggtgaagctggcctgtggagacaccaggcctaaccgtgtgtatgggctgacagctgcactgttggtcactggggttgacttgttttgcattggtctctcctatgccctaattgcacaagctgtccttcgcctctcatcccatgaagctcggtccaaggccctagggacctgtggttcccatgtctgtgtcatcctcatctcttatacaccagccctcttctccttttttacacaccgctttggccatcacgttccagtccatattcacattcttttggccaatgtttatctgcttttgccacctgctcttaatcctgtggtatatggagttaagaccaaacagatccgtaaaagagttgtcagggtgtttcaaagtgggcaggaaatgggcatcaaggcatctgagtgaccctggagtatagagggacttaatccaaaataaaaaaaaaaccttttcaagataatcctcagtatgtgagaccagaaagagcttttaagagggggataatgtcttctgcagaactttctagaccatttccaagaatgataaatcacagagaagggcattctttctttcctttcagagaagtgtaaacatgggaagattcttgcaacctgggtaacgtgcagatattgaaaacaacccactgtgttctggagggtttctaccctgctgcagtttagaagagtccctgcatagccataagatctcttctcatttcctggcacccttccaatattccaggcatggatttctaatttcataccttaggatataccagctatcttaccagctgcaagaatcagaagataggacaatatagccacagttaaagtagttaaagccgcaaaaaatttatcatgcttttccataaaccctgtatttctccattagagcttcaaaccaagaggagaaaaagatccaccagcatccacaatgttacttagtggcagaacaaagctgtgaaaactagaatcctttaggacttctatgaatgagggcacaagagaggttaggaataactcttcatttctagacattttctatttatctcacaggtacactcctgtctccagcctctcaggaactaacctaagtctgaatgaccttggatatcatccctcacaagcagtttccaattattcttgtacatacatacaatgggaggacctttcagaagtcattgacttatctcctgaacctataagaaatggccacttacccaaaccactcagaatgggaattcttaattatgaaattagtctgtatttattaattcttctatttatttataatgaaaagaagattaagcttgattctagtaactccatgtggtgatggaaagttcctaactatatccatgaaactaagattggaaaccagttactgtacatactgagctttctgtccactcctcaccaaatagcttcagacaatttatcaaacacattctcttaacaaattagcattttcaattttgagttcgccaatagtacacattttttgcttgtcatccgcttatatgccatcctaccctgttaggtggagggaacacaaaactcccttgtggaagttcacagacactcctgtcctgggaaagtatcagtcctgaggtagaaagccaatgcccagctcttcaaagctctgtctctgtcaggaatataagtgttttattgggacacttcaaatatgttgggataaacagtgcacaaatagtgaaactcagtgaagtaggctgagcactgtccatttttcagagaaaaaataatcactttttatagggagagtactagtatatgggctgtcactggttttaatttttttattctaaccctcaattttttttattatactttaagttctagggtacatgtgcacaacgtgcaggtttgttacatatgtatacatgagccatgttggtgtgctgcacccattaactcgtcctttacattaggtatatctcctaatgccatccctcccctcacccccaccccacaacagaccccggtgtgtgatgttccccttcctgtgtccatgtatctaatccttaaattgagatttttttttttttttttttttttgaggcagagtctcgctctgtcacccaggctggagtgcagtggcatgatctcagctcactaccagctccgcctcccaggctcacaccattctcctgcctcagcctcccgagtagctaggactacaggcacccgccaacacacccggctaattttttgtattttttagtagagacggggtttcaccgtgttagccaggatggtctcgatctcctgaccttgtgatccgcctgcctcagcctcccaaagtgctgggattacaggcgtgagccaccgtgcccggccgagatattcttaatagatttttaagatttatatacaattctaacactacagttcatcaacaaaattacttttgtgttctccaaattgaccatttttctagcacagaaacctacaaccccaactgtgtaacaatcttatactgtatcatgggtttctatactttgtagaacgtttctaaagtgtattgtaagcaatatacttataagcactgcttgttcataacttctcactttaatgtgaatctcaatgctagatgtctatgtgttcaccttttatgatttacaataataagtttatatcatgatcaaccccttatacacctccggccactcatgtttgtaatattacattgatttcaattccataaaaaatgaaatgacaaggaataaactgtctccaattataatcctcatataaacttttgatgtgtatagccattatttcctcctttcttgctatatttatttattgccaatttctttttcctctcaagaaagcctcttataatatgcctttgggatcccagactatcagttacttcttggatgtctcctgtttataacccatttgaatttactggcacatttgccccatagaaaaatttctcataaccttagtgattttttttaaatgaaagttcatgaaaaatatttttggaactaattattgctgcattcttatgtcctattcttttcttatattacaatctaacttcaaccagaagttgatgtttccagagaaatacctgtcatcaaagccagcagtaaccattttttttttttttttttttgagatggagtctcactctggtgcccaggatggagtgcagtggcacaatctcagctcactaccagctctgcctcccgggttcatgccattctcctgcctcagcctcctgagtagctgggactacaggtgcccgccaccatgcctggctaattttttgtattttttgtagagatggggtttcactgtgttagccaggatggtctcgatcttctgacctcgtgatccgcccgcctcagcctcccaaagtgctgggattacaggcgtgagccaccacgcccggccagcagtaaccatttttaacagaactaccttaaattgtgttatattatgacttacttctccaaaatctatccactgtgatttctatgatcccacacaatcccagcttttctttcatgtctctaatgtttttcatcctcttccccttattttatttttaatgaacctgacttttaaatgttggtgtttctcagagatccatctttggctaacttctcactcattccaatctaagtccatagcaatggggaccatgaaaggaagagctgaaaatccagaacagtgtcaaggcagagggcttcctgcaggagacagcaactagatgtctatgcagaaaacactgtgctcttcattgcattaggaaacttctcttgcctttttgtttctttcaattatgaccgatggtgtgcttaactaattccttcccactgtcattatttcttgcttctgatgatatcatcttgaactcaccttgactataagcagacttcaaattatattagtatttggaatctgttccttgtaagagtaagcaatgtaggatggtcaaaaggtacagcctcatcccttccattcgtgtatactgttcagttaatagagaatttagtcatagtgtctaatttgaagagcaatgaaaactaaaaactttcaggaagaatcattttctaagtgagcactggactaatggactcacatatttggcagattatgaaaaggacattgaggaattactgctctattacttcatattctgcagtctaagcgctctaagttgctgagggtcggataagttcctacatcttatccacttctcattcattgtaaatgagcttctttaagcattttgtatgttcaagaagtttactggaagaaagcagagaaaccagcaggggaggcaagaattgtgataatatcgaattattatttgatgtaatacagtaaagggttttctggcacctccagaattgttgtgtacgtctcagaattgtaagccttttctctacattaaaaataagtttctcattaatctgcagcttccttcctgttcttggtccaaacatttccctaaaacattaccaaatggtagctcttaatttcctctaactaaacataacaaatgtattatatcacacctacctacataggcaaacatttaaccacattttctaaggttaattgacaggtaccattcttccaatttgaggtaggtccctgccatgtgagccatggaaagtggctctcatcacccctccttttttcagcaaccatatgctcttatttatccaattctctctgacttatcaacaatctatttttctctctaccaaatagttcataccaacctccaaagatgcattatttttcccgattttaaaacaagaaatgctttttaaaatttaatttttatttttgatgtatattttcatttttaattgactaatatatataagggatgcaatgtgatattgtgatatatgtatactttgtggaatgattatatcagtctaattaacataactatcacctcataaagttattttttttgcagtaagaacattttacatttattctttcgcaattttgaaacataccatatattactattgactgtggtcaccacgttgtacaatagttcttgaaaatttactcttcctgtctaactgaacctttatacactttggtcaacatctccgcatcccccagttccccaccttttatccttttcagcatctggtaaccaccattctactttctactacaaattactctaaaccccaacttccaactctaaacttccaacttctgccctacattttcttgtttgtacaaacttctttaaaatgttatgtgcataaatttttctatttcctagcctttaacttactctttagcccactccaatatgactttttcttatgcactccaaaaatagacagttcttttcaaaaagtcatttgtaacctccaagagactgaatccatcaatattactttaaactatgtttcattagatctgtcagtacagtaaaattatgaatcaatttctttgccttcttctttaaaaatcaatctgtcttttcctatataggttattttcggtctctttttctttctcaacatttacctagacatcatgatgagtttctagaaactacatgctagaccaccttctttctgtcactatcctcacttgctaaaacatctatttgtgctaatagcattaattcaaatattccagtaatttccaaataaaatactagtcactccagtttttctcaaattgttcctttgctctctggaactactttttcctctctttgctaaataataatctcttggatgcttcaaaggtaggcacctcatattggtcatgacctcatttgaactcattctcttcccttataatctggttcttctccagtcatccttaggtacatgaatgacatattccattccagtgcatgtatgagaaacttagagttattttggggtcataaatattataaaatttacatccagtataacttctatatccatccatttctctatatcttcatagcttaaaataaagctgtctcacccttgaagtactgttgtcagtgctcatccaacttacttatatttattcttgccatgtacaatctggtcttcacattgctgccatgcctaaattatcctaaaccttttcagtggctccatattgctttagcataaatttgcttaaaattatctgaccactatgacctcaacagcaccatctcacatcacctcccatgttccaccacaccttgaggtttccagacacattgttgtcaccttgaggttaccttgttgttacactgagattaccagacacattgttgtaacactctgttgttaccttgactatgccttgatccctctcattttaacattcaaagattcctggataaaaagtcttttttatccccaccccaacacacacaccatagttatcttctactcaaacaattgccctcagaacaaacattttttcaggatatcctctctgacaacaagagattatttttttcttcatgtgaactcttatcacttggtacttttgctttaaagcactaatcccagtctattattatatatttgcttgattttgttgttattattctctccccccacctcaactagaccacaatttcaatgagaacaggaacgatgactgttctattgatcactttatgcctaacatgtttttcaaacacagacagaactaaatatgtatttttgaatgaaagctttctcctttaaaaatgtttaaataaatctcctagccacagaatttagaacacccagagtttgtgtgcttaaaaaccattcaaacactctaaaatttctcacctttataggtccattttgatttaataaatgaagatattcttctattcatgtaaattcttaggttacattaataggatacatgtttttgagttaatctgctttctattctagtgggatttaacatcctaggaattcagctttctctataggtctttcatcatgtctgcaaatgagatctattatgcttaggtcactgagctgctttactactctccataaatttcagaagtttataatttctgtgccacatcttagctgacaacacatttttatcttgtgttaaagcatctttctcataaagttctgtctttgcccagtagaaaacttctgccacgcctaggatcccagactgtgagtctgtgttcataagcaaggtaagtgataaaatcttctcatggtcactttggctaaattccagagagttcaatggcttatcctaaacattatgttgttttgtcaacattctgcaaaaagattgacatttctctctgttttagtagcatatagaggattagagggcctttccaaaaaaggttgaagtcagaattagaaaatattaaggctcacatggtgcactagaagttaccttgtctgtaatcaaaaaacaacactgccagattatcttcagggttaatatattaactgttttatatagcagaatcgtattctatgtcatgctagaatataattgtaaaaaaaattaaaaacaattctttttctgtgagctcaaacatactacttctcttaattgtatcacacatatacaaatcagaaaaaaattttaatagagaaaacatcaaagataaaatgttatgtgatattaggatgtaaagtaataaatgagtattaagtaaaaatgccaggccttgtacatcaaatgggttacatacttccacgcatccaggataaaactattgtgttgaaccccttcagaattctcctctaaaagctcaaagtcaaactagctttacctccattattgcttgtgctctttagtcattgaaattttctgtagatacatttagataattttactctttatcaaattacattcaccattaaagaaggatgatttactccatcatttgggagtatatgtttattcaaacatacaggcagtaagaaacctctgaaaggaaatacatttagtttttaataagaattgatacaacaaaagaattttattttcttccagatttttttggtatttaacaataattatatcaaaaatcaacccataactaatatattaaaaataacattttaacctttgaacatagctttccagtttttgtttcttgctcataaacctgcaatagcttccaccatggcaaaaatattggaaataaaatgccttgaaaaattactaattttagcatagagtaagtattatatgtatctgcagtgtaaaatacaaagaagttcaaagcaagagattatattcacttcggtttgagtcatatctgagagtgttttatgcaaaataaaggattgtaatagtaaataaataataaatggtaaataaataaaggattgtaataataaagtattgtatttgaaagaaaatgtgaaaccatgaattattttaagcaaaggaataccagtgtctgaaagatcagattgctagcagaaagaaagaattatggaaaatcagaaacatttgctccaggcaggttgcagaaagcatactgaaaaaaaagagtgcatatgaatgaagtaaagaaaagaaatcaacaatatgataagcaattatttgcagtaagggaaggttagttttctagattcaagcttgtctggtcgagccaccatgcagaataaaaagtaaatggataacaacaaagttgtagaaaagataatgagtctaattttaaccatgatttttgagcattgaatggcaattccttcaacattatggacaaataattcttgtttgttaaataagttaaaattactgttcaatggttagaaggttttagttgtacaagatgaataagttctagagaccagctgtacaacattgtgcctgtattcactaaaaaatgaatagagttgatctaatattgtgttgttatcacaggaatctttaaaagcttcttattagttttacctaaatcctgtatttatgtctttataggttctctaagattcaactataaaaaaacttactaaggtatgtcttcattatatgacttctcatatggagaaattcagccataatcactaacttccttttaagctactcttttgcaacctcctcagaagtgcatacaaaatagaacatgaaagaaaactatccccaaatcctcaatataatttatttctggaaacctttacaagtccatgatatcaaaattttgaaaggctatgtaagacgttaatggacatctatatcaacttgaaatgatgtagctataaatttcatctcccataattcttcatttaaaaaatctagttattattagttaataaacctctgcatcaagtcaagtaacactgagataaatatgaagaaaacaagcacatccatttaatctatataatttctaaagagatgaagaaaggcttagaaaaatactacaattttatttctgtggtggttccaacctgtgataactgagaacaatacaaatagagatttgaaattcatgttgaatcatgaatcatatgtctgcatctctcaaaatctccaatagctccaaattccaggtctctgagttcatcctgctgggattcccgggcattcacagctggcaacactggctatctctgcccctggcactactgtatctctcagcacttgctgcaaacaccctcatcctcatcatcatctggcagaacccttctttacagcagcccatgtatattttccttggcatcctctgtatggtagacatgggtctggccactactatcatccctaagatcctggccatcttctggtttgatgccaaggttattagcctccctgagtgctttgctcagatttatgccattcacttctttgtgggcatggagtctggtatcctactctgcatggcttttgatagatatgtggctatttgtcaccctcttcgctatccatcaattgtcaccagttccttaatcttaaaagctaccctgttcatggtgctgagaaatggcttatttgtcactccagtgcctgtgcttgcagcacagcgtgattattgctccaagaatgaaattgaacactgcctgtgctctaaccttggggtcacaagcctggcttgtgatgacaggaggccaaacagcatttgccagttggttctggcatggcttggaatggggagtgatctaagtcttattatactgtcatatattttgattctgtactctgtacttagactgaactcagctgaagctgcagccaaggccctgagcacttgtagttcacatctcaccctcatccttttcttttacactattgttgtagtgatttcagtgactcatctgacagagatgaaggctactttgattccagttctacttaatgtgttgcacaacatcatccccccttccctcaaccctacagtttatgcacttcagaccaaagaacttagggcagccttccaaaaggtgctgtttgcccttacaaaagaaataagatcttagagaccttctccatgatgtacatgaacctcagcttctcctaaactggatagtaaaatttcaaagaggataaatgagtaagtgaatacctttgggattccctttttatatttgtatgtaaataattgtgaaagcttcagaaaagatacaaaaaatcacagtagcctaaaatattgacaaaagctaaatatttaaatatatttgagaatatggaagaaatttctgccaaatcaaattggatttaaagaacttaatgattgatatctatctcttaaaataaaaatgaatataatcacacacccacaaatacacacacagacacacatacattcaatcagacaaatgagtgattgggacatgaatcacaggtcatgcttgcgcattgttagctgtaacttgggagctgtaacttgggagcaaagtcagtctgcctaaacaagcattactccagtaatatgaaatacagaggtcggaaaagaaaataattcagataaagccaaatcagtcaatgatgaggatttatgtggaatatgagatgactcagcttggacagacagaacccaaaagattcatctagctagaaggatctggtgcttacgccgtttgcctccccagatttgctgtctgccctttgtgcactgctctgtaaactggagggctgactttcacatattgtaagcccaaactcctttgtctttcggtgttcagttgaattgagccaatgtgatgcgtgacagattatagttcaagaggagacagcatttgggctatttattattctactcccagcctgctttgacatgagggttttcactggatatgtcccttctctggccacccacctgctacagctacagcttttatggaaatatagtaacaggcttgtcttgccttctttcttcaggccaaggggctgataaaggcttcctgatagtagtctctgagtgcccagcatccattattttttaatatccacttgttttcttaaacaacctactactcaataccaacttcattaaattgtcttcaaactcacatttctttgtgccttttttttttccctttctgagaccctgactgactcactggctttatttatatcaccagcatctatctctaccatagctactcatccactactactaccacacccacataagaatgtaggcagcttcagcaaaatcttcagatgatcagatataaagacactgcaggcaggaggtcgatatagaaatttttccctgtgaaatttttactttgagagttttcttttctttcttttttttttaaatagtcctaaacaatgaatgggcaaaataaggcttaatctattattgtcttgtatttcaatcttttccaggctactttccattaaacacatgctcagattaatgccattaaatagctaggacattccttgaaatatgagtattaattttgggtgcaggaataccagttgctagaaagtctgttatacattatataatgtcaactcctcttccagttagatttcaaaagtaaaccctatcagttttcaggtaaaatgaaaataatataatgtatctttcttattagtctggcctttcacacaaacttcaatttttttcatttaaaaattaatgaagagaaaagactccatgccctttgtattcataagactacttttttttttttactaacaatatagttgagaacattaagataatttaagaaaatttatgtttgacattttctataaagttacaagaagatagtgttcatattaaataagaatcatcagctgggcacagtggcttacacttgtaatcctagcactttgggaggccaaagtaggaggatcacttgaggccaggagtttgagaccagcctgggcaacatagtgagaacctatctctataaaaaatacaaataaataaaaataaaattaggcaggcatggtggctcatgctgatagtcccagatactcgggaggctgaggtgggaggactgcctgatcccaggaatttgaggctgcagtgagctgtgatcacaccattgcactccaacctaggtgaaagagtgagactctgactcaaaaaaaaaaaaaaaaaaaaccatgataagtgggcagttcaatgaaattaaatgagatgatatgttattccagcaggaataacttacatattacagcctagaaaaattaaaaaatttaaaaatgtgtgtgcacctttcacacgtcccttcaagggaacctgatataagtagcattgttgactgacatcctctggcttctacaccattagatgcatctgcaccttcacacaaagctcatgcttcccttggctgctcccagacagtgaccagacacagtaagaggacgagagctaggccattctggccagaaatgaaactcctttaatggtcaacttttgcatgaggactctgaactggcccggctaagactttctcagagctgcactgagggctgatacttttcttaggcaatctttccttctctttctcttttcttggttgtcagagctgcatcatggtttaaagattctcttaatcttttcctcccttcttatcctttacatttcacattttccccccaataaacctatctgatgactagtcctatctagttgtctgctttgtagaggactaaacccaacacagatcataataggagtgaaatcatacaatacgggacacatttaatcccctagtacaaggaattgactcaattgttgaaaattttaccaatcgtaatgtgacaaaacacccttgtggagggaaatgccctggctggttcaactctttaaggcatttgaaaggtatgtggaggggtggacaatggcaggaaagatagtggagtcgactgattactgctgtgctatatggaaaccacgtagagtaataatgacaaaatgaaggcagttaacaaatagtaaaaatgaagtgtgatagattgcaaagcttgtaaagatgctcttatctcctgaagtaaaaagggtaacaacagcgggggagtacacttgggcatgaaatttgagtctcagctgggtgcagtggctcatgcctctaatcttagtattctgggaggttgaggaagggaggtctcttgagcccaggattgagaccagcctgggcagtgagggaaaccccgtctctacaaaaaatacaaaaattagccaggtgtggtggcgcgtgcctatagttccagctactcaggaggctgaggtgggagaatcgcttgagcatgggaggtggagcttgcagtgagccaagatagtgccactgcactccagcctagtggagcgtacagtaagccaagatggaaccactgtactaaaagaaagaaataaaaggaaagaaaagaagaaaaagaaaattgcatctcagaactccatgactgtttaatgcttaacaagacagaactattataccaaggtgtgcactctggttgagaaaatctggggcaatgaaacatgggatgtggatatctgaaaggatgaccttgaagatgtattttgcaaactagctcactcctttatttataacatgagagctaacactctcatgcaggaagataataaagaagtttatgcaggaagataataaaggagtttatgcaggaagataataaagaagtttctctcatacaagactatggttactgccctctctacattgtcaggctggtaactaaggttaagttccagtatgattacagcatgaacaagctgcaagaatccaggggattgaaaattaagggagcttaatcaagaggataagatcttaagacataagaacatagagaataagcaataattttttgacttgggaaaattattgtggacactgtattgaacaccctggtcagaattcctggagatgggtcagactcactgtgacagtgactcttagaagcctggagaatgtgatggacgatgatgagtcaagtggtaatgcctgagttgccctggcagttgggcattgcattgcacttgggcaatgcaaagatgaagcagctggggatgctgaaatcgacatattatatgaggccaaaagagtcaccagaaaagtatgttctatggaacgccccagaaaacacaacattcaccaatgaatgcacaaatgagtgggggcaccagtattactaaaatgttcagctatggctctccttttcagagcaggtgtgaggataggagagacagtcaaagagctggattgtctagtagttgtgggggtgatagacctttgaagtaacagatagcaagttgaggcaaataactgccagaagccaggggacagcaattacttaaaaaccagcaagggtaaactagctgccaaagaggcttcacctgtagggagttatggaaatggtgtccttaagagcaaattaataggcagccaacaagggtgacgcctaacatctgcaatcacaagaaagcaggaatggaggagctgaaaaacaggtagatgatattttaaaaaataaagaatttctgaaaccaaaaattcactgaaggaattacaaaatacagttgaaagctttaaatgagaccaagcagaatagtacatttcagagactgaagtcgggtttttaaattaacctagaagaaagcaagcaaacaagaacgaaagagagagaaagaaagaaaagaaagagaggaagaaagaaaaacagaaaaaaggaaggaaggaaggaaaatttaaaaaatgaacaaagcctttgagaaacataggtttatgtaaaatgataaaacctctgaggtataggcattcctagggagaagagaaataaataaaaagtttggaaaacttatttgaggaaataattaggaaaatttctctagtcttgctagaggtgtagatatccagacacaagaaactcagagaacacctgaaaaatactttgcaagatgaacatcaccaaggcatataggcatcagactatctaaagccaatatgaaggaaaagatcctgaaagcagcaaaagaggcacatcaaaacacctataaaataaacctcgtcagagtaacaaagtactcctcaacagaaatcttacaagccagaagggactggggtcctatttttagtcttctttaacaaaagtactaccagctaaaaaactaccagctaaaaattttgtgttctgctaaattgagctttgtaaatgaaggagaaataagtctttcccagataagcaaacactaaggaaatgtgtcaccactctactggccctacaagaagttcacaaaggagttctaaacaagaaaataaaagggtgatacttgcgacaataaaaaaacaagtgaaagtaaaaaactcatagatcttctaaagcaaccacaaaaatggaactacaaagcaattaggtaacaatgaacatcatgacaagaacaaaatctcatgtattaatattaagcttgaacaggaatgtactaaatgctccacttaaaacatataaactgagaaaatggattaaaaacaatattcaaacatgtgctgcctattaaaatgcacccaatgagcacagacattcacaggctcaaagcaaaaaggtataaaaagatgtttcacacaaatggaaaacaatagcaagcaggagtagttagctatacttatataagccagactttatataaacaacagtgaaataagacaaagaaagacattgtgcaatgttaatcaattcaagaatacaatgtgacaattctgaacatatatgcatccaacatcagagcaaccagtttcacaaaacaaatactattggacctaagtaaagtggtagaaacaatacaataacaggaggggactacaatacaccagtgaccaccctagacagatcactgtggcaaaaaaatcaaccaaaaaaaccttctgaacttaaattgccctctagattaaatgctaaacagacatatacagaacattctgcccaagaaccacagaacatacatttctgtatatttctgttggcacatgaaacagtctcaaaaattgctcaaatgctaggccagtctctataaacttaaaaactgaaataatatcaagcatattcttacaccacagtggattaaactaaaaattaataccaaaaggaagtctcaaaaatatacaaatacttggaaatcaaacaacctgcttctgaataatctttggatacacaacaaaatcaaggcagaaattttttaaacattgaaacacatgaaatagagacacaatatactaaatcatttgggaaatggcaaaagctgttttaagtgggaagtctatagcattaaatgccgacattaaaaatatagaaagattttaatttaaaactctaacattgtacctcaaggaaccagacaaataagaacaactaaaacccaaagctaggataagaaaataaagaacaaatatcagagaagagataaatgaaattgagacagaaaaatacaaagataaagaaaatggaaagttggttctttgaaaagataaacaaaattgatagaccacagcaagattaatgaaggaaaaagaaaatttgaacaaacaaaatcagaaacaataaaagtgatatgacaaatgatgccacagaaatataaaagattattagagactataatgaacctctctgagggtacaaactagcaagcctaaaaaagacggataaattctggttaacatacaacctcctaagattcaatcaagaaaaagtagaaatactgaccagaccaataacaagtagtgcaactgaatcttctaacaaaaaatgcctaggaccagaggcattcacaatcaaattctaccagacatataaagaagatttagtcataatcatactgacactgtttcaaaaaattgaagaggagggaatcctccctaactggttctatgatgcttgtttcaccctgattccaaagccgggtaaggacgcaacaaaaaagaaaattacaggccaatcttcctgatgagaattgatacaaaaatcttcagcgaaatactacaagacaatccaacaggacattaaaaagataatgcaccacaatcaagtgggtcatattccagtggtgcaaaggtagttcaacaaatgcaaaagtggttcaacaaatgcatgcccatatgcccctgaggcctaacatatgggcataacacaattaaaaacaaaaggctgggtgtggtggctcacgcctgtaatcccagcactctgggaggctgaggcgggtgaattacctgaggtcaggagttcgagaccagcctggccaccatggcgaaaccctgtctctactaaaaatacaaaaattagctgggcatggtggcgcatgcctgtaatcccagctactaggggagctgagagaggaggattggaggatctcttgaacctgggaggcagaagttgcagtgagccaagattgtgccactgcactccagcctgcacaacagagtgagactccatctcaaaaacaaacaaacaaacaaaaaacatataatcattttaatacatgtggaaaaagcttttgacaaaactcatcatctcttcatgataaaaactgttaacaaactaggcactgagggaacatacttaaaaaatagtaaaagccatatacatcaaaccaacagtcaacatcatattgaatgggcaaaagttgaaatcatttctcccagcaactggaacaagccaaagatgcccatgttcaccactcctattcaacatgatattggaagctctctctagagcaatcaaggaaaagaaataaataaaaggcatccaaatttaacaagagaaagtcaaactatctctatttgctgatgatatgatcttatatgtagaaaaccctaaagactcatccaaaagactcctagacttgaaaagtgacatcggtagcatttcaggatataaaatcaaagtacaaagatcagtagcattgttatacactaataacaatcaagcagagaacaaaatcaagaactcaatttcattaacaataactagaaaaaaatatacaatacctaggaatacatgtaactatgctggtgaaagatctctacaaggagaactatgatacactgatgaaagtaattttagatgacgcaaatatgaaaaatcacctcatgctcatgaattggaagaatcaatattgttataatgaccatactacccaaagcaatctacacagtcaatgtgatccctatcaaattaccaatatcatttttcacagaattagaataagcaattctaaaattcacatggaaccaaaaaagagccaaataatcaaagcaatcttaagtaaaaagaaaaaaatctggaagcatcacattacctgacttcaactacaatgctatagtaaccaaaacagcatggtatcaggtaacatcacattacttgacttcaactacaatgctatagtaaccaaaacagcatagtaaccaaaatgcatggtaacaacattttcttttttggtgtgtccttacccagctttggtataaataaagacacatagatcagtaaaacagaatagagtattcagaaatgaagccacatacttatgaccaactgatcttcgacaaagtcactaaaataaacactggggaaaggtcacactattcaataaatggtgctgaacaattggatagctgtaggtagaagaatgagcctgaacctctatctctcattatatgccaaaactaatttaagataggttaaagacttaatcataagatctaaaactataaatatcctagaagaaaacctaggaaaaattcttctggagatttaggcaaagaatttacgagtaagttgttgaaaggaaatgcaatcaaaacaaaaatagatgaatgaggcataattaaactaaaaagcttctgcaaagcaaaagaaacaatcaagagagtaagctgacaacctacagaatgggagaaaatattggcaaagtatgcatctaacaaaggagtaaatccatcatctacaaggaactcaagcaactcaacaagaacacaaataacaccattccaaagtgggcaaaggacacaaacatatgtatatgctctttcttttcaaaagaaaatatacaagtggccaagaaacatatgcaaaaatactgaatattgcttatcatcagagaaatgcaaattaaaaccacaatgagatattgtcttacaccagtcagaatatctgtgattaaaatgtgtataaacaacagattttgtcatggagaaaacttatatactgtgagcgggaatgtaaattaggaaacctttatggaaaacagtatggagatttttcaaataaataaaattagaaccacagtttgaaccattagaaccaccagcaattgcactactctgtatttaccataagggaaatgaatcattacataaaaaagatatctgcatttgtatgattatctcagcactattcataatagcaaagatagcgaatcagactaaatgtacatcaatggatgacaggataaagaaaatgtgagataggctgggcacagtggctcatgcctataatgccagcactttgggaggccaagatgggcggatcacttgaaaccaggagttggagaccagcctggtcaacatggtgaaacctgtctgtagtaaaaataccaaaaaaaaaaaaaaaaaaaaaaaaaaaatatggggtatggtggtgctaagcctgtagtcccagctattggggaagctgagttagtggtgagagagaggatttgaaatacattggtcaaaggtaacaaaattagttccagctatttggaattccgaggggaaggaatcgcttgtgaccaggacttcaaggccaaccagcctttgcaaaatagacagacctcctatctaaaaaaataaataaaataaaataaaacaaaaatgcagttatataggaggaataagttcaagaaatttattgtacagcatcatatctacaggtcatagaa

SEQ ID NO: 386 - DNA, 154210 bp, Homo sapiens
taagttataactagtaaaggactaaacttctagacttgaacttctgatggtctgacttcaaaaatatcttatttttaaaatcatagcacggagcaccttgtatatcatgatatagctatattactttgcagggtttttatgtctaagttattttctcctcctgttccacttccaccctcccattcactctcttctctcctagtagacaaagtccttacctgtctgccagtccccaaccccatgcatgcaattacctcatggaaggacggaaggggggcagggaagaggggacctcctagcccaccaccttccaacacacctctgcagagcccaggccctttcaggcaccccagtcacagccacaccaagcttctagctactgctcagcacacacttaccacctggtttccctgtgcttctcatttgtaattttggattttagtctagttcagacattccttcaattcacattaagcatccatttcctctctgatattcttgtctctggtcccttttttgtcttatccatttggacatctattcctaagcaaaacattctaaattctattttcattatcttactccttagcccagatcaccagaagctccctactatcaacacaaattggaaaatctctggtgtgattatgaggagaccattcagtattttctttgacactattaaacaacattgagtttgcctaatgtcagtactaaaggccaggttgtaaaatagtaaaacctgcagtggtctctaaggcaactagctgtttattatagtagttggggaaaggaagatataaaaaatcttctaaggaactttattatagatctgtttacttaggtaaagcatatacaggaagatgcgggaatcataataaatgcttatgaagcaaaactaaatgcacctgtactgctacatccagattcacatacaaacgacaaagagcttatatccagactgcatgtgtctgtttttgcactgctataaagaaatacctgagactgggtagttcagtttataaagaaaagaggtttaattggctcacggttctgcagcccgtacaggaagcacagtggcttctgcttctgaggaggcctcaggaaatttacaatcatggccgaaggtgaacagaaagcaggcacatcttaaatgacaggagtaggagcaagagagagagtggggaggtgctatacatttaaacaaccagatctcacaagaactcactaccataagaacagcatccagggggaaatccacccccaggactcaatcacctcccaccaggccccacttccaacattggggattttcattcgacatgagatttgggaagggacacaaatccatatcacagactgtataaagaacccctccagtccaggcgtagtggctcatgcctgtaatcccagggctctgggaggccaaggtgggaagagtgcttgaggccaggagtttgagaccggcctgggcaacacagtaagactctgtctctacaacagaaaaaaaaaaaaaaaaaaaggaattcctccaggtacgggggatgctgaatatagagtcaagggtgattattccccagctttgagatttaatgtctgccctcttaggctttggacttgcttggggcttattaaccctttcttttggcctacttttcccttttcaaatgggaatgtctatcctatgcccgtcctgccgttgtaccttagaagtagataacttgttttgatttcacagatggaattttggacttctgagttgatgctgaaacaagttaggaccttggggatatggggattaagtatagttgtatgtgagaagaacatgggtttgggggaccacaggcagaatgcaatggtttgaatgtttgtcccctccaaaactcatgttgaaacttaaccttcaatgtggcagtattgacaggtggggcctttaagagatgttcatggattaatgggttatcatgggagttagactagtggctttataagaggaaaagaggcttcagctagcatgctctgctcctttgccatgtgatgccccataccacctcaggattctgcagagttcccatgagtaaggaggctctgaccagatgcatccccttgaccttggacttcccagcctctggaactgtcagaaatgaatgttattttttttctaaaaaataaacaaaaaactccttcataagaaaaagattgatgactcaatggaaaaatgtgagcagaacagatgtttcagaatagagaataccaaatggcctataaacataggacaatatatactatctgatttgtaatcatggaaaatactcagtaaaaatggccaaaattcaaaagtctgaaaataccaagtactgagagaatgtgaagcaatagggactctgcactgcttggtggagctgctgtgagctgatactagggagaatgaatggatctgggaacagagattaacatgtaaatagttctctttgacactgaaagggtctgttcaggtgcgagtacactctgggtctaacaagggagggcaagaaaaaacaacagttctctttggtgggtgtagatcttaggcagataaagaaacttcaacttatttgagagaggaggtaggggatggggaggtcacagagaactctgggtttcttcagtttactatgccacagcaccatattttcgggtatgagttctgagccccacaatggccataagcacttaaccacagacctagtgactatgtataaaatatacactagattccaaagacttagtatacaaaagaacataaaatatcttatttgtaattgtttaaaactgattacatgttaaaatgataatattttaaatataatgggttaggttggtaaaataaaatatattattaaagttaattttaactgtttctctttaccttttttaatgcagctataattagaaaaccacaaatcatataagcggcttgcattatatttccttttttgagacagagtcttgatgtcacccagtttggagtacagtcgcgcgatctgggcttactgcaacctctgcctcccgggttcaagcgattctcctgcctcagcctcccaagtagctggaatgaattacaggcatgagccaccaggcctggctaatttttttgtatttttagtagagatgaggttttgccatgttggctaggctggtctcaaacccctgacctcaagtgattaacctgccttggcctcccaaagtactggcattacagacgtgagccaccgcacctggctcgcttccattatatttctattggacagcactgctctggagaaaaattaagattctccttttacaggatatttttaaaaaatatttaaatgtaaggaataaaaaatattgtaagaaaccgaagaaagcaaattagaatctggaggtcaggatggatttcttaatgaggacaggtaggggtgtgtgtgtgtgtgtgcgtttgcatgcatggacacacggatagggcaagcacacatacatgtgtgcatatgtatgagactgataaacaatccaataggaaaaatgggcaaaggatagaattgaaaatgcacagaaaatctgaatggcaaacagtaacataatcaaaattactaaaggaagagaaaattaaaagtaactaagacttctctttattggctgggaaaaaaataaaaacataaataatatgtatctttgctgggcaagtgggaagggagcaggatcatacattgttgtaaggaaatgtaaaggttaacagcctactgagaaagcaatatggcaacatccatcaaattagaaacatgccatatccttcgacccagaaacctttctcacaaaaatctaccagcacatgacatgtgttcagaaagttattattgtaatactgtgtagcagaaaaaaagaggaaactaagtatcaataggaaatgaagtaaatgcctatctactgacaaaaggttaaaaacattacctgcaaaacaagacctgttatggaattattaaggattataaataaaaatatcagcaaatttttaaaaatatgaaaatatcaggaatggcaccactgtaggaaaacagactacagtagttccctcttattcttgggagatatgttccaagatccccggtggatgtctgaaaccactgatagtactgaacccgattgctgttaataggaagttttttttggtgatgtttcccacccacaattttaatgacttttctatcttaaccaagtgcttaacatgcactgtggctgcaacttttccattttgaagtgtgacagtaaaactagcaaaaatttctttttcctcctttataatttcagggatagaagatttgttctgaccatggatcttagcaaactcagcatttaaaaaatttccttaagtcaagaacttttaccttttcacttaaaagaagcactttatggcttctcttttgtatatccaagttgccatcattagtactcctgcactttggggccactgtcatgtaaaataagggttccatgaatataagcactgtgatacttaggcagtaaaattgataagaaggctattaagtgactaataggcaggctgcatatacactgtggatactgggcaaagggatgatgcaaatcctggggagggatggagtggtatggcatgagatttcatcatgttcatcagaatggtgcagcgcccaatttaaaacaggaattgtttaggtgccaatttaaaacttaggaattatttctgatattttccacttaaaatattcagactgtggttgccaagagtaatgaaaccttgagaaatgaaaccgaggataaggggaggactactgtatttcatgatatgctggtgtggataaaaataggtgcaaccttactgaagttgaccatgaggttgatcacctgttgaccactgaataggccccacagacaaaagctcctgatctgaggaatttcgaagggaacaaagaccacctggtgaccaccaaacgggccagacagaggcgaaactccttttctgggaattcagaagtaattaaactttcctagtatctaaagtctggttccaggcctctttcaacttttacaagtaactaaaatttatatacatctctgaaatgccatgccgaaactctttttactatcctaagctcctgccttaaggtccataaatacctctaaagaaaaatccatggcagcacacttagtcctcttgctgaggcgccccactgcactcttctgcagtgttctgttaccgcctaaggggttcaccttgcccatgcctagacagagtcaattcatcgagacaggggaattgtgatagagaaagagtacttcacgcagaaccagctgtgtgggagatcagtctccccgagcacgggggagcagagttttaaaagataacttcgtgggtggggggaagccagtgagccagaagtgctgattggtcagggatgaaactgtagggaatcaaaaccgtcttcctgcactgagtcagttcctgggtgggggccacataatcagatgagccactttgggcagccaaagtgagtggatcaccggaggtcgggaattggaaaccagcctggccaacattgtgaaaccctgtctctactaaaaaacaaaaaaaaaaaaacaaacagaaaaagccaggcgtgatggcaggtgcctgtaatcccagctactcgagaggctgagacaggagaatcacttgaatccgggaggcggaggttgcagtgagccgagatcgtgccatttgcactccagcctgggcgacaagagcaagactccgtctccaaaaaaaaaaaaaaaaaaaaaaagagccagtttattgatgtgggtagtgccagctgacccatcaagtacggggtctgcaaaatacctcaagcactgatcacaggagcagtttagggagggtcagaatcttgcagcctccagctgcatgactactaaaccaaaaattctaatcctgtggctaatgttagtctagtcctcagacaagaaggaagtctgctttgggaaagggctgttaccctctttgtttataaactaagtttctcccaaagttagttcagcctacgcccaggaatgaacaagaacagcttggagcttagaagcaagatggagtcggttacgttagatttctttcactgtctcagtcatcattttgcaaaggctgtttcagttcttcctttctaataaactttccttttttcaaacctatactgtttgtaggtatggtaaattcattttaccaacctgcgagttgaccacttcccggtgccagggctctgacaccttgccaggcacttacggaaagataattgtaaaaatctaatagaattttaaatttccatgccttcgaacccagcagccaaacttccagaaatttatcctactaatataatggcacgacgatctaaagagatatgtacaaggatgttctcgacagcctttatttaataagatgtggaaagaaccttaaatgtctactcaaaattgttgaataaatcacatgtctacaaaatgaataatgcagactttaaaaagagtgaggtagctctatgtcaccaaactggaacaataaaagccactataaagtataaaaagcaagctgaagactgtctctatgtttgaaatttttcataataaaaaatgaaaaaaatggagggggattagatatattgccttttcatgagtaagaatctcacaagtcttggacaattaaaccccgccttcatccctcccatctcatcatatctgacctcaaccagtttcctacctacactgcttatatgcccatttgctctatatgactcagtcatttcaagattgcttctgttttcccttattgatataaaaatattaaaaatgtatatttaaaatttgtttaattacatcccattattacagttcatttttgcatattcctgtgttgaaaatcctttggtataaatcaacatcaaaactcggtgttattccacttttcttgaactgtaatcctttttaaacaaggaatataccttttcttgtttagagaatatacgtacattcataaatcttggcaactttcaaaggccataacaaatttgtgttaagaattcagatcccctttattattgtggtaaacagacagatgaaattaagagattatagcttgttttcactctctcccaattactatcgcttgaaaaataccggatatttcattattatcctgtccggagtcggcaaactacggtctactatctgtcttcgtatacgtcaaaagctaagaatggtttttacatttttaaatgactggggagggagggccagaatccaaggggagtatttaatgacacttgaaaatgttattaaattcaaattttagcatccataataaagtttcattgacacacagccatgctcatttagcttttgtttgtttttggagacagagtctcgctctgtcgcccaggctggagtgcagtggcgagatctcggctcactgcaacctctgcctcctgctttcaagccattctcctgcctccgccttccaggtagctgggattacaggtgcgcgccacacgcgccacacgcccggctaatttttgtctctactaaaaagtagagacagggtttcgctatgttggccaggctggtctcaaactcctgacctcaggtgatccacccgcctcggcctcccaaagtgataggattacaggcgtgagccaccgcgcccagccttcatttagtactgtctaatgatgttttcatactgcaaggagaaagctgagtatggaccacaaggccaaaaagatgtcctctctggctctctacagcaaagatttgccaagccctgttatatgtcatactacttgcgcttcataattttatagttttacctagacagtctcccttttttccttccatattcagcataaaatccccttaatatcagtctctaggcaagcacattcttcacagtccttagaactggacctcctcttgttaatttccttagtctaatcacattcctcctggttatctacaaacagaaagccagaaaggagggctatcaacatcttaagcgccacaaattaacaaatcaaaaccaaatctctctctccctccgaagccacggctaaggaggctcactgcccagttagtggctttcaaactacccttacaagtgagacatcttgtgaattagaacaagtgctgctgctaaaatccctaacggctacatagcaatgtgaaaaaaggtatcaaatgtaattttctcaaatttaatcttcttcaattcttggcacaaaaaaaggaacagtaaaggtagacaactgtaattagcatgtgtgatcccaaatctttataccttagatactggattatattttcagcaagtaaatagtttctggctcccaagatgagaggttaaataatgcagggtgtttgtaaacagcagcacaatttacaccggaaattagggccctttctcaccgaggagagtacagcaaaatctgctcatctctttcaatgaatattctccatgactagtgctggcggcggggaggcggagcaagctatcttttctaccagccgtgtcacacccctcctagcactaacccctcctcctcagccttttcacacctctacccactactagcccctccccagccccatcacctcttcccgggcccctcacacctctcccagcatactcttccccagcctcatcacctcacccacttcctccaaaatcactgacctgctaagcttccagcagcaggcgggcaaagcagggaggctgtaatgcaaaagtccgcagtccctacacaaacactatctgctcctgcggagaaactcaagtcacagccccagaagtggaaagaacaggccttggctctcacccagttaacaagcgtttatccagcgcacgtgttgcggtcggaccccatgcgaaggagctaaggacacaaaggtgagcagcagagacgcggttccagctctcccccggctcccactccagcgggataggtagataatttcggtaaatttcgccaagcaggggcaggacaaagagtatttgaagtctaccgcggggagaacttacctaatccttgaatgttaaaaggctaaaaactccactagtcggaagtgacgtgccagcttagccccgcaggtccgccacgtaattggccgccgccacagctagccaccctctccccagactggcccgaagagaggaaaagtgtggaagtccacaagccgcccccgccccgccctcttcgtcgactttcagctgcaccgggaggcggcggcgcctggccagagccggggcctggagcctggactagacagcctcgccggccggggcgccagtccagcgccctgcgggcaatgggcttcagcgctcgagcacgcgcatgcgcgggcctgtatctccagaggattcctcgggtcacctggacgccagcatctcagccacctgcccctctgggtcccttcttgcccttgattccccctgctgcttctcatcgccagccctcctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaaggtaggtgctgtcccgccgccgcgcccgagcctggggcctgcgctcgccggccggctccgcaagccgcgtcccagcgccccgcgactgcgtcaccggccccccgcacgtaaccacagctgcctccgcccgcctcgggcccgggcggacgttttgccgccccggcgacgtcagcgcgtccggcgttgcttggctaccccgccgttcccccgtcccgctgctgctcacctccccgggtgaaactctgacgcagtcaccgcgggtctcggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcaggtgaggaggccacttaatttgtaaaagactgaggaaggggtaggatcaccacaagtcaaagttggattcccacagatagaaatcatctgactgaacttctctcctattgctgacagaagaaattcaaatccaaagaagttatcagttcctactccaaatcaaacacatttgtgtgtgccaacaatatatacaggaacaattgttgttaacctacctcattacatggccacttatctctcagcacatagatctaccaaatttccttccttccagtaggtccctggagaaggatgggggtcgggaggagaaaaggttatggggatagttaaatcaacttacccatggctaaaagtatggatgttttaaggatggagtagggggccagccttgtgttttataaatctctcctatgcatttccaattcttctgaggctgcgcttgagggagatctcattgcctcttttgtgtctcttaattcgcaaccactccaggacctataagttggagacacactatgcccagggtgttagttatcaatagctatattgaaagattccagtcactacaaatagactcgttgctctcttttcaagaagtcgttggcctgagctcagcaatatttaatatggttgccataatttatcagttttcagcagttctgagtgtccagatgaacacaagagaaatggaatgttgcgtgaaatgtcattccaagaagagagcagatttcctttaggctagtctgatggataaaaggaagaataatttcagattttcctgaaaagaggaggttgcctttgcctcattcattccatttgttagcctttagagcagtggtatctaaccctttcaatatgaggactctctttgcttatctgtggtggctgataaaaattatgcatggaccttctgtggtggtgatagaacaaaagttatgcatggacttttttttttttaagcttatcagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacttttttacttctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagaggtaagagacaagatagatcaattgggggttgtgtgtcagtttactaacaagaaaaaaaaggttgatggctgggagtcacaagttttgaaaatggagaaacaaagaggttgaattgattggaagagaagatggagaataacaagaaggggcaaatctggagttaggacttaacatagggataaatgtcgggtcagggatgcaaaaaaaaaaaaaagaaaaaacctccaattaatatttttattttctctgtcctcttccccactcccaagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggtggggaagcagacacacgatgtcagtgtgggtaaaaagggagaagcggcagaggatgagatactccctaggtagagatcgtaagctcctactactcactttgtattctcagagctgcatatgcaggggcacacagtatgtgtgatcagttgtcctctagcctgaaaaagagcaatggtgagaagtgccctaaaatttctctctgacttttgcaatacatgtgagtcttatgggtgaatattggtatgtgtggtcatatttttcataaatgaatgaaaccacatggaaaagattaaacttaggaagaactgaaaagtagtctggtttcttcattctgcctgcctgctcagaatgctccttgttttcacactggttattgggcataggtaatatcgcttgagactgatacctaccggactaagctgaaccattcaattgtttgcagcttctctaggtaatgggtaacatggcatatcatttaacttactgctgagacaaaggaaaatgtttgaataaagggaacagagatatgaatgtgttagcattttatcatatactttgcttagttatgttactcttgaaaacaagatttcaggtaacttacagtataataaccatgtttttattgtaggtggacagaggtggatgggaggacaggtttaaagagagatattagggtacagaaggttgcttggatggtaataggcagttgcctcagtaagaaaatggaaagagttgagaaaggacacagagttgatgacagctatctcagattcagtaaaaggacagttgggtgagcagagaaggtgatgtggacaggctagtggcaggaggagggactgtagaaagttgacatcccaaatgacaggcaaggaaggaagtcagatcaagaggcagtaagatggctaggaagcaaataaatggtttaaaacaaatggtttaatctctgaatggtaggtataccagtcaaccccaaatgtcacctctcccacttcctccctacccctcaggaaaaactgcagaagtgtctggagcccctggaacagaagctgcaggagatcactcgctgcaagtcctctgaggagaagaagcctggtgagctcaaggtaaaggcaggcaatcccatgtaggctgctctgaagggtatttgcctatgagggaattaactgtacactatttaatccaccagttccggttcattagaaaaatgcagttctcgccggacatggtggctcacacctgtaatcccagcaattctggaggccaaggtgggcagattgcttgagctcaggagtttgagaccaccctgggcaacatggtgaaaccctgtctttactaaaaacaaaaaattagccgggcatggtggcacatgcctgtagtcccagcgacttgggcggctgaggcaggagaattgcttgaacctgggaggcggaggttgcagtgagccaagatcacaccattgtactccagcctgggcaacagagcaaggctctgtctcaaacaaacaaaaaaaacaaacaaaaaaaaaaagaacaatgtagttctctcaaaaatgatggcattttattaggcttgattgtcattaaacattgtacttaaattacttgtcatgaattaagtattaagagggatttaagagatgaagaacagacagaatatcttacatctggtgagctgagagagttcgtgcctcttggtctcctttttttgttaaagcagcaaaggaggctttctgctgagaaggcagggatgggagtttcttagaggacttgaagagaggagaatatggaagattcactggggagaaagggaaaaggagctgaccaagagtctcagaagaactatctaatgacattaggaccacattcttaaaactcaagtaagcttacatatgctagaatgttctccccctccccatcctccaccataggatcttattcatctctcaggcgggatgaaagccacttcctatgcagcctttcctgacccttcagaaattaacattcttaattttcatacaattttgcacctcttttatagcattgccttatttgtagcatggtattttggtgtctgtctgtcttccattgaacagtgaacaattatcatttgtagcaaaaataactagaattgagtcctatgcattaattcattaggtatccgtaacattccagatttatagggttgttagggtcttagagttcaggccaaattgggataagtgagacatagaaaagctacgagaaagagacagaaggaaatcctgaggccatctttagtaagatgtaggggtaaacctagatattctttaaggtaggtattattaccttcagcttacacagaaggaaatggaccttgggtaagtgactagtccaagatcataaagccagtaagtggcaaaaccaggaatactagttcttcgtgaatcagtaaatatttgttaagctcctggtttaggccaaacccggtatttgacactggggaacaatgatgagcaaaaacacagttcctgccctccttgagcttaaagttaagtggagaaaataagtaatggcacaaaatgcacagctgcaagttcataagaagacaacatagaaatttggcctcattaaaggtttcccgaagaagtaatgagtttttaagagttgacatgtagagatcaccagaagctaaatccaagttttgattcatagaaacatgaatttttaaatgaatgataacatttcatcagaaagcaagtattattaccttagtgccttatacattttagcaaagtaagcatttgaaattttaaaatttgaaccaattttggttagaaatgtgaacttttaaagttttttgttcttttagaggccttccaagaaacctaaaaatatgaaaatggtgcttattgctagtcattaactttcttcttcatgttgatcaccttcttgaaggtaaaggatggagagagaaatatacctttttaaaaccttctaaatgcttgaacagaactgtcctgttttttaaactgtaaattgtcatttcagtggtctccaaaactaccaccaacattcctcttgtgaccatttgaattctccctccttctccctcatcagactcaatgcccctttaaaaaataatttgtaattatgctgaactgaaaattacaggtaatataacctatgtgcataatgttaaattttaaagagtctatcatgtccaaatataatataatgaaacataattgatgataaaatgtggtatgtaatatttgggcatgactaccctgaacgactttacagtgtagctggttatatgcttgcccctatatgtgtcattatcagcaacgccataaatacaaattcagactgagatggatgtgtgccaatatgattgaaataccataagtagcttagctcttggtgatatgatttttcatagtaataacttttggtaaagttctaagtataacaatataatcttgggttttattcagctattgctgaaaaattcacgtatagtaaaaccatgtaagaattactctgtgtttatactatataaaatggcattcaagcccaggcctatgtttttgtttttgtggttttttttttttttttttttttgagacggcgtctcgctctgtcatccaggctggagtgcagtggtgccatctcggctcactgcaagctctgcctcccgggttcatgccattctcctgcctcagcctcccaagtacctgggactacaggcgcccaccaccacacccagctgattttttttttctatttttagtagagacagggtttcaccgtgttatccaggatggtctcgatctcctgaccttgtgatctgcccacctcggcctcccaaagtgctgggattacaggcgtgagccaccgtgcctggccgcccaggcctgtgtttttgaatatccagcagaacattagaaaatgttgcaggtcagttcactatgccggattgtctcacacattggaggagtgcttgcgtcattgtcaggaacttccccaaccatggaaaacaagaagatgtgcctatttccaaaatatcctcagagtgtgttaacagcttcatcaagaaccactgccctaaaatatagagtgaaaaaaagagaaaagattaccggtttataagaggaagggcctttttgcttcctatttatcacagtcatgaatgttaaacttacacccatacctaaacaaacacacatgcatgcacacacatgtgcaaacacacacacacaaaggctgtgttttattgagggcaaatgtgagaatatattttgttcagatgtacactgagaaggcagtggtggaaagtgaagcagcaagtggccctaaactagaagagctagtcagcctctgccaggaactagcttgaatccacaaatgccacgcttgtcaggcccatcctggctttgcatccccactctctctccaccctcaagcctgcctttcattccctatccacttccttctagagtcccagtctctgcttctcactttgcttcatcatcagtcacatgatgcttggggaattctttagggagatcactatttgttgtagtggagatgcagaagagaggatgtgctgataattctcagaaagtgttatggctggtgtttgagtcctatattatcaaatttcaggaatgttagaggcttaagtctgtgtgctggcttaaagaaagcatgtttcaaatttcaagaaactaaattactaacaaacttctgtaacctgttcctggggtaggaattgccagttctctgaagtgacttgaaacaatttaacaagttcagccctgaaatctacatatgtatattttataataacccatataactcttactgattcttacactttcccagttctctggtttttatctggtgcatgtgttgcaatatgcaaaggatgacaatcttatttttaactttttattatttgtactttcctttttgtttcgttgttttttgtttgcttgttttgagacagaatctcactcacccaggctggagggcagtagtgatcacagcacactaactcaaactccagtgttcaggccatccatcctcttgattctttttgagtagctaggactgcagatgtgcattgccatgcccgactaatttttttttctttttagttgaaacaaggtctcactatgtttcctaggttggtcttggcctcaagtgatcctctcacctgggcctcctaagcactaagtttacaggcatgagccaccatgctgagcctatactttccttttctcgacagattgaattaactagaactttacagttgataataacacagatatctctgatatctgtaatagttaatgtcatcatattattgagttctttatcttaaattaaaacaaatatatatatccgcagtggtcttcactaccaagtcatcagtaggggggtgatagtgatggagccattctttacagaaggaaattccaatggaataaaaaatgagtgttctgttaaaccattttctctcattttctttctttcttttctttctgtctttgtctttctgtctttctttcctgtctgtctgtctttcatctcgatctgttgcccaagctggagtgcaatggtgcaacaatttcagcttactccaacctctgccttctttgctcaagccatcatcccacctcagcctctccagtagctgggactacaggcatgcaccaccagactcagctaattttttgtattttttgtagagttggggtttcaccatgttacctaggctggtctcaaacttctcatcccaagcaatccacctccctcggcctcccaaagtcctgggattacagtcatgtgtcaccacacccagcctttgttaaaccattttcaatgaaactggaagtctgtgttaattcatacatatggtgggtgagagaaaggcttccttataccacactgaccctgctgatacaacatcttccctctcttctcagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggttcgacctttgcccctgcatagcccctcaggctgagtgcagcgtagctttgcgtagcctgggatttgtcagcctgggatactcattcttctgctctccttctctaaatccagttctttctgccaggtgtactcaaagggtctttgctacggaaaagtgatttctcccatccccttctaaccatttttgtgttcttatctctggtcagcaattatgtgcttaatctgttccaaagaaaagattcattcttttgaaaggagggaagtctagcctgagttagtgaaaaactatgcattaaaaattttgtaaatgcagttaccattacttttaagtcctgaaatttgatttatgtactgctgaaaaaggacagaaacatagtttaaaggatacaggcatacctcagagatattgtgggttcagttccataccacttcaataaagcgagtatcttgataaagcaagtcacattaattgttgggtttcctagtggaatcatatttttgctggtggagggtcttgtgttagtattgactgatcgaggtggtggttgctgaagattggggtgactgtggtaatttcttaaaataagacaacgacgaagtttactttcaactcttccttttatgaaagatatctctgagcatgtgatgctgtttaatagcattttactcaccagtagaacttctttgaaaatctttgaaaacccacatttgcagttacttacaacatgggagtcttgaacccctaaaagtcatccataagggttggaatagacttcttctaaatgcctgttaatattgatattttggcttcctttcacaaatcacaaatgttcttaatggcatctagaatggtgaatccttaccagaaagccttcaatttactttgcctagatctatcagaaaaatcactatttatagcagctttatgaaatacatttattaagacttgaaagtccaaattacttcttgatccatgggctgccgattggatgttgtgttagcggacgtgaaaacaacatgaatctcattttacatctctatcagaacttttgggtgatcaagtgcattgtcagtgagcagtaatattttgaaaggaatctttttttctgagcagtaggtctcaacttaaaattttcagtaaagggttgggcacggtggcttacacctgtaatcctatcactttgggaggccaaggcaggtggatcacctgaggtcaggagtttgagaccagcctggccaacatggtgaagcccaatctctactaaaaatacaaaaaaattagctgggcatggtggtgggcgcctgtaatcccagctactcgggaggctgagggaggagaatcgcttgaacccgagaggcagaggttgcagtgagccaagatcatgcagttgcactcctgcctgggtgacaagagtgaaactccatccccccaaaaaaaacttcagtaaaggctaggcacgttggctcacatctgtaatcccagcactctgagagatcaagccaggaggactgcttaaggccaggaattcaagaccagtctgggcaatatagcaggaccccatctctacaaaaggtaattttttttaattaaaaacattcagtataccatgctgtatacaggtgtactgtcatgtaggctttgttattccatttctagagcacaaggaaagtagatttagcataattcttaagagccctaggatttttgaaatggtaagtgagcactggtttcaacttaaagtcaccagctgcccttgcttctaataagaaagtcatcctgtcctttgaagctttaaagccaggcattgacttctctcgaactgtgaaagccctggatagcaccttcttcaatagaaggctgtttgttgacattgaaaatgtgttgtttagtgtagccaccttcatcagtaatcttggcaagatcttctggataacttgctgcaacttctgcatcagcacttgctgcttctccttgcacatttttgttacagagatggcttcttttcttaaaacaacctacctaactttaaacttttcttctgcagcttccttacctctctcagctttcatagaactgaaggagttaacagccttgctctggattgggctttggcttaagggaatcatgtgatcttatatccagatcactaaaattttctccatctcagcaataaagctgtttcactttcttatcattcatgtgttcactggagtagcacttttaattttcttcaataacttttccttagcattcacagcctggcttggtgtttggcacaagaggcctagctttcagcccatcttggctttcaatgtgcctttctcactaagcttaaacatttttaggttttgatttaaagtgagagacatgtgattcttctttcacatgaacacttagaggccattgcaggattattaattgatataattttaatatcgttgtgtctcggaatagggaggccagaggagatggagaaagatgagggaatagctggtagtggatcagttagaacacataaaatatatttatcgattaagttgttcgtcttatatggatgcagttcacagtgcccccataacgattacaatagtaacatcaaagatcactgatcacagatcatactagatataataatgaaaaagtgtgaaatattgtgagaattaccaaaatgtgacacagagacatgaagtgaacacatgctgttggaaaacatggtgccagtagacttgctcaacacaggttgccacaaaccatctatctgaaaaacatacaatgtcaacaaaacacaataaagcgaggtgcaataaaatgaggtatgcctgaaattgtttaaataatatattgcttttgatatgtatatattaataatacctctaaagtgtttgaaatattttgttctcttacgtaaatgaatggtgttagcaaaactagggaacatattttttatcttagagattagattaccagcatttgaagcagtgaggcttcattgtacatttatttttatgttacgtattgcttggtatttgttcctatggcctttcatgtatgtgtgttctgccttccatattaaactgggaaatccttgtgggacagagatttgtcttctttgtcttctggaccccaagtattcacaaatcagtattagcacacagttattaatgtgtttattcttccttttttttttttctgagagagtcttgctctgtcgcccaggctggagtgcagtgcatgatctcggctcactgcaacctttgcctcctgtgttcaagcgattctcctgcctcagcctcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttattgatgtttattaactaatgcaagacaggggataccaaaccgtaacaggaatgtgtgatttgttcctatgccaccagtctggaactctctgtacttatcctcaaggagagtgagatatgtggttggtacttgggggacagagtaaagaattgatacaatccctgtcccttatagggagctcccagcatccttgaggagcaaagacaagcataaaagaaatcattgggaagtgatataaatgaccaagcttcatgatgaccagaagttgaaagtagggattaggttgggagaagtgcattcaggtcccgctggagctcttcttgcactgtgtgaccctcagtttatcctatccctattttatagctgtggaactttggggaggagggggaaccttttgccttcaggaccactgaataccaggaccaatattgctttcttttctccttccttctaggatgtcaaaagtaccctggaaaagtaagtgattgttgtatctctctgagtgagttaggtcttggcttagagaggaggggtacagtcaggagtttgggttgggggtgaggttgggaaagtcatgtagtgtgtctgggcagggtatgggagaatgttcattgtgcccatgaagccagttagagaacaaattattgggaataataatcccttttcccctttgaacatcaggacttcttgagaaggagaatgataaggtagaatcagattctacttgtgccagtgggtggaattgtgtccaaacaagatggcaggaggaaggggttgggagagcagggagggcaatcatccatttgcatgaaatacaggaatattcctagaaagttcggaggctcactctcaacgatctgtccacgggatcataaggctctccttggattagtaaaagaaatcaacaggtgagcttttcagggaggaggaagaaagtgggaagatggagaattttaatttctccctaaaaatgttaacatctgaatagtcacttggctggagcttctccctaaccctgccctttcttcccctatctccctatccctcctagatgtgaaaaggtgaagaccatggaggtgacttcagtatccatagagctggaaaagaacttcagcaattttccccgacagtactttgccctaaggaaaatccttaaacagctaattggtgagttgttcccaaaaggaaactagaagaaaccactagagagaagaaagtttttaggtcctaccttatatgggtttcagttatcctatgtctcacttttcttactcccacacacacctacccctttatctggcttttagtctcaccctgagtcacagaacttggagtgagaggaagccttaagcgttatctactcttaggtccattcttttctaaatagagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagcggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctagaccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaagagattattatctgtttactttagggtcagggtgagaagtgagccattgctttctccccttccttaggtgacaccatggattgagaaagttaaccaaaccaggttgttctggggacctttaagggaccaggctctgtaaaggcaggctggaagagtgaggcaggggcatttagctattcccatcctcatctagctccccactctggcttctcccgccagcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgatctctgtgttgtgtggtaatttggtgacagccttgtactgatgtgtaagaatcactgggtgttagacatgcatgttcctgggtctcacccttagtggttagtcaaggtctggggtgggccggacatctacattttatttatgagacagagtctcgttctgtcgcccaggctggagtacagtggtgatctcagctcactgcaacctccgcctcccaggttcaagcaattctcctgcctcagcctccagagtagctgggattactatggactatagccatgcaccaccacacccggctaattttagtggagacagggttttgccatgttggacaggctggtctcgaactcctgaactcaagtaatctacctgcctcagccactcaaagtgctaggattacaggtgtgagccaccgtgcccagcctacatctacattttaaacacaccactctcatttgagtccgaaaacccttgtgaaactagttccagaggaggtttcagccatgtccttcctcccagctggagccctgcttgtctgtccccgcctggcactgggtctgaaattggagagaagtcatcctctcctgacttatgctgccctccccatctcagggttcattgatcttctacccctccaattcatgtccctctgcttctgacttcagtaactgatagtcactatgagtcacaggacaccagacagaagaactggaagatagaagaggtcagagggaggggtgtgaggtgaatgtcagtgtggggagtggggtgaagtttcaggggcaggggatgctgttgacagatttctgtgctgtacctaagcctaggagttagaaaccattcactcagaaagtgaggatcacctactgtgtgtccagcactgcataacaggaagtgtgtttctttggtaggtggaatagtaggagtaaactgtgctttctgaggaccgggagtccttttccctccctccagcaccctcatgatccttcccactttcacccccactggcaccagtgcttttttttaatgtattacctctgtgccttccgtctgtagatcttacaggcatctgcctcggacctcaggagagtagggcagaagctctagctgggtataaattgcacataaccatctccccaacgtagctacataaagagaccagccttctgtcctgaaaatggccgatttaagatcctcacctgctccactaggtctctaggtgatataattggtcatgagcttgaggaagacaaaagcactgaaaattcataaagggaccctgggcatggattgctggggttgtgtttagaaaccgatgagtttgtgaggcctccgggaggctcccgagggcgcggggactacgtttcccaggaggcctcgcgcggacgcccgggcggggctgtgcgaggggtggggctgcgggaggccctggagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagagggagcgcgggcgccagaccactatcctcctccgcccccagggatccctcggtgaagaggactctctgtcgaggctgctcttccctcctcgtcccgggcctcacctgcacccagcgccagagacgtgagtgctccaacggaggtggaagactgcggagcattgggggcgcggaggggggcggggtggggggcgggcactggaggccaacagcgcctttctcactgtagatggatgttgggtgtgggattcgcaggagtcttccttcttcgggtttggattaagttcctaacgccacttgcacaaactagggtttgggctcggctgttttttttttttttcttccagtgtgggcaataaataataacttttaagaggcaaccccacccatgcacaataatagatgttgttcggctttgtggaggacgattcccatcaccattcatttattaagcaaatacttattttctaaaatgtgtcaggtactgtgctagattcattattctcattgaaattacggtctgatgggacagactaagaaacaaaatggtgtagaaaaagattaactgggggagtagaatgctcacttactcatgccagtggtggcgaagtttatgataagcaaagggagtgagagatggaaattctaggcatgtgtgcagactctgagacaagagagcttgtggtgctgtcaaagaaatgagagttcaggaggctggagtttgaggtaggagggcaaaacatgagactggagggggaaacaggccagttcttgaagtcttgttagggagtttgaactttatcttaaagagttccaggaaatcgatggagcttatgccgaggcctgacaccatcaaatgtgcattcaaattgggggtgtggtgggggagcggggatacctactgaaaaacactggaggcaaaactggcagcaagagaccgttacttctaaacgtggacagtctttttcccatgttcaccctaggctgcaggggacagcgctggaccgtacagacctgcctaacatgccagcgcagccaacgcttcctcaatgatcccgggcatttactctggggagacaggcctgaggcccagctcgggagccaagcaggtgagaggtgagggagaaaatggaggacaccccagaggatagggacaatggagaacgtagagtgaagaggacacatggacaggttctgggttggtgtgagaagtaccacagtcagaaaactaattctgtttctctgattctgctcatttactcagattccaaaccactacaacccttgccaaacacagcccactccatttcagaccgccttcctgaggagaaaatgcagactcagggttccagtaaccagtgatggattcaccccatctcccaaataaagtttacttgttttacattccatgattctgttctgtgggtatttcaactcttaattccattttcttctgtttctgtctgtgtttcttggtcacctttgtaatcccaccatgcagggagatcgtgatttccatagaccacttggcctcactcagcagcttgcatttccaaggccatggccccagttccctatcaatgtcctgagccaccttagggcattccatgtttgggcagccataattgctgactgaagagctggagagaatgatgccactgctgctgtttttaaacaaggggagaaatatggggcagcggagagtgtttgtatcctctaggcccactcatagtcagaaaagactcaggtcttttcccagtctcaaagttgtctttaataaaattctgataaaggaaatggcgcaaacctgaactaacaaagtcaaagatgctaacaaaggacaccgacagacattttgcaattatgtcccataggtaaactctcagagttttcttaagaataaacaactaaaatgttttcttcgatatccctagaaagcctactgaagtacagaattcttagactgacctttttgctaaatgccagctaataaggttataccaaaagcatacaaacaaaatttactacttccagaatgcagttttcttttatttctcttataaaccctgtgtttgcttatcgatagctgtataaaaaaatcacttcatcatgttggagcttaaaacataatgatttattatttcctctggttctgtgaactaggaattctgaaagactttggctgggtggttctcctgttacatatgaaatcagcttaaatagctgcatttagctgctatctcgtaggtggtctggaagacccaagaaatttcactcacgtgtttagcacctcattgcttctccaagtagccttgctccctcgctagctttgatgttcccacagcatggctgactcagggtagttgtatttcttacatcccctctggcttctacaaaagcatcccaatatgtaagtgtttggctggatgctgtggctcacacctgtgatcccagcactttgtgaggccgaggcaggtggatcacttgagttcaggagtttgagaccagcccggacaacatggtggaaccctgtctgtacttaaaatacaaaaaaattagcagggcgtggtagcaggcacctgtaattccagctactcgggaggctgaggcaggagaatcacctgaacccaggaggcagagttgcagtgggccaagatcgcgccactgcattccagcctgtgtgacagagtgagactgtctcaaaaaaaaaaagtgtttatcgagcctctgttggggtcacacttgctaatgttcccttggccaaagcaaggcacagtgccaatgccagattcaatgtggaaggggctacactggagtttgaacgctgggaggttcattagttccctggggatcaccagtgtaacaatctaccacaggggtccccaacccccaggccctgtggactggtactgggctgtgtcctgttaggaaccaggctgcctagtaggaggtgagcagtggtggaagggagggatgggccagcattactgcctgagtaatcagtggcagcattagattcacataggagcatgaaccctactgtgaactgcgcatgcaagggatctgggttgcatgctccttatcataatctaattgctgatgatctggggtgaaatagtttcatcccagaaccatacccttcctgctccatggaaaaattgcctttcacaaaaccagtccctggttaacctgtccctagtgccaaaaaggttggggatcactcatctaccacattcttgttttgcctttgtccctgacttggtctctccactgcctccttcacatgtcagtaaattatttgcgtagaaaatactaaacagtgtacatgtaagtaaatgtttctgagtcatcctttgacattttatttctggaaatagtgcctacctgggtcaactttcagtccaacaaaaatgtgtagcctgaaagtaacacctcgtgcatacctgggtcctttgcatcctcagctcaccttccatggctcctccagtaagtttaatttgggatgactgagctcgactcttgcacacttaatctgatctttggctaagtttgtcttgagtgtgttatgattgcatgtgactgaacatgtctacagtgggatagcagtggggaaactgagtttcgatttcatggctcagtcactaagtgattcctctcatgtgggagatcatgggaatcaggtcccagtcaggatgagcggcagacaaaacagtatctggaatctggttcacttgtgagtctttgtggtttctttatttgttgtgggtttctatcaatatataactctaaagatcacagccctcttcctctttccacagccctcttcctctttcctttttcatgtttaattataaatatatgattacatatataacatttatattctatacattgatacatgattctatgtattaatacagatacatcataaagatatataatgtgatagtggcatattatatgcaaaaatggatttcctagatgaaagatgaaaataaactgaatccctggaatgcagtagctttctcaagtgtttctagaagttcaataactcaaaatttatgcccttttaggactctaaataaaattaaaggagagagaagaaacttaggttattcaaatcgaatcaagaaatgaggtcttccagtaaccatagaaactatgccttagtcactccctgaacattaagttcatttagcactttcaaaactagtgaaaaccagtatcgttattgtcaggaggcaaaagagagaaggattgagagactgttattttgaattcaagtagcaaaaacgttagaaaagacaggtcttgaacattgaggaatctgagttattgtcaccataataaatcagtgtgtatctctaatttaaaacaattatatcactatgaagatagtgcctatgcttagtaactgcttaataaattttcaaaactattttgaaatatagattcactggaagctgcaaagagcatactgaaatgtcccctacatcctcacccagtgccccccagtggttcctctttttattgtggtaaaatatacttaacttaaaatgtatcattttagccattttaaagtgtacaattcagtggcattaagtacatttgcaatattatacaatcaccaccactatttagttccagatctttttcatcatcccaaacagaaacctgtttccattaaacagtcacttccaatttttccctattccagcccttagcaaccactaatctgtttctgcctttacggatttgtctattctgtatatttcatataaatggaatcatacaatttgtagcttattgtgtctgatttctttcacttagcataatgttttcagggttcatccgtgctgtagcaaatgtcagtatttcattcctttctatggctgaatagtagccgattatatggatataccacattttgtttatccattcagccatcaatggacacttccgttatttctgctttttggctattgtgaacagtgctgctatgaacatttgtgtacaaggttctgtttcagtatctgtttttagtttttttgttggaggatataggtgcggttcgtttgatagttttatattttaactttttgaggaactaccaaactgctcttcatggctgctgcaccattttgcactcccaccagcaatgcacatggttctaatttctctccatcctaatctacacttactttcagtttgttttgttgtttattatagccatcctataataacattctagtgggtataaaaccgctagaagtcaatccaaaacactagacaaaaaccacaaaacctctttgtggttttgatatacagttctctaatgagtaatgatgttgagcatcttatgtgtttgttggctatttgtatattttctttggaaaaaggtcctttcaagacctttgcccatttaaaaaaaataggttgcctttatgttttgagttttaggaattctttatatattctgaatactagacccttatcagatatatgatttgcaaacattttctttcattccgtggattgtcttttcactctcttgatagtatattttgatgtataaaagcttttaattttcatgatcttgcagctacttcctcaagaaccaaactgtctctctcagaccttatcttctgcctccatcctgattctttttggagcttgttctaaccctggccctgcccactgtgaccttgacactacttaattaggaccccctcacctcctttcagacctggtgcctccaactatatcctgcctcactctgctttgaaacaggaaagtgttccccctggactcttagagtagatgtgggtatctgagtttctcttcctaaaatcctttccttcttagagcgatcaatgagccctgttgaatggcctatggaagggaaatgaatgttctaaatttcctctgacccttttcttcggacccccaaaggcattccccaccagcacccactatgaccccatctctgactgtaataccaccctgaggtgctgggccctgggcttccaccctgaagagatcacattgatctggcagcaggatggggaggactatacctaggacatggagcttgcagagaccattttatctttttgacaacttttttttttttttttttttttgagacagagtctcactcttgcccaagctggagtgcagtggcgcgatcttggctcactgcaagctccgcctcccaggttgatgccattctcctgcctcagcctcctgaatagctgggactacaggcacccgccaccatgcccggctaattttttgtatttttagtagagacggggtttcaccgtgttaaccaggatgggctcgatctcctgacctcgtgatccacccgcctcggcctcccaaagtgctgggattacaggcgtgagccaccgcacccggctgacaacgttttttaagctctctgtactgtatatacatctaattcagtgttttggactgccatagattatgcttttaaaacattttgtttatcccttttcttatggatagtcaactagtttgcttccaactatatgttaccatatatatctctgtagtagaattctagaccatggacctatgagagtgggcctctggagtacttagccacaattacaaattggattctaggtttgtgtgtatggaaattacctgaggaaagtcaaattttccttcagcttccacagtctatactccctagcaatataccaagttcatctttctttacatgctcagttgattttaactgacttcttaatctttgtcacaatctaatcagtatcaactctttccctttcttgttgtaacttgagtttctcttattgccagtgatactgtgtagcttcaaataagtcatcatcattcatttttctctttctttgaactgcctattcaaatgtttccccctatttttccactagatttcatggtgttcttttctttttgctttgaagggtgttatgggctaaatgtttgtgttcccccaaaattcatatgttgaagccctaacccccagtgtggtggtatctggaggtgggaccctggggaggtaattaagtttagatgaggtcaggaggggggggcctccgtgatgggattagtgctcttttaagaagagggagattggagctctctttccctaccttgtgaggacaccgaaagaaggcagtcatctgtatgccaggaagaggatcctcactggaactgaatctgctgtcacctccaaaactgtgagagataaatgtctgttgtataagccacccagtctgtggtatttgttatagcagccatggctgactaagacctaaggttttggttgttttgtttgtttgtttgtttgttttcttgtaatggaaaagaattcttttagagttttacctggtacatttgtgcctttaatacattttgagttgatttctacagattgtgtgaagtaatctgctggttctctaaggcttcagtgaatgcctcctctccaagctgcacttgagtcctcccatctgcctgggcctggagcttcttatgaagcctcagctgcaagcagtggtcagtggcaatttctttcaggagagagcctgccttcagccagtctcctgacaaacagcatgctggaagcatcagcccttcccactgcctttgctttctgttgatgacccattcttcatggagagtggtgtttctcttgtccttaactcaactataacttttctctttttacatttttcttattgccatgtaatttggggcagagagtctttgcctaagcatgaacttattgtgccatcctgaccaaagcctgtcatttagggatgtgtcctgctttgtggtgggtcattctgaaattacccgtttcagcccagtggaatttaaccagaactgtgggattgaaactgtctcttgaagaggaactgtggggaaaatgaacaaaccaacattcaggctcagttggagtatgcttttaggctttcccaggttatggagtataaagctaattgttgattcattccttcttggctttacagttgtagaaagagatctggcctaaaatccctataactgggacaggctgagtccaggctctgacattggccagctgtgcgactgggcaatattttgtttcactctctagcctcattttcaataggtaatacatgcaagtagcaggaaattcagaaagtatgcaaatagataggggaattaattttccagctacccattttatcttccagaggagaatacggtaaaaatattctggatatttttgtaaatatatataaacaagttggtattgatttaaatttttctttcatacaaatggtagaatactattctatgggtcatatactgctttttatttagcaaaaaaacttagtgctcttaccattttagtatctaacatcagcttcattatttttcatcactgcataatattctattgtgtgggtataccataatttatttagtctgctccctgttgagtatttaccttctttcaaatgttctgcccataaacaatatgtaaagcttaggtatggctatacatccagcatggatgagtcttcaaaacatactattcagtggctgggtgtggtgcctcacgcctgtaatcccaacactttgggaagctgaggctggtggatcacctgaggtcaggagttcgagacccacctgactaacatggagaaaccccatctctactaaaaatacaaaattagcctggcttggtggcacatgcctgtaatcctagctactcaggaggctgaggcaggagaatcgcttgaacccgggaggcagaggttgcagtgagccgagatcacgccattgctctccagcctgggcaacaagagcgaactgtctcaaaacaaaaaaaaaaaaagaaaaaaatcaaaccaaaaaaaacatactattcagcaaaactccagatacaaaagaacacatattgtatgattccatttatgtactgttcaaaaacaataaaatatgaatatacatacagacatataatttattatttagtgatttcttcttaggtgggaaaactttgaaaataaagcaagaaaacatcgcctgaaaattcagggtagtagccaattgggaggggatgtgattgctggagtagaggcacctgggctgccagcaacgtttaatttctcaagtaagatagtaggtacattgcatgtatgcttcatttagctgtacttttttgcatttatgtcatgttattgttcacgataaaaacgactttaaagtgaagtgaaaagagtactatgcttaagctttttgctcacattttattttacacctgggtctttatccacatgataaatttctaaaggttaagttgccagatcaaatacttttgcagttaaattttgatggaaaataccagttgcctttcacagaaattacatcaatttactccccatacaaaacaagacacaaaatagtgtctgattaccttaccttcaccagcacaataaggcatcatcaaatctttgggttttgatcacctgataaataacggtttctgtgtatgtgtgtgtgtgtgtgtttctgttatagggccctaataatgatttatgtaaatgtgtacagaagtaactctttcaagtggtcaggctccagtgggtgggaaacacctttataaaaaaattgagaaattttgtagtcttattccagcctaatgtaaaaaaaaaaaaatcaagaactgcacaaatgtgatttatgggtattgtatcccaaacggtcccatctctacttaacaaatggattgacccatcctgatatgtctattttttcatttcctaaaacaaatgaggcttaacttctctgacccaaattgtccttgctgtgcttcaagggggacctaggcaaggatgtgggtcaggggcagatggactgaaaacgtgtgcagtgagtgagccaatcatgttttaggaagattaaagctcctgagacagaggactcctaggcagagatggcagcgagctccccagctcaggcttttagcaccgccaactctctggtaaaagcagctgcacccacctcttcccttcactctcacctcctatgttcttgggcatcaaacgtaattttgcttcagagctcaagggcagtgcagcctaaggaaaacttgtaagaattcctcagtcttgaagtcctttgcctgaaaccaaggagagatcaaggcctagggagaagaaggggaacattctctttggaatgctgggtatttctaagcaggagtagggggccctgccctggagggaaggtttgccttgaactgctctgcctgcaccctgccccaaactctgcactctccaggtcctaatccaaacaagtacaacaggaggctgagtttgcagtggagagtgaaatagcatgatagttacaaaattgtcaggacttgtatgtggttggatgctattgtttttatcttctttcattcactgttttctgcagtatcacttttgcccaaatatatttaaagaaaagaattgtatctctactttcaatttaaaactagtatttttctaatacattaaaataacaaaggaaccaattatatattaatataaacaaaaaactaaattaaaaactaacttgggccatgtgtgtctataatcctagcactttggggggctgaggctaaagaatcgcttgaggccaggagtttagaaccaatctgggcaacatattgaggcgctatctctataaaaattaaaaaaaaaatcagccgggcctagtgacatgcatagtcccagctacttgggaggctgaggcaggaggatcgcttgagcccaggagttccaggttacagtgagctatgatctcgccactgcactccagcctgggcaacagagtgaaatcccgtctttaaaaataagaaaaactaatctgtcattctgccaaataaagatgcctctgggaaatccaactctgagtgatgtctcagctatcttctacacatcagttctcaagtgaacccccttccctcaggacatgtggcaatgtctggatatattttgatgttgtcacaatcaggaaggtgttggtgttacaggcatctagtgggtagaggctaggaatgttgctaaacatcctacaatttacaggacaacctccacaataaagagttatgtggcctgaaacatcaagtactcactgtaacgctgaggttgagaatccctgctctacacagatcctctgagcctgatgctccaggcaggcttcctcccctgtaatacccacaacacctgcataaattgctgtgttagctcttatcacactgcaaggtcattgcatttattgtctcctctttacaactgtgggttcctggaaagcaggggctctgtctgatagctatgttttgtaactatgtgttttatgccttatatttttctcagcacttgaacattgcctggcacataatatttgctccacaaataactgccagaggcatgagtttagttttgagacacctaggaaacagcagaaattagcaatgattagtgagataaagagaaggttattaataaagccctccctttattacatcggtccttcctaaaaccccagtgtggatggtaacatgattacatccattttatacataagttaattaatgcttagataatttacatgacgtgtctaagatctcatgactggacagcggactagttgagactctcgcacaacttatctgactttaaaacttcaattctcctattattatgcaaagactgccccttaaatatactcctactaaaagactatgagtggccgggtgcggtggtttgtgcctgtaatcccagcactttggaaggccaaggaggccggatcacttgaggtcaggagttcgagactagcctggccaacatgatgaaaccccgtctctactaaaaacacaaaaatcagccgggcgtggtggcgcatacctgtagtcccagttacctgagaggctgaggtgggagaatcgcttgaacccgggaggcagagattgcagtgagccgagatggcgccactgcaccacagcctgggcgacagagcgagaccctttctcaagaaaaaagagaaaaagaaagaccatgacagacgcctctgccttcaaggtggccaactgggcacaaaatctttcctccttgactcttaagatattgttaaaacgttattaggggaactgaaatccaaattgtaaagaaggatgagtccagtggtgaaaattttccacaaatattagaaatagaaaaaaacccttactgacctatgaaagaaggcagaagtcctagcgcataagaaacgctagagggggctgtagcccagagaaaaccaatcaacctaccaaatagagccccagaaagaaacctcctcctcgcccctccgccttcctctgtgttcctgccgctcctccattccttctttggaagacgcagctcctgcattccttctttggaagactccccccttcaccgaggttacctaccaaatccgccatagggtgtggtccagggtcgagttatcacagacctgtctccccaaggtccccgcgtcgcgttatctaggcagaagcgctgaccccgcatccctcccgtcgggaccccacgcgctgccccagtgaaatgaaatcctggtgcttgtggcgtgcgctgcgcggttccactccgctgtgccttcctttccgcccgcccccgacggctggacgcccctctgtcgattggagcggtccttagtgctacgtgtcctgggatccccaaagttgaccgcccccacagggtgtgccaaagctcatcaagcgccattccagtctcaacctttatcttttacaatttaaaatttatttattatccatgtaaggagaataactggtacactcagcgcagttctgcatatatataggccataaaaggaaatgaagcttgcgtgacactttccgtgaaagcaatagtaccgaactacaaatcaaactgcatcttagccgatctcctgaagaagaggaaaagccttgccaaatgcgtcttcccagcaggatgcaaacctccttcagcaaacactgagtaaatctgggagtgctgagacatagtacaatgcgagttttcagtgtaattgaaaaaattgaaaaaattgaaaaaaaaataactaaattaagattttcgactgttttcaaggacagtactgaggcagcacgtttgcagagtgatatttttcaaaaatgctgtaagaaactataaaatcagctggagatattctgttgaaatgtgtttttctacaaagcagagtcaaaaatcacacgctatgtagtacacaaataaagtggaagctgtcgatacacgtataaatataaaggatttttgcttacacaaaaaatattccaatgtcccaatatgcaacattgctgaacaaatatggagctaaacaagtggcttctaatgaattattctaataaattttactccgataaattacatacttaaaatattatatttaaaaacaaactggagagctgtagaagaaaccctatttatcctcatgtgaagtttgagatttgtttgtaattttttttaaattaatgcaggagagaagtgcgtcgttgaaacaaccacctcgagtaaaacagcatttcttctcaccacacaacaaaacaaaaaccccacttgctgcatttcagtttagaatttattgtgttcactttaagcagggaatgtatcaaaactcaaaatttagcagacgttttaatgatttaagaactattatagaaaatactttttttccaggaataagttgctatatcttaattactaagtaaccccaattcctattgcttttagaacttcccagtttgcttcagagttcaacggcccagtgtgcaaaactgactcgtgaattttgtaggtgatgtggattcaccctgtctagcaggagtctgcagcactggctgaaaaaactgtttctgtggtgcctgatgagagacttatgcttttggcaattgcatacttagatacgtcaccctgtagagccttcactgcttcccaatccacccctcactcccacctaatctctgaccaggagtaaaccctaagatgagcttagaggctcctgtggctaagggcagtgaaatccactaaagtgtgtcagggctgagagaatatcggaattctgcaactgtgccccaaattcaggattctctactttcagttcatcgtggcttttgtggagcagggctacacattgtgggtaatctgtggggtttcagttacctattgcaagacattgtttactcttctcactccatgtcctttatatggtgcagtaaaactctagtgggggctgctggtgctgggtgttggcgggggcctcctacccagcagctgctgctgctgagctctggaagtttgctatgggccatggattgggtaatgtgtgtctaggttctatgtaggaaggctgaccacttccacctggagccatagctcaggaaggaggcagatgaagcagatgaataatcaccagcgtgtctggaaagagtgagacactctggagactcaagggacagtgttggcgatttattggaggtttgcagtgtcacaataggagggtgtttcaataggaggaaaacatggtccaattgaagaaagggccagaaggaagaaaagaggaagatgggctccagtgctagaaaagagagaccaaatacagtcgaaaaagcagagaaatgtatttttcctcaagttcttctgctgtcactttcactgcagatctcagctttgctcttccagagtccctcctttggcactgcactgcagccctctagccgaccgagggcggctcctgttctctctgcagactgcacatccctgtcctcgctcagcgctccccatctgctgtcgctccttccaagtgcacgaatacttagagcttaatccccgcaaacctagtttgcgtgacagtgccccaagccgggagacccacagctcctttccctctggacctctaactgacctgcagcagcgggcttagtactcagctcagcacgcttctggtctctggttcagccttctctcccacctaggcctatggagctactccatctcaggcttctgctcttgtctggggtgcgaatcgtagtgtgtggccacttccccagctcagatcatcattgcctgtccctgggatttctgccaaaatttcccaacacatttctttgccttcagtcttgttctcctccaaagactgcctgcaaccagagaggtctttgtaaaggaaaatgtcatctgtctctctcctacttcaaaactttcatggtccacataatcatctcgattgacacagaaaagcatttaacagaattcaacaccctttctgataaaaacattcaacaacctaggaatagaaggaaactacctcaacacaataaaggcgatatatgagcagcccatcactaacatcatattcaaggagaaagaatgaggaaggctttttctctaccatcagaaacaagacaaatatacctattcaccacatctgttcaacttagtattggaagttctagccagagtaactaggcaagaaaaataaagtaaaacacccaaaatggaaaggaagaagtagaattatctttgttagaagacagcatgatcatatatgcagaaaaccctaaggattacacacacacacacacacacacacacacacacacacacagaggaagagagagagagagcactaataaacaaattcagcaaagttgcaggatacaaaatcaatatgtagcagtcagttgtatttctataccatgccttgcaacatggtgtttcttctagtcctgaagaggcaagttgacccagtccaggtagagcaccgacttagaaagagaaagaaggaaacagctgaaaaaatctgagaaggcatatcaacttgtgagccaaatataaatcataatgtgtgttagattaacgaaatgtactttctcatagtaatacagtatttctaagttctgctcagatactgttactgtgtatgtttctagaaaacacagccccaaatgtgcatagtcttgaatacaaaagaatcaaaagccatcaatatgtggtataaatccttaaagcattttaattgctaaaaatacatgccaaagtcacagtaaacaacattgctctgcaaactataagatataaataatttgcctctctataataattttactcacaaattactacctgagtaatctcgttaatcgtccctaatctcatcctaatccccagaaactgtgagtgttgccttatttgggaaaaaggactttgtaaatgtgattaagaatcttgagagagattatcttggatttgctgggtgggcccaatataatcacagtggtccttatcagaggaggcaggaagtgtcagagtcagaggagaagggaatgtgatgatgccaggagagactgaagtgattcattttgaaggtggaggaagggcttacaagccaagtaacataaacagccttagaagctggacaggattggggaatgggttctcccctagagcctacagaaggaaccagcccatctgacatcttgattttagtccactgaaagtaattttgagtgaactgaagtccactcaaaattattttaatttgctgatttcaagagcggtaagtgaatacatatgttttatattaagtcaccaaatttgtggtaatttgttataacagccataggaaactaatgtactactttggtagtctggaagacaacccttccaaggatatccatgtcaaatccttggaacatgtaactattactttatatgacaaaagagtgaatattactttgtatggcaaaagatatgattaatttaagaatgttgagaggatgagctagcctggagtatctgggtgagccctaaatgcaatgacatgtatttttataaaagacaaggagagggaatttttaaaaacttttattttaggtttgagggtacacgttgaaggtttgttacataggtgaacctgtgtcacaggggtttgttgtacaaattatttcatcacccaagtattaagcccagtacccatagggaatttgaggttcacagacacacagaggagaaggtgatgtgaagacagaggcagagattggagtgatgcagccacaagccaaggaatgcctgcagccaccagaatatgacagatgcaaggaactgattctcccctagatcctctggaaggggcatagccctactgagatcttgatttggggctcctggcctccaaggttgtgagaagatagatttctgttgttttaaaccatcaagtttatggcaatttgttgcagcaaccacaggaaactaatacaactatcacaatctaatgtttaaaaagcaattaattggatggttgtaaggcaaaattatgtatctcaaatttaaaagttgatacctgtttgcaagaaactcattaaatgccaaagaagtacttgattcaaacaagttccttgaattcaaaatcaattatttgtatctaaaagtataaattgcgttctatctgcatcaccatatgttaacaagacaatgcaaagctcaaaatgtaattttgtattattttaagtatttgtgaaacattatacaaattaaataactttgttttaaaaaaacagaaacatcgctgtgctacagtattccaaaacttccaaagatcctactacccacttatgttgttattagacattataaatttgctttttgattcaaaaatttcactgtagtaaacagagctatttgttcctgaaaactaacttttagggtttgtaccggtgagaactttctccttcaggagcctgcagtatgtgtgggcaaaatcagattctatgatgcctggtatggaacttctgtttccttcagggtgacagagggtcatattgttctctgcagagctccaatgcatccccatcttcaatcccgccaggccaaaagcaatccctaagataagtctgggtctttgtggctgatgtttgtaaactgtgttgaacctgtaatgaggccttcatttccctttaggctttggttaaaagtgtgtcacaattgtggatcaatgattaagttaaacttctcatgaagtggcagattatatgctgtgcctggtggtgaggtttcaggtttcaggttcctgctgctaaagctctgcatcccttccactgcaggcccttacttggggcaacagtacttgtcctgtgaggacctgtcagtgtcacccccagtgctggtggtgctcaatggttgttatggaaaccagggattaggtaatgttctctagtttctacataggaaaactgatcacattcaactgaggaaacattgctcactaaggaaacggatggatccccaccaaactttcttgaacggcactcaacattggtccctcaatgtcagactacatgttcaacagagtaaaatatgcccctgggattctctcaagattgctcaaggctttgctttggtatgtcatcattttatgcatcattgttggaagcgagaaaagttttaacaattgtcatgttatatccagaggataaagctgaatctaatatctagatttctatgtatcaactggcaatgtttgggaaccggcaatacttaagaaccttataaagtcagggctttgaagtgtactttaaaatagatttcccatcctctgaagtacacaaacatctttccaaaggcacctaacccacaaggattcctcttgatagaaccagatgtgaagttgctacaaagaaatgatggtgtatgagaaaccatgacttcccagggtctgcgtttgctgaagtcactgattatgaagtcattttctctgtgggtttgggtgttaggaagaatccactgtgactccattgtggatccatcctcactcaacattcagaaaatcagcagcacatttggtcaacacggcatctttcccttgcactgctggatggagctagtccaggcgacatgaacttctttctctcactctctctctcttttttttttttttttatacaaagtcttgctctgttgccaggctggagtgcagtggcatgatcttggctcactgcaacctctgcctcccaggttcaagtgattcttctgcctcagcctcctgagtagcccatctaattttgtatttttagtggagacggggtttcaccatgctggccaggatggtctcgatctcctgacctcctgatccaccctcctcaccctcccaaagtgctggccttttcccttttgtagtcttcacagtgtcttttgatcttgggctccacagagtggcatctacaggtcatagttgtcagtgactcagggagaccaggaggtggcaggcaagtgaggggaacccagaagtagccagtacctgttcaatgccagaaaaacctggccaggacatgcccttcagtattgagggacacagtggcagctgtggtgagaactgtggaaaccagcataaagctgaattataaatcagtatatgtggtccagtacagactgcttccaggctctctgtggtcacaatcacaattagaattggattataattaaatccaagtctctctgagcattatattgtcacagtctatcactgtctctagaggagattaaataaatatttttggatctatcattgatgcattatcaatgattttgtaaagtaaattatgaaaacctaaaaaaatgtctcctggctatttatccttcacttgccagtcactatgattgtctcttcccattttcctgttcttctcagggtgtttctgggaccttcagtagaaattctcaactccaggttttcagctgtttctgcacagaggacatagtcctgtcccaaactctctagtgtcacacacacacacacacacacaccccgtcctgagaccccttcctttctctcaagtttctgggatcacatcacatgtcccagtggttgtacctccaggattttgaagtgtctcatctcctcctgctttcctaaggagaaaggatggaggaaaggagcctggtctcttcaggatttttttcatatttaggcccttctagcctgggaatgaaaggacaccacacattagtgagcaattatggaggcaccaagagacgtcatccagcaactgtgcatgggagggaggttcaacaggaggaccaaagagccagatcatagaaaggatcacgagaaaggagtgggggagctagcaggttcccagtggcaaatcaattacagagtagaccaaatgcctgcaagtgtgcagaggttctgagccaggggttattgtcttgtgcatcttctagctactttggatttaccttcccctacatgactcccacaacctttagctgctgcacatcttgttgagtgacaacctgcaattctactctactctgggctccacactgtgttgcccaccccgtcctagtgccagaaacatggaaaatcccagcccaggggctcccttgttcactcccattctgccccttcactggggtgtgcaggtgttagacctctcctctgctccacaagtgggagcttcaggctttcccgaccctgcccccgagcctttgtagctgcaccatctctagtgcctgtcctcctggatcccagcgtagtctccacagccctagatcttgtcactctttctgttgttcagagttcttcaaaatctcccaactcattttattgcctccagtcttgctctgacccaagcaagacttgggtcagtgccctacaattgcaggaatcctgctgaaacaaaaatccacttttgtttctttcttacttaaaatattttaatgactcactattaacctcaggataacacccaaattcttaaccaattttcccaaccctgtgtgaacaggaccttgcacacttttccaattttctctctctctcctcttgcactagccagtgattctgcttacagtttcacaaacatgctgcaaagcctttcattttttggtcggactaggtgttccctttgcttgggtctgcctaattcctgctttttttttttttttttttatacttggattcctgttggaagtttagcctgctttcctgaaactggctttgctcttcctcctttcttttctcacagatcctttccttccttctcaaagcactttttgtagtagcttctattcatctggctcatgtatttctttctcactacactgtaacttcagaacataaatgcctatgtttatgctcctcactgttctattttcaaggaggagcacagaagctggcatattctgggccttcaagctgtatttgttggatagatgaaaaatagggattcttacagtaacaatgcacactgagagtgtctctccatagtgagagttcaagagacaacacatacaaatttaaaaaaaatttacttttaaaatgtgtaacattaggtatgacactaaaaaaggtgtccatctcccctactggacaccaggatcaatgaagacagctacactggcttacttacttttccctcaaacagtctacgtttgatccctgtttgttgaaatagtgattcacataaaatggatgagaaaatggagacacagagaagtgaaggactctgtctagaatcacacagctgtcaaactctcgggcttaagccatttccatgcctctgccttccaaaatgctaggattacaaatgtaagtcaccacaccagccagcatcatataactaatttgttattgcttaaaaaggaaaaaatggaaagtgagctgatggagaatgaaatatggacagaggaagatgatgggaagctttgaagggctgcccttgactctgtgtgtgtgtgcgtgtgtgtgtgcgtgtgtgtgtgtgtgtgtgcatgtgcgtgccccttattctctcttaagctacgtctaacctcatagggatcactggggtccctgtcagccacagccacacacatccacagaaaccttgacctattgacagatgtaagagggtggcctttgagagttctgaatccctacctcataggattctggatatctggacactttcttcttacgctgtttctgcatcgaccttagggactgtgtttggggtgtttcctgcactcatcttgtgacagagttctatttgctcctcagatggcctcttttcccttggagtggaaccgtggctatcagggtcttgggccgagcatccatgagtgactgtgtgagttgctagaagcaatcttatactttcatagccaccccacacttcacagtgatactcatctctaagaaattattcaaattaagagagaaagctacacatataaacaattgatggacttgattgattaacatggaaaagcattaactttccagttttctgcctctcactggaattttatccctacactttgaactcatttcaaacttctggcttaactaggaattgctatagtcaggctattctagacagctcctgtgagccactaggattcagagaatacaacacatcttttccaatttaaatatgtagttctagaaaaaaactattttaaggtcaggcttggtggctcatgtctgtaatcccagcactttgggaggccgaggcgggcagatcacttgaggtcaggagttcgagaccagcctggccaacatggtgaaacccagtctctactaaaaatacaaaaaataaaaataaaattacccaggtgtggtgacacatgcctgtaatctcagctacttgggaggctgaggcataagaattgcttgaacctgggaggtggagtttacagtgagcccagatcatgccactgcactccagcctggtgacacagcaagactccatctaaaataataataataaataaacaaataaaaagaaaaagaaaaaactattctaaaattcatatggaaccaaaaatagctaaggccatcctaagcaaaaagaacaaagctggaggcattatgctatctgacttcaaactatactgcagtgctacaataaccaaaacagcatggtattggtacataaacagacacatagaccaatggaacagaaagagaactcagaaatgaggctgcacacctacagctattttatgtttgacaaacttgacaaaaacaagcaatggggaaagaattccttattcaataaatggtgctaggataactggctagtcatatgcaaagattgaaacggggcccccttccttacaccatatacaaaaattaactcaagatagattaaagacttaaatgtaaaacccaaaactataaaaactctagaagacaacataggcaataccattcaggacataggaatgggaagagatttcatgatgaggacaccaaaagcaatgacaacaaaagcaaaaattgacaaatgggatctagttaatctaaagagcttctgcacagcaaagaaaactagcaacagagtaaatagacaacctacccaatgggagaaaagttttgcaaactatgcatctgacagagatctaatatccagcatctataaggaacttaaagaaatttacaagaaacaaccccattaacaagtgggcaaaggaaatgaacagacacttctcaaaagaagaaatacatacaaccaacaatcatatgaaaaaagctcatcattgattattagaaatgcaaatcaaaaccacaatgaaataccatctcacaccagtcataatggttattattaaaaagtcaaaaaataacaggtgctggccaggttgctgagaaaaaggaacgcttatacactgttggtgggagtgtaaattagtttaaccattgtggaatacagtgtggcaattcctcaaagacctaaaaacagaaataccattcagcccagcaatcccattactgggtatatacccaaaggaatagaaatcattctgttataaagacatatacatgtgtatgttcattgcagcactattcacaacagcaaagacgtggaatcaacctaaatgcctaccaatggtagactagataaagaaaatgtggtacatatacatcatggaatattatgcagccataaaaaagaacaacatcatgtcctttgcaggaacatgaatggagctggaggtcattatccttagaaaactaaggcaggaatggaaaaccaaataccacatattctcacttataagtggaagttagattataacacatggacacaaagaggggaacaacagagactggggcctattggaggctgggaggagggcaaggattaggaaaaataactaatgggtactaggcttaatacttgagtaatgaaataatgtatacaataaatccccatgatacaagtttacctatataacaaacctgcacacggacccctgaacttaaaataaaagttaaaaaaacataaaggtctagctggatcagtgggcttctaggatccttcttcagtaatactgaggtaaatagcacaaaccatgagtttactcttttcataatccatgacacatcacacttaatatttgctgagtttaaacaagtctcttaaacacatcactagtttacatcagctgtggaatctttgctttgtcaatcaggggtcaacaagcccatctacacttgccatcattaactaatgtgcaggattgtgtcttatcaaatcagcagccaccttctctgccgagaagcaaggagtatgtctcccagaatccccttccctgtgtagttccgattcacattttccaatcagagaaacttgcatgagatatggtgcccagaagagatggagagacaggcctctacccatcagtcgtggctgcaggcagaagagtaggcagatgtcaggttctcagtggcttctgtgctaggccaaagacccatctgctttgcctgtgcagaccgagatgaatggtgggagctttctcagaggttctggagaatgacagcaatctcccagcagggttctaggaacctcccacctgtgcttcaggctaagttcttcagcacatgcttccctgacctcccagctgcagcctccaagagctacaatggtgactggtattagtattctgtttctgctgtaacaaattactgctatgaagtggcttaaaacaacgcaaatttattatcttacagttctggaggtcagaagtctgatatgggtctctctggcctaaaataaggggtcatcagggctgcattcctatggcggctctgagggaaaatctgtttcctcaccttctccacttcttaaggctgcctgcattctttggctcgtggttccttcctccatcttctaaagtcagcagtcccatcactttgacctctgattctgttgtcacatctccctctccaattctcactctgctgctacctttttcacttataacgaccattgtgattgtattggacctgcctgaataatacaggataatcttcccatctcatgagcctcaacttaatcacatctgaaaacttccttttgtcatattaggtgacattttcacaagttccaggggttaggacataggcatcttgggagacctttattttgcctacaacatgacttcaccaatatttgctctcctagattttccaacattagtataggctctaattcctatattgaacacgttattcctaaaatgttatactagagtgtggtggttttcctggaaaaagctacactaatacacttccttacctcagaagagctcaaaagttacctttctattatcttttttttttttttttttttttgaggggagtgtcgctctgttgcccaggctggagtgcagcggcgcgatctcggctcactgcaagctccacctcctgggttcactccattctcctgcctcagcctcccaagtagctgggactacaggcgcccgccaccatgcctggctaatttttttttttttttttttttgtatttttagtagagatggggtttcaccgtgttagccaggatggtctccatctcctgacctcgtgaaccgcctgcctcggcttcccaaagtgctgggattacaggcgtgagccaccgcgcccggcctacctttctattatcttaaagtctccaaatggtaccaccatctcaaggtgcaatggctgtaatttaagcaacgactttgcgggggtgatggagggagacaaaaagaaatgactggaaagcacttctgattccatgccctgtccctggtgtctggccgtcttggactctaggctgcagtttctctcctacataaacccagtcatttctgagtctccaagagtgttttataggattcatgtccacttcttggctctgtcatcttctctctaccttgtcttatagctccgcgcttacattttcttctcacctactgctatagtcctgccttgattcttcagccattgtcctctttttaccttgtgtatgcttaagccaattctccaagaagaaattccagatggctctttattgctgtttgtttgttactattttttatttggctgaagagttttcaagattcttaactttctatttttaaaattttagtgtacaaataatacatgctcagagttggaaatgaaatcatcacaatatgtataaatatattttaaaatatcttctatctctaaatctatgcccactttactaaggtaatttatgttatcaatctactctctatgtgtctactttctccattttcatacaaacataggcacctatattaagtgttgagtgtttttactttgtagcttttttttagcaaaagtcctcaaattttatttgtagtttaatcattttacaacaacttgagatataatttacatatcataaaattcacacattcattatatacaagtcagtggtttttagtatattcacatagttgtgccaacattatcattatcaattccagaacattttcatcaccccacaaaaaaccccatacccattggcagccactcctcatttcctctcaactcccctagccctaggcagccactaacctgtgttccatatctacagatttgcctattctggaaatttcacgtaagggaaattatacgatatgtggcctttcgtgtctggcttctttcacttaccgtaacattttcatggttcgtctgggttgtagcatgtggcagtacttcacgtcttttttattactgaataatatttcattgtatggatatatcacaatttgcctattcatttattagttgatggacatttgggttctttctattttgtgctattattaataatgcagccgtaagcatttgcgtataggtgtttgtgtggacagatgtttttgtttctcttgggtatgctgtatacctaggaggggatagctgggtcatatgctaacttagtgtttgacattttgaggaagtgctggcctgttttctaaaggggcttcacctctttatattcccaccagcagtatatgaagcttccagtttctctgcatcctcatcggtgttcattattatctttttattgtagccattctagtgggtggttacaactaagggaaaaaatcaaactttaaagaattaacttagttttatttggaaatcttactgaggactatagacggaggcctacaacccaagaacagccctttagagaggctctatcagactgtaccagctcagtatttcagcccactgcttatattataggtgttctgtattgcaacatcacatcacacttggtaagaagttacattaaagcagaatcacatcaaagtttggaagcaggaatacgtccagtgtagattacagaagcatgatcactatgcccgtcagacattatcttatgtgcagggaaaagcaagggcattcatcttttaaggaatatagtggcttaggcaagagacgttgggggctgtgtgctttatcctgttttgtcctcaaagcatctttccagagagttgcacatcctcacgatgaactaggaggatgtgcaactctcacagggactttgtgaaattatgctggcaagtaaaagtcagcttctgacatttactactttgtctcacagtgtgaaatactatcgcattgtagggccgatttgcattttcctgatggttaatgatgttgaacatgtttccacgtgcttattggccttttgtatattttcactggagaactgtaaatccaaatcctttatttttaaatttgattatttgcctttttactattgagttataaccggttttatatattatagacaaaattttctcttttaccatatgtatgatttgcaaaaattttctcccattctgtggggtttttttttttcactttcttgatggcatctgtaaacatacaaaagtttttaaatgcgatgacgtccagtttatctttttcttctttttttgcttatgcttttggtgtcacatttaagattaggtgcctttacttaatccaaagccatgaagatttatgcctatgttttattttctttctttctttcttttttcttcttcctctcttcctcccttccttcctccctcccttccttccttctttccttccttccttccttactttctttccttttttttccttgagacacagtctcactctgtcacccaggctggagtgcagtggtgcaatcacggttcattgcagcctcaacttcctcaggctcaagtgattctcccacctcagcctcctgagtaggtgaaactacaggtgcatgccaccacacccggctaaattttgtattttttgtagagacagggttttgccatgctgcccagtttggtctaccaactcctgggctcaagcaatctgcccactttggcctcccaaaatgctgggattacagacatgagccatcgtgcctggcctgtttccttctaagagttttctaatgttaactctttcacttaggtctttgatacattttgagctactttttatatatagtttcaagattttcatttttcatttttcattcattgatactgtatagaaacacaattgatttttatattttgattttgtatcctgccaatgtgataaaattctttagttgtaatgcttttttaaagtaaattcttttggatttctatgtataagatcatatcatctgtaacgaaggtagttttacttctttcttttcaattcagatgagctttattttattttcttgttcattgtagcaaaaaattcaactattctatttataatgccctgttacttgatgttttttatttatattgtgaacatctcaccaatttcatagagaaagcttgagctcatcattttaaaccctaattccatagtattttgcatgcaactgcttctctagtgtaaatattcagatggtttcctttagttgtcactacactgaatgtccactgcacagacatctttacacacatatccttacagccatcccagagttttctgatttcccacagcactacatgatagtggttaatctgatgatctaactgactagctaggcagactgactgactgacaatcccattgcttctgtatataaagtcagtaactacatttggaactcagcttctctaggcccagccacgcttactttcctagtcttagaggttccctctctgcctctaaatttctctgtccctgaaaccacccttgtactccagcccaagagcgcttgcaaacaggtagaaggtatcatctggagaaggtaagtaagagacttatctccattcccttcatatctaattaccaaatcttccatctagctcagtcaggttgagttgaaaacatcttgactttagtcatttagccactgagcacatcatagctcttttcatacctcagtcttattcaaatatttaatttatcaagctcacttataaatgccaagcctctcatttggccacctctgaccctacagctccaaagcccctcccattttgagaacatgctcttgccaggccagtctcctcattgccccctgattatccatcactctgtccgtttctgcgcctttgctcattctgaacttcttgtcaattctcaagtgtcagcagccacctctagttgcaacagagtggactttgcttaatcttattgccctctcaacctctctagggcattctataggtagaatcctcctttttgtggtccctaagttggcctggatattacactctaaagtctagaatgcagtcatgccaaatcccacggagaaccttttataagtaactatttctggccctctcctaggcctacagaatcaatctccggaagcagaacacttcactcttaaaaattcttgggggattgtgagcagctagtcaatggatctggggttggtgtccaccataccacactccaagtcctcctagtttctgctttcctcagtcagttaatctgcgagctaccttgcttctcatcctctcttctgtgagaggtcaggcaccatgttctggcagttttcccaaacattcctctacattcttagccccactggtctcccctcacttatggaccttttatcattttatctaacggataaaggtttgtgtttatgttcttgcttatgcttccttccatcccttccaaattttaaccttcgtatatgcatttatttaacaagtattgacagcttactaattggaggaattgcattaggtgctatgattcaatttccccaaacatgtttttcatattcttatatgtatttaaaaaaccactgcatcggggtgacagaataaggttttaaaattctaatattagactgtccactacattgtctcagtctatctttctgttcagtcagttaattattaggataagaagataccatcaatctgatttttcccccatatttttaaaggagaggagagagaacaatttggaaggtcaagaagttggtatgcccaggagctcacaactctcacctttggggttttatggaatatttttaggccttatttatttattagtaaaaaaaaaaacagaataatgagttcttctctgacaactgtacaggattgtaaggatcaagtgtgtttatgtgtatgaagcaccatgaatattatatataatgtaattgcaatagaatatatatagaagtagaaatcatactttgaaataacaagtggcagaaatatatattgaaaaatattagtggaggatgtcacaaagtttgagttacttgtttttcatttcattttaaaataagcatatctgagtatgatgagttctaaggattcctttcagggcaaaaattgaggctaccccattgcagttgtccagtctttccacaggatggcaaagtatagccagtatttctttgaaatgtttgcttgcttatgccactaaattttgaacttagccttctagaaatgagtttataacttatctttcttgaaggtaatctcagagtacctatgaaaagacatctataaaatacttttgcaaaaatacctaatacatcaaatgtgtgctcaccacatctcatcaaagcaaagtgtaaaacgttctcagggacctgtagagctaaaatgtcaccttctatgttcaagatatatgttgaattctatgtccgatttcttctcattattggacttaattctgtaaaacatgaggcttgaacttttcatgaactgattggtgcatcctctgcttaattgattcttcccatttgacttggaggatggtgttggccagaggtccttttttgcggaggcctttaaagatatttattcagaagaatgtaccacatgaggcatttgactaataaaaacactgttattaacactgacaataagcaaacacatatttctttagctgtcttgcaattggtacattctcctcttcccattgaggaagtatctgctctacccttgcttcagattaaacattttgaaactctcagttttaacattattgagccttactattattgaaataattcttttcccaaaacaccagactacactcaaactccagaagatgcccctaaccaagactaatattctgacatcaaaggaaatctgtggataagatattgggaacttctgaaaaattttagtagggctatgcctagagaattttcatgatcttaacaaatcttgctcattcagcaagtccttagagagccttcatgggaacctatgaaaaagaaagtcctcaatgtattacatggaaaataacgatagcaacaactataataataatagtggctgcatttaaagggcacttgctgtattccaggcattggcttaagtacctacataagttattttgttcagtatttatcacaaccatatgaaaaaaatgttcttatccacaataaagaaatgaagtttaggctgggtgttgtggctcacacctgtaatcccagcactttgggaggccgaggagggcggatcacctgaggtcaagagttcgagacaagcctggctaacatggtgaaatcctgtctctactaaaaatacaaaattagctgggcttggtggcgggtgcctgtaattccagctacttgggaggctgaggcgggagaaacacttgaacccgggaggcagaggttgtggtgagctaagattgcaccattgcactccagtctgggcaaagagagcaaaactctgtctcaaaagaaagaaagaaggaaggagggagggagggaaggaaggaaggaaggaaggaaggaaggaaggaaggaaggaaggaagtaagtcaagaagtctacaaagtataggtaacttgctcaagaaaattaggttcagaaagtttaagtaacttgcccagggtaacacaattatgaagatttgaggccagaattcagttccaggcagttttgttctagatctattgctcttcagccactatagtgtcatgccaagactggcctaaagtcgtgtcttctgctcaaacaggtccttctatggcaatgaccatgaaatacatggctaataaagtattaggggcaggaagagggggaagaagaatgcagtatttgagactatggttactgactatatttaaaatcacagtttcatgactattaaggttctttttaaacttttctccctgatgtatcatggtatccaggtgaaagaggatctggctccctacatcccaggacgtgtagaactgtccatggttctgaaagacaaactagcaggtcccaccacctttacaaatggcaatcttactgtggaaaactgcactagtgaaaactctacatatgactttgtacatgcatcacttacaaggattcagcaatccttggaaagatgacatagaaagacccacagaatattccctttatatgccctatactaaaatgtacaaagcaaaatcaaattagacaacactatgatttagaagtttatcttgaaattttagatcagaatgtaaagaaaagaaatccagcattattgtatggacaagagagaatggatatagattttaactaactatatattccctcaaaactcatatgctgtcctttttaacctcaccttaatttaaatttaaccacacatttactttcatttttgatttttattttgtatttatgttttcttttatcttgtatcttccaaccaggatttcgccttttgcctgaagcatattctttagaactcccttcagtaaaagcgtgtttgtgtcaaattgtctttgcttggaaaaaatccattgagacttgatttttatattatcatgtatttcatttctaaatgttttatatttgtcttttcaatttttcctgaacattatttgtagtttctgattaactggaagtcttttaaagcctgttttttaatcacaggaagcagggctattttatgtcttattcttattattctgctgtatggtgtttctgcttgatctttcatggtgacttgtatcttgtaaatagttttgttgttgttttcctggtaagtgctcattttgcttatggaataattttaggaaattttaagtgtggttgatgacatcttcctccagagaggatttgtgtttgttttgcgtgttatttgcgtttgttttttgacaggttccttggagcctggcccactataaactgaattcacaacttgatgattgccagacaatccaggtagtgagaacttgggctgcaaatacatgtgtggggccattgtgtttactcccagttccactcagcaccaaggcagctgttcctgcagtcctttgagcatggggcatttctcttacaccgaggaactgaacttaggggtcccagcaaaatggaggagatcatcctaggagatttcccactttgagtgctacttgagacttgcctcctattccaaattccttatgaggccatggaaactaaagcttaacttgtctacattgagcaaatgagctcaggataaaagtaaattcagagcttcctgatatttattagacagttttcactgatgtgaaagcctctcagtgcttttatgatgtattttatcttttgataacccattttttgttagcatgagagtaggcgtagatacctaatatgccacattagtggttcacaccttatccttaaagctccttatcacaaaccttcccatcttgttcctttgaagtcattgaatacctgagcaaactattagtcactacccatgcattgatgaggatctaacaataagatatttctttaggcaaaatgaacttccagatggtctgattgaaaatcttcctgctggaggtactttcctttccactcttctttatgacaattcctgaaaagggctgtaatgctgcaaagtacacttttgggtattcaaagcatattcaaatttcttcttctatagtcaacagtccttagggaactcctcaagaccccaaggatgagacaagggagagtggatttaccggtggtaataagaatactaggaatatagtacatattatgaggcaacttagctggccttgctaaggaccagctcaggtctgatactgtatgtatatacagtatatatatccacttcctcctgaatgctcactgagtgctggtgaccataagtgaataaataaaatccaggtcatggtggacatctcaagtcacttggtcatttgctgtatcatgatcatggcattcagaatctaccagggctcagtagcaagccaggaactgttatttagtagaagaataaagaataaagcttttcttcgaagccctggaacttgagcagtgagctcctatgcctgtttcacacacacacacacacacacacacacacgcacacacacacacacacgcgcacacacacacacacacacacacacacacatatccaaggaagcatttaggccaaatggcagatatgtttgatgcctgcctggatcagaatgacatttccatttcttatggaatgttttgaacttgtactaacttaccggattttggtgcagagaaatcccctcacaagataagaaatcacattttttctttgttgaaattatttatcttcattaacgtttaataacaccggtgcagttatttttcaaagagcttgtactccaatcttggaggaattccttgagttgaaaagcccagggcctgaataatgagggagtctcatttccaacagcttccaatcagctgtaggattgaatgaagacacatgtgattgcatgattttaagagagggtaggggagaggggcagtgcttgtttcacacttaactgaactacttccttggcctccactcaaatttaactgcagcattggtgacttgatttacagagtcagaaatttcctaggtatggaatgtgctgtcttaaatagtaatgagtccaatctatgtagagtgtccttctttatcattgggggtcatatgaagtcagcgattcttttagaaatttggggttacaaacagaaggcctcaacttacttcaatttgaaaaacctgaacaaggaatctctggtgtctggatccttatttgtctcacaaaattgaattgtgagctgtgacattttctcccaaaagtctcttttaggacagaacttctggtaatggcaacatgaacaggtagatcagcaagtcttcctctaaatagcaatatgagaactggacaaaatcataaaaataaatatttgaagtcactggaaaacaaacaaaggcgagcagaaatgtaatagtgctttgatcttgagactatctattgggtaaaagctgcaagttggtggcctttcctccttacctatgagtttgctccaaactcccagcaggtaactgcagccctaatggatcaatagggcagtttatagagttaaaagcccaaataagctaaaaatgtttacatttttacatgtttacatcagtcaggcaattttgaaagagatctgctgaagaattcagattcaaaatctgaatacaaactatgctcacatccctggttgaacactaaactccccatgggtgtgggacactcaggggaacctggggaaaaatcagaaagaacctagagtgaggtctacccttgaaagagtgaaataatcctggcaatatctgaaagtctgcagtaacatagactgcttgcatttgtcaacctgcatacaacacaggcagaagaaagcaaaaatcttactggactgaggggtgaaaaggcaggatgcaggacaatttagaggggattccagaagcaaaacaaacacagagaagctgaattgcaaaatcttagcagaaatagccccagtacttgttagtccatgttgtgttgctataaatacctgagagtgggtaatttataaagaaaagaggtttatttggctcatggctatataggttgtacaaacatggcaccagcatctcttcagcttctggtgagacctcaggagccttttactcctggtggaaggggaagggggaccaggcatgtcacatggcaaaagaggaacagggtgggaggagccagattcttctaaacaaccaactctctttcaaaataatagagcaggggccggatgtggtggctcatgcctgtaatcccagcactttgggaggccgaggcgggtggatcacgaggtcaggagttcgagaccagcctggccaatatggtgaaaccccatccttactaaaaatacaaaaattagcttggcatggtggcatgtgcctgtagtcccagctactcaggaggctgaggcagaagaatcacttgaacccaggaggtggaggttgcagtgagccaagatcgcaccactgctctccaggctgggcaacagagcgagactctgtctcaaaataataataataataataataataataaagcgaagagaacttacttatgactgtggggagggcaccaagccattcatgagggatctacccccatgacccaaacagcttccactaggccccacctgcagcattggggattacatttcaacatgaggtttggcagggacaaatattacaaagatgcagagtagacacccagagccccctgctgaaaatgcagcaactggatatcggtaaacagagcagagacatcagctgtagccaactgcaggggtaacagatttcacagttaccagtgcagggaaagttaaccacgttcactgaggggcaggggtggtggtggtgggagaattgccatctttagagagattgttgtagattccagactctctaaaacaaaacatataatgtccactttatcaaataggatcagacatagaaagaaaagaaagaaatgtgtgactataataaggaggaaattaaaaataaatgggtttcaatgggtccagatattgaaattatcagcaaactctttaagacagttttgaaaaatatgtggaaagaaatgaaggaaatatcatttctaaagagtgaatagaagtaattgcagcagagaaatgaaaactatagatggtactaagtggaaattctcaaactggatagaaaaataatgacagtgctctggatgaggtcaacagaagttttgagatggcagaataaagaatcagtcagtgtccttgaatataaatcaacagaaattgtctaatctaaaaataaaaaagagtgaaataagattaaagaaaagtgaagaaaacttcacaaaccctcagaaaatataaagcaggtaaacaggtgaccaattggagtcccaaaagaagatagacacaggatcagaaaaaaaattcaaaaaaatctatggctgaaagattcccaaatttgatgaagaattttagcttatagatgtaagacactcatcaaagctgaatacccacatagaaaatcataggtagagtggccatggccttggctggcctgagggtgtgtcgctagccctgctgcatgtggtgtggtgcagggtgccagtgcctggtgggaccagagagctcccagcacagcctttgggcaggtgggaccgccgatcattttaaaataattttttattgatttaacttatattttgagttcaggcatacatgtgcaggtttattatataggtaaacttgtatcatggggtttgctgtacagattattttgttacctaggcattaagcctagtacctattagttacttttcctgatcctctccctcctcccagcctccactctctggtaggccccagtgtgtgcagttcccttctatatgtccatgtgttctcatcatttagctcccacttataagtgagaacatgtggtattcggttttcttttcccgcattaatttgctaaggataatggcctccagctccatccatgttccgcaaaggacaagaactcattcttttttatggccacatagtattccatgatgtatatgcactacattttcttaaaagagagcaggagtggctattcttatacaaaacaaaaacagactttaaagcaacaacagtaaaaaaaaaaaaaaagacaaagaaggacattatataatgatagaatgataattccaacaagaagatatcacagtcctaaatttatatgcacctaacagtggagctcccagctttataaaacagttactactagacttaagaaatgagatagacagcaagacaataatagcaggggacatcaatactccactgatagctctagacagatcatcaagacacaaagtcaacaaagaaacaatgatcttaaaccatatcctacaacaaatggacttaacagatatttacagaacatttcttcccagtaactgtagaatatacattcttctcatcagcacatggaacattctccaagatagaccatatgatagacctcaacacaagtctaaacaaatttaagaaaactgaaatcctataaagtatcttcacagaccagagtggaataaaactggaaatcaactccaaaatgaaacttaaaaactgtatgagtacatggaaattaaataacctattcttggatgatttttcagttaacaatgaaatcaagatggaaatttaaaaattctctgaaatgaatgataatagtgtcacaagtaatcaaaatctctgggatatagccaaagcagtgaaaataagaaagttcatagcaataagtgctgacttaaaaaagcctgaaagagcccgggcacagtggcttatgcctgtaatcccagcactttgagaggctgaggcaggtggatcagttaaggtcaggggtttgagaccagcctgaccaacatggtgaaaccttgtctctactaaaaatacaaaaattagctaggcgtggtggcacgcgcctttaatcccagctactcaggaggctgaggaaggagaatcacttgaatccaggaggtcgaggttgcagtgagctgagattgcgccactgcactccagcctgggcaacagagtgagacttcatctgggaaggaaaaaaaaaatctgaataagcacaaattgaaaacctaatgtcacacctcaaggaactggagagataaaaacaaatgaaacccaaagccagcataaaaaagaaataataaagatcagagcagaaataaatgaaactgaaacaaaaataatacaagagataaatgaaaaaaaagttgggtctttgaaaaggtaaacaaaatcaatagaccattggtgaggttaaccaagaaaaggagagaagatccaaataagctcaattagaaaacaaactggagatattacaactaataccacagaaacacaaaagttaattcaaggctactatgaacacctttacacacaccagctagaaaatctaaaaactgataaattcctggaaacatacaaccctcctagactaaatcaggaagaaatagaaatcatgagcagaccaataacaagcagtgagactgaaacagtaataaaaaaaactgtcaacaaaaaaaagcctaggaccagatgggttcccagacaaattccattagacattcaaaaaattggtaccaatcctactgaaactattccaaaagatagagaaaaagggaatcctccctaaatcattctatgaagacagtatcaccctaatgccaaaagtaggaaaggacataacaaaaaagaaaaatacagacaaatatccccaatgaacatacatgcaaaaatgttcaacacaatactagctaaccaaatccagtagcctatcaaaaaaataatacaccatgttgaagtgggtttcatcccagggatgcagagatggtttaacatatgcaagtcaataaatgtgatacaccacataaacagaattaaaaacaacaatcatatgattatctcaatagatgcagaaaaagcatttgataaaatctagcattgctttatgataaaaaccttcaacaaaataggcatagaagggacttacctcaaagtcatgaaagtcatatatgacaaactcacagccaacatcatagtgaatggggaaaagttgaaagcattcctccaaggactgaaacaaggcaaggatgcccacgtgcaccacttctattcaacacagtattgcaagttctagccagagcaatcaagcaagagaaagaaataatgggcatccaaattagaaaagaggaagtcaaactgtccctgttcactgatgatatgatcgtatacctagaaaatactaagactcatccaaaagacccatagatctgataaacaaatttagtaaagtctcaggtcacaaaatcaatgtacacaaatcaggagcattgctatacaccaacaacgaccaagagagaatcaaatcaagaactcaatcccttttacaacagctgcaaaaacaaacaacaacaacaacaacaaaaacctccaaaaaaacaacaccccccaaaacctaggaatatacttaaccaaggaggtgaaagatctctgcaaggaaaactaaaaaacactgctgaaagaaatcatagatgacacaaacacatggaaacacatcccatgctcatagatgaatagaatcaatattgtgaaaatgaccatactgcccaaagcaatctatagattcagtgcaattttcatcaaaataccatcatcattcttcacagaactggagcaaacaaccccaaaattcatgtggaaccaaaaaagagcccacgtatccaaagcaatactaagcaaaaataacaaatctggaagcgacccattaacagacttcaagttacactacgaggctatcgttaccaaaacagcatcatactggtataaaataggcacttcagctgggcacggtggctcacgcctgtaatcccagcacttcgggaggtagaggcagacaaatcacctgaggtcaagagttcgagactagcctagccaacatgataaaacaccatctctactaaaaatacaaaaaaaattatctgggcgtggtggtgggcacctgtaatcccagctatttaggaggctgaggcaggagaatcacttgaacctgggaggcagaggttgcaatgagctgagatcgtgccattgcactccagtctgggcaacaagagtgaaactccatctcaaaataagataaaataaaaaataggcgcttagaccaatggaatggaatagacaatccagaaataaagccagatgccaacagctaactgatctttgacaaagcatacaaaaacataaattgggaaaagcacatcctattcaatagagagtgctgggaaaactggcaagccacatatagaatgaaactgtatctccatctctcactttatataaatgtcaactcaaaatggatcaaagacttaaacctaaaacctaaaacctaaaaccataaaaatcttagaagataacatgataacattaaaaaactcttctggacattggcttaggcaaaaaattcatgactaagaccccgaaaacaaacacaacaaaaataaaaataaataaatgagacctggttgaatgataaagcttctacacagcaaaagaaataatcagcagagtaaacagacaacccacacagtaggggaaaatattcacagactatacatccaacaaaggactaatatccagaatctacaaggaacgcaaagaaatcagcaagaaaaaaacaaataatcccatcaaaaactgggcaaaggacatgaattgacagttctcaaaagaagatatacaaatagccaacaatcatgaaaaattgctcaagataactaatcatcagggaaatgcaaattataagtacaagataccaccttactcctgcaaaaattgccataattaaaaaatttttaaaaaccacagtagatgtttgtgtggatgtggtgaaaagggaacacttttgcactgctggtgggaatgtagattagtaaaaccactttggaaagcagtatggacattatttaaagaactgcaagtagatctaccattcaatccagcaatcccactgctggatatctacccaaaggaagtcattatatgaaaacgacacatgcacgtgcatgtttacagcagcacacttcacgattgcaatgacatgaaaacaaagtaagtgtccatcgaccaacaagtggacaaagaaaatgtggtatatgtacaccatggagtattacttagccataacaaggaacaaaataatgtgttttgcaacaacctagatggagatggaggccattattctaagtgaggtaactcaggaatggaaaaccaaatactgtatgttctcacttataagtgggagctaagctaggaggatgcaaagacatatagagcgatataatggactttggggactcaagggacaggctgagaggggagtgagataaaagactacatattgggtacagtgtatattgcttgggtgacaggtgcactaaagtctcagaattcaccactaaagaactcatccattaaaccaaaacccacctgtaccccaaaaaactattgaaataaaataaaacttcatagggcaaacaacaacaaaaacaacaacaacaaagaaaataaataaatcatacaaaaaatatttaagatctctgaaatccaagacactagaaatcaagagacactgtggaaagagtacatagaagacctaaataaatagatcccctgttcatggggagcaagatttaacattgttaaaatgcaacactccccaaattaacccagagatttaaaaaaaaactaacaaaattctaggaggctttttgatagaaatttatgagctgatttacaaatttatatgaaaacataaaaggtctagaataactcatgcaatttattttttaaaaattttagagaaagagtctttctatattaccccatgttggcttctaacttctgggctcaagggatccatccacctcagcccccaggtagctgagactacagtcatgcactaccatgtgcagctaatttttcattttttttcaggacaagttttgctatgttgtccgggttagtcttgaactcctgggctcaaggtgtcctcccatctcagtctcttgagtagctgagactacaggcatgttatcatagtcagtacaatttaagtaatttctaaaaagatgaacaaagttataggagttattttgactaaaaaagctgagataatttattatgttaataaatattcttgtacaattacacctattaattacttttaaaatttctgcttcacatctctgcaaccttgggcttagtggatttcccaggaaagaaatgcttccaccaaataagaacctcagctggccattttatatttccataaaatatagtggtatgagggttctaatttctgcttatctttcctaacatttattttcattttaaaaaaattattattatagccatattattgtggtttaatttgcatttctttaatggctaatgatgttgagtatcttttcctgtgtatattggcggtttatgtatcttctttgaagaaatgacttttcaatttctttgcccattttgtaatgggattatttgtcattttgttattgatgtttaaagggttctttgtgtatccaaacacttgacccatatgagatatgtaataggcaaatattttctgccattgtatggattgccttttcactgtattgatagtgttctctgatgcataaaagttttggtttgatgaagttcaatttatctattcgactctataaccatacccagggcaggatcaggaaaacaaggacaggagacgtgcaggggctggaccaccttccctcttgggtgactggaggtctgtcctcagcagtctttcccttctgacctatgacttctgggaatcgggtccccatctctagaatcatcaaggtgatgactggtcctttattttcacaagtgctttacgttacagaaatttcagcaagcagggactatgactgggtaagcatgagtgtttgtgttttgtgtgtgtgtgtctgtgtgtgtggtggggggcggggtatgtggggtacattttattatcaatgcagaatggaacatgacaatgcagatcccagtccttacataccagagctcttcttccgcttcatcgcaagtgtagccaccacagctcaagtaaccacatctccaatgaaatttgatagtgcataccagagtatcttagtttttaatctccctaaaagtataccatgtcactcatagattgaatatatcaaagttgtcttcatatggaagccatgaatttgtctatatgggtctcagacatatcattgaaatatagcatgcccaagaaagtttaattaatgtgtatttgaacaactacagtgtatagacatcaaccaaaatatgaattatcagttcatagtatcaagtcttcataaatgcacatcactgttgccaatccatgtctatatttcactggaaatctggcataatattttctttactttggtgaatgtaagaaggcaaataagtcttgagtactcatcctaagttgtatttattggataccacatatattaagtaccctacagacccagtagacacatttcaaaaattataaaataattaaaccttacaatcccatcgcattagtaatctttacttttccacaacttgaaacaattctatgtccttcaactctcggacccctttcctcatcgtctcttcctaggtcaaatatgtatgaagttttcacaactctggagtgcagatgttctaagcatgaccaaaatgtgaaaagtgatgaagaatgatgataatcattttgactacttacaaattaaaaaaaatctctttggcatccacaaacacagaaatgtacaaacactttcccataatcaacctcaaagacatgtaaacagttgatggacaaaatagtaacaatgtgttaatacccttcagcccaaggccacctggagcacatctgtgggtgaagaagttgggtttattactcactgcagtgggagggagaatgcacaccttggataactaccgagtatcttggtaagtgccttttagatagagcctattataatatttgggcttcagctggtatttcaagtttccctgggatttaattaattagtagttatgactgaatgatgacacagagaggtctatgccactgaaaaaagagtttattacccactgacataggaagcacagcacaacaggcagcaccaaggctggtcaagtggcaacgggaggggaaagcatgggcgagagcctctaatgtggtttttaggggaatgaatgagcaaggcagggtaagcagtgtagacatgttcagtattgatgagtctgaataatcttggtgactctgaggcatagggattgtctctagttgtctgatacctgtctctcagattattaagacaggagaatattgactgggagtatcggggccatgtgacagccagaaaaaaagaactcattctgagtttgggctctggtttggttagtttgcataagaaaggcgcatttgcggtcaatccctttagtatctgtaggaatagactagtcttgggaggggagtcctcacaatcagtgaggactcagatgccagagcatgagaataaggaaaaaaagaaaatacagataacacagttgagaaattctattttattttattgctctagatttagtactgtcagtaagcagaggcaattctacaattcggtatttcaataaatcttacctttagggagggtggactagagtgcagataaagcttaatccgtagagaagcatcagccactcatactagccgggagagggtttagacaaaattatgaagtacttttgtttcgcctcactttctcatgggctgagagtgatccagtgtggtgttggtattttgtgatataatttatgtcccagagggactaatatggcccagtagtgaagaccagaccagctcctggcaacactgatgcccagctgtgccagacaagttcccagatattaggggctgctttttcttgattaaattcaatatttaaaaatatcagcattacgtttgagaaatgattaagaaatgtcatatagttatattagtaataaatatgtgcaaaaaataagaatgtagactacaaaatgggaaccagaattaaaatccatcagcttggcaaagacagaagtaaatgatggtagtattgatcagagtacagggaaaatgtactgttacgaagactgatggcattgaaaagtggtacaaaacttctaaagggcacttttgcaaaatgtctcaataatttaaatgttctgacgtttttgagacagagtcttgctctgtcgcccaggctggagtgcagtggcacaatcttgacttattgaagcctccacctcctgggttcaagcgattctcctgcctcagcctcccgcgtagctgggactacaggtgcgtgccaccacgcccagctaatttttgtaattttagtagaaatggggtttcaccatgatggccaggctcatctcaaatccttgacctcaagtgatccacccgccttggtctcccaaagtgctgggattacaggggtgagggactgcgccgggcctaagtgttctgacattttgacatgaaaatttctcttttaggaatttatcccaaggaaataattacatatctttctaaaaacgcatatataggccgggcgcggtggctcatgcctgtaatcccagcactttgggaggccgaggcaggtggattacgaggtcaggagttcaagatcagcctggccaacatggtgaaaccccgtctctactaaaaactacaaaaattagccgagcgtggtggcagacacctgtggttccggctactcgggaggctgaggcagaagaattgcttgaacccgggaggtggaggttgcagtgagctgcgatcatgtcactgcacttcagcctgggtgacaggtcgagactctgtcccaaaacaaaaacaaaaaaaccacatatataagaatgttccttgaattgtggtttataaaagcaaaataatggaaataacccaaagattgtaatgaatatagtgatgatagttatcaataatggagcatttagtatgactcagaaaataatgccatggctttacatagagagtcagatttaatcctcaatgcaaacccatggggaactcaatatgtgatcctttgtacagacagggaaggagagaggtaaagaaggtggtggggctagggttgaaccctggagattttctctcagaggccttgttgacttgtcttccattgattctctcttcatctgcaccttacacaagtgaactgttttgatgtcccagaatgttctatggacaggaggccactggctcagagctcaggaagacaagaagggcaatgacttaactgccaaattcacgcagaagtccgttcatccagggtgtatttccagtgatcaggagatctgctaagcacttgaggatataatgaagagcaagagtaaaatcttggagatggggagttttcaatattgtaaggaagataaatatttagcaaaaattgccccaagattgtgaaattgctaatgagcgtaagggaaaagtttgtgatatcatgaaagcaggttacaaggagacctaatgggtccctaccactattaccaattatgtgtgaaagatgtaagaaaacagcagttatgagatttgaacaaatttataaacaatttcatgcagagaactagaaagagctctggaattttaaaatatgatcattgaaataaagagtttaaaaaatgaactgaaatgaaagttgtgtgctgcaaggtagtacaaaataaaaacgtgatgccaagcatgatagaactttaagaatattatactatcaattaaggaattccagcagtctcataatataagttccaataaccatagaaagtaattaaaagtaattcaagaaaatgttttgaaggctactgacaaaaatgtatagtgtgaatggctgcaacaaagttctcaatacaggagatggaaacagacccacaccaagactcatgacaacaaaatttcagagagtgaaagacagagcaagaccaatggacaaaggaatggcaggaggtctggtcgtgtgtgtgcatttcctccttcccgtctgtcattgtccttcctcaccaggcctgcagatcacctgtgatgacttggcctcttgccatccctagctgggcaaactccatcatggtgacacacgggatggcagaagtgcaaggcctcgtttctgctggatgagccttctggagactgtctcagggttttctgagaacttctttaaaacctggtctacgggcatgcattaccccagttattttttccctaagtgaaaaatcaaccagaggagatgatttattttaatagccttattgcaggagaggaaggtgaaaagtgtttctattcattggcccattagttacaatgggcagaggccactgagcgagcagcgggtggtggcagtgatgaccacacgttctcacggcagcgcaacacttttgagacaagttcccacctctccattaaacatgtcttctccacgtgcagaaaatgtggtctcgtagcttcccttctcagtgctggattgctggcatttcattttccttatcagagacatgaatatctttgttcttcttggatttctaagacttcaggttttcttcagggagaagctgcttagggaggctcctgcgtggaccgagtccttcctgagggtttgcttggtgccctaactgtggctgactgcctcccgcggggtcccaactttatacccagaggtaaggacagatgcttccagctccatcttataacttccacatgaaatttgaggtcaggaacttctcttaactcgtcttaaagggcctcatacttacattcttgactcggaaaataattaagtgtgcgtttgaacatgtttcctccgcaatttactctctggaggggaatacattgaaaacccagtttattttcagatactgagtgggattgaaaagctgaattgtctgttttcctgcagggcacacagaggaactggctgtcccacaccactctgacatttccagagaagcaccgtcctcttccagtaggacatgagtaagaccagtgaggagccaacatgcagcccctgggcatctctggggttgaaggaaagatatatatgtccttctgatgtgtggagccctgagggcagtgttcaagaccctgcattttccgaagtacttgtttactgagcaagtgtttctgcttgttgcattatgtcaggggatatggaagccacttttcatccagccaaacacagatgcaaatgagatgttctgggagaaagcagaaaaagcccttttcacagagttccttattttactattctattacacttgtctgaggttacaatcacatccttttttaacaatctctaaatgagaaaatcatcaaaagggtatgtagtgagtgacagacacaggataaatgctgtaagtcagtgtttgatgaaagatactggtgttccaggatgtcagagtctcctgggtgccagtagggaggtggtcagggactttatccaagaagcagaaagaagagcttcagggacatgaggatgtctcatagccaaggacaggacagtaaagggccccgtgtgagtgcatcacagaggtctgttactgttcagaccccaaagctcagcacccagtgtggcatgtggcaagacctcagcaaacacatcagttggctggatgaaggagggcaggtgtgagccgacaaggaaaatcttgtgatttttgttgggaaatgaatgtaaaagtgttgatgtacctcccttgtaaggagatagaaaggtagagagcagacagatgcatgcatggatgaatgcatggatggatggatggttggatggacggatggatgttcattttctgtgtgtgtttctatctctgttctgcctttctgttttgtctctggctctgtctgtatctgccattgtcccttcacaaccatgccttcactattatcagtaacatcttttacctggtcttataggatcttgcctgtgttgtattagtggtcaaggacagaaaaaagaaagaagtctgtggaaaacaaaataaaggaaacagatgcttctgacatgcggcagtggaaggatgtgtggacctgaggcccccagggagacaggggctgcgcctcactgcaaagtcgatcctgctgaacacagaggggaaacgcgctcagacagccctgcccgtgctgatcagaagggagggttgcgcctccagatccttctccctgtgtttcttcagggcccagccctgagagttccagggtcccattttcttagttaggaccttaagaccctatcagagtccagccccaggaagcctgcagtcatagcactgggctagaccaagttgctgctatgaaaagggatttgaaaattcccagaggagcctttcagcctctttccatggctctttatgccctttcaaaggcacagccagagacatcagaaatgaaattgtatataattatatggacttttcgacaatcattgaaatttctgtaagtgccagttatattttggcaaccccatcaaagccaggtgtgcccagggcagtcagctcaggccctggcctctcattcaggttggattctataagaaccgcattcgcggtgagaattctagagccagatcttgctgctccacaattgcctcacgttgcaagacaagcaaatctagcctgagtctgtggattccagggctgcttaggaggaacctgcattcccgcgtggatgacctcaggctccgccccttctgccccactcagccctcacccagtgcctgagagcgctcaatcagaatgcgagagcagcgcggcggcgcccccgtgtggccacagggacgaggacagaggaccggaccccgctcccctttctcaccaaccaggacctccgaggctctccctctgctcccagcacctggacagggctctgcactcaaggagcctccgggtctcaagtcaggctctgagtccattcagcttcccaaaatccatgttgacaatgacatttcctctcaccactgagtgactggacttttgcctcagagcagagagaggcctccagggcaaaacagtgggatcagatgtggggatgacacacccccaaatccttgctgccacaggacccagtccctcagcctccagatggggccttggcctcccgtcccctcctttgttcctgctgctagaggctgctcatcccaggaatcagcctgttagcctccaaccctggggtccagggacagcagctcctagtgcctcggtccaggaagaagggaacctccagagagcagaagagagaagaaatggaccataagagaagggggcaaggggggagaaagagagtgaaaggagccagggaggagagaaaaatggaaaacatcctgttaggaatgtgtgtgtttgtgttgatgtgtgtgcgtgcaggtgtgtgtagagtgggagagagtttctagggttctgaggagaagagagctgctatacaggtgctaaggggcccagccctgggaatttcagggtcccgctttctgagctaggatcttaaggccctatcagagtccacccccaggaagcctgcagtcatagcactgggctagctggacggctgcctcttctttgcctttgacagcaggagctgccatgccaggcccaggggccctggggtcatgggcagagagcaggtccctctgctggcagccaaggagatgttgttcttggagggtcaaagactcacttagctgggagtctgaaggtggtcatgggttacaaaggggttacaaagagctcagcggtgagcctggcccaagcttctgacccctttctttggatctcaagggctgaccatggattctcaatggatctcaagaattcgcccatttacctcttgccccagaccctccccacttcgataccctgggacccaggcatctgcctctttccttctcctccggcctcccaagcacctccaggccctgctctctgccaacctgaactccaggaccctgcagccccaccccaaaattgcttgataatacagtgattctattttcagtgttttgaaaactctgtatactgttttttacagttgctgtactagttttacacactgtgtgtaagagtgcccttttctccacatcctcacaaacatctatttgtttgtttgtttttttttgtctttttagttgtacccattctatctgggggtaagatgatatctcattgtggttttgatttgcatttccctgatgataagtgatgttgagcatttttcatgtacctgctggccatttgtatgtcttcttttgagaaatgtctattcatgtcgtttgtccactttttaatagaattttttggtttttttagctcttgagttccttacatattctggatattagtcccttgtcagataaattgtttgaaaatattttctcccattcaacaggttgtctgtctactcttttgatggttttctttgctgcgcagaagcgttttagtttattatagtcccatttgtctattttgtttgggttgtctgtgcttctgaagtcttagccataaaatcgttacccagaccaatgtcctagaatgtttctcatatgtttgcttccagttgttttatagttttgggtcttacgtctaagtatttaatccatcttgagttgatatttatatagggtgagatatagggatctaattccattcttctgcatgtggatatccaatttccccagcaccatttattgaagagggtgtcctttccccaaatgtatgttcttggcacctttgtcaagaatcagttggctgtaaatatatggatttatttccagattctctattatgctgcattgattgacatgtgtttgtagagacgaggtctcagtatgtttcccaggctggtctagaacctctgggctcaagtggttcaccctccttggcctcccaaagtgctgggattacaggagtgagccacagtacctggcctttgtgctgtgttttgattcatcgttatctcctaagccctttcccagcattgatattttactaaacaccctatgattaaattatatctctacaccttgagataaacaaaaaattatataagcggtaaagacaaatatgaaaaaataaaactactaccaatgttattaggaggataaccttaaaacatttgagcaagaaaatttttctttttttcttttttctttttttttagctgtacctgctggaatggaaaatatttcttaaatgagacaaatatatgaaagtgaaaatgcttaaacttcaaaggacttacattacatatatagtcattctttcttaatgataagataggttctgagaaatgtgtccttaggtgatttggtcttacgtgaacatcataaagtgtccatacacaaagctagatgatatagcctactgcacacctacgctatatcataaagcctattgctcctaggctacaaacttggatagcacattactatactgagtactgtaggcaattgtaacacaatggtaggtatttgtggatctaaacatatgtaaacagaaaaagtacagtaaaaatatggtaaaaagatttttacaatggcacacctatataggttactcatcatgaatggagcttacaggactggaagttgctctgggtgagtcagcaagtgagtggtgagtgaactgaaggcctaggccattactgtgcactactgtagattttataaatgctgtacacttaggttacactaaattgattttaaaaataattttctttctttaataataaattaaccttagcttaatgtaacttttttaactttataaactttaatttttaaaacttttcagcttttgtaatagcacttagcttaaaagaccaacatgttacaaagctgtacaaaaatattgttccttatattttcattctagaaacttatttctatttaattttttttttacttttaaatcttttctgttaaaaaaaaaagacataaattagcctaggctgacacagggttaggatcaacaatatcactatctttagcctttacatcttgtcccactggaagattttcaggtgtaataacatgcatggagctgccatctcctatgataacaatgccttcttctggaatacctcctaaaggacctggccgaggctgtttcaagtttttttaataattagaaggagcacactctaaaataacaataaaaagtatagtaaatatgtaaaccagtaacatagtcatttattatcattatcaaggattatgtattgtacataactgtatgtgctagacttttataggattgacagtgcagtaggtttgtttacaccagcatcaccacaaacatatcattaatgcattgtactatgatgtacagtgtcacctacaatgtcactacagagaagaaacccccaaaatctgcactcctaagctgcatatgctttaggtgatactctaagaagcccaccagagaacagttgcttggagattgcatgctaagtagaaatgccaaaggcttcagagtatgaggagatgttggaattttagcccagccaaacctgggttgagccaacagggtggtgaagcactatgagtgaggacccttgccttggagtaaggaccgcactgaactagactcatgttaacaaaggctaaaatcaagcctaagcagaatcaaagtgggtctgatttttatgataattaatgaaccgtcaagcagttagcagtcttagcaggaagatagcaaaatccagaacctctgtaacacatcacccagaatatgtggcatgccaagcagcagaaaaaatgcaacaagtggagataaaataatcaacagaagccgactcagatgatctggatactgaagccagcgagcaaggacattcttcaatatatttatgattaatatgttaaggataatagaggaaatcatgggcaaactatttcataatccccagaaagatcaatcatacaaagagagaaaacacgaatgaacactgtgagaagggacaacttataaaaccacagattttattaaaatgaaaataagagaatattagacacaacttcatgacaataccttttaaaatttaggtgcaatgaaatgagttcttgaaaaacacagttgaacaaagccaacagaaaactaagtagaaaatataaatagtcctctatccattaagaaattgaattttaattaaattccttcccaccagaaaaacttcttaccacatttcctcccatcaattctttcaaaaacttaaaaaaggaatgtcagtcctatatagtcatcccttggtatccttttgggctgggttctaggacccctgtggataccaaaatctgtggattctctggtcccatgtataaaatggcctactatatgcctactacctatgcatatcatcccatatactttaaatcatctctagattacttacaatacctagtgcaatgtacatgattgtaaacagtagttatactatattgtttaggaaataacgacaagaaaatgtctgtacatcttcagtacagatgtaaccactgtcagtaggcctaactacagagtacacaacagcagcaacataacatttccaatcctcaggtagttgaattcacagatgtggaacacacagacatggaggacagactgtcttatattttatataatgaagagtggccaggcgcggtggctcatgcctgtaatcccagcactttgggaggccgagatgggcagatcacctgaggtcaggagttcaagaccagcctggccaacatggtgaaacctcatctctactaaaaatacaaaaaaattagctgggcgtgatgacaggtgcctgtaatcccagctactcaagagactaaggcaggagaatcgcttgaacctgataattgctaggctttgagtaaagtagtttgacctttataatgtgaccctccctaaacaagatggaactctgcagcagacatcctgggatttgaactgcaatatcagtcaactgacccacaaagagctggttggtttgtgtacagcatttgcaagatgagtggacaacatcctgtttggaagtctacccctttgatcaaagaagttaaaaacaggacagtttttttttttttttttggttgaattgcatgatgttttctgagaagtgatgaaagaattgaacaatgacaaaagtccctatgtcttagtttttactgacttatgggcattgactgatggcctggccatataattaagagagcaatggaaaactggcctatgaaaagaatacccgtataggacacagtcctgtggaaatcactatggtaatttgaggggtgcattaatgtaaggcgtgttgatgtctgatataaattgggtgttgtccccacccaaatctcatgttgagatataatccccagtgttggaggtgaggcctcaagggaggtgattgcatcatgggggtggcttctcatgaatcgtttagtaccattccctcagaatagttcaattagttcaatgcccctcagaataaccctcctccaggtttggaaggtgattgaaatcaacaagcatttatttctaagtgatttccaggtgtacctgtatttccagctacaagaagaactgaggcagaaggatctcttgagcccaggagtcttagttttgcctgagcaacttttgagtccagggaaaaatatcaataccacatctcaaaaaaatccacgtttgcttgtggtgatcacctgggtccgtgaaataagtagacactgagggctgcagcaatgcagagataggctgaatcaagatatattccttttacatcctccaactcacaggcacgaaatacccataaggactgttctgtttaagaagagacagagacagcatatggctatgtagcaaattctctcatgggaaggtcttgaaaatagatagctggcaaattagactgataccagtacccctaggaggcagcaaatgggtcttggcaggaatagatactgaccctggagtaagcattgcttagctggtggtagatgtgttatcaaactgaactggggcccactcacctggtgcaataaaggcaaacatccacactgagattttgtagtgggagaaaggaaggcgtttatttgcaaggcaccaagcaaggagaatcgggcagctcacacttaagacctaacctccccaatggcttacaagcaagagtttttaaggcaggagtaaatttcagcaaagccgagttgcaggcaacatcaaaaatcaatgcatagaaattacacactggtttggcctaaaaaggtgggatatcctgatgagggatcgtacaggtcataggtggattgaaagattctctgatttgtgattggataaggagccaaagctttgtctacacacttaggggcagtagggaggaatgttcaggtctgctctgtggacctgactctttccaggcccctcaggaaaaaatttagaacaaagagtcacagtcagcattgagtcctcattttccccttatctgaggtctccctatcagtggctctgtttggtgagagtctgggttcctgaaaaactactcaaggacatatgttaagatgttctctttagtttctatagagaatcaaacatcttgggactctaacttccttggctattgtttaagctatttttacctgcttgcttataaggtcactcacttgcttttcagggctggctaggtgcctggaatttctcttgaaggaactcaacattttcctttatttccatgttagggaggtctagcaggcttctaagataaatccgtacttcatctcagatgcaaatgcttagagcactataatagaacctggacgggagatattgcaaccatttgcatcactgagtcacatttcttcacaccaggaaacacatttgcccaaaatgtccaacaatgttcagaaaaatattttgctcagaggaatagtttcatagagaataaaaatagtcaaatgacacattacttgtataaagcaggagtggggagacataagcatgaagggcgggcttacacacgttcatgagtgggctcacaccagacatgagtgtggaaaaaggagtgtccccactagagagtatcctcttttttcctgctggatcagggaaaggtgctagtatgacctgacatacgatttttcccatgacaagaggacactggaatgatgactagacttcacctcaactcgcctttctcatacctgattcagtggtcttaggacaagggatgcatataaaagtgccaaaacaggaattattcctaagcaagaaagtgtaaatatattttaaaaccattatgcaagaattcctcagggcctggaggagtaggttgtgccttcactgcatctggcaaagttggggctaacactgaatgcagctatattgcctggggtcagatagccaactagttctctacctgcataaccctaccctctatgaactggaatggaccaacgagagacacttgctagaacagtattgctcccttcagtctaggccagcacagtagcagaacttaatgtttcttccaaaactgttaatgtttggtataaatgaagtagaaggaggaatagtagctgagggtaaatgaatgaataaatgggttgtgtaatgaggaaaatccaatgttacatgaactcccaaaaaaaagaggtataagcaagagatgatattgtctcttgacaatgatggtgcaccccgtctccatggggacagagggtcgtgtgctcagagtgcttccagatgtcgcctcctgcacttcatctgcctgctcatttgtatcctttacaactgctattgtttgaatgtttccccagaaaagcgtctgttggaaacttaatccccagtgcaacaatgttaagagatgggacctttgagaggtgattggaccatcagagctctgccttcattaatgaactgatcaaggctgccctcattaatgctgatcataaaggacctgagcctgtgagttcgacctcttactccctctagctctcaccctctcttgcgcttctcccttctgccagatacattcccttgattttggaattcccatcctcgacaaccatgagccaattaaatttgtgttcattgtaagttatccagtctcaggtgttctgttatagtggcataatttaaaccaggggtccctaactcccctgcagtggaccggtacaggtttgtggcctgttgggaaccagaccgcacagcaggaggtgaagggtgggcgagaaagcatgagcatgaccgcctgagctccgcctctggtcagatcagtggtggcattagattctcatgggagcacgaaccctattgtaaactgtgcatgcgagggatttaggctgcacgctcctttataagactccagtgcctgatcatctgaggtggaacagtttcatcccgaaacccatccccgcctacctgtgccgcctgccctggtcagtggaaaagttttattccatgaaaccagtacttggtgccaaatatgttgaggtaagctatgattaccgctgatttaagctatgacaataataaactgcaatactgagtgtgaaagaaagataaaatcttgggaccccaaactcacagtgccaaagggaaaagttaagtttgggaactgagtcatggaaaaactgcctttcttttgttcctaaacaaatacctgcaaagatagaggaccacatatctccccaagtggcctccctcacaatctgctcacaatgtaattccttgtgggccccaacatctttaccctaaaacagagttttgttgacttttcccctgacaatgtaaagtaacagcttatcttcacaggtacaggacaaagacaagactagaaatcatcccttcacccacccggagacaaacacatattttactactctatgtttactttagcttatgtaaaattcagatttactgagcacaagatgaatgcatagttgactgtttttccccttctgcctgctctttcccctgtaagtactgaagtcctcaaaacccttttaggaaaaagcgtgggccacagatgctagtgatttttgtctctttttccaaggtgcatcttggaatgggagactggagggacccatggatcccaaccctggacctggttcccccagtacaatccatgagccagttgaatctgaatgcgaagatggaacgacgactgaccagagtcatgctgacatcaacccccataacatggggactgatcaagaaaaccacacaggaagctgagaaactgctggagtgccagggtgtcaccttttgctggaactcagaagtacaatcgatgtttaacggaccagtgctttctgactcagctcctctctaccctgaatacaagagaccctaatagttaggcaggaatatcatcgcccttattctgcatgaagaagttgcagaagacagaccttcatccttctgcaacccttaggattaagcgtcctcttgtaaaaagggaagggggagatatgtaagaagcattcaaaccacagcaactctattttgaataagggctaagaaaaatgaagctggatcaccaaccggcaattaagagctgcacagcctgcaattaccttgctcaattaattttaaaacaaaaaggagtagatgttggaggccgcacgaatgtttcttatgatttgccacaattgaagcctgccagtaacaatatgaacctgtgatcaattaagcagctgaccaatcattacctcctcctccttgcccttattacccagtaaatatgaagggctaagaagctcgggcggcggcctttgctcactagaagcagggagctcttttcttctcgtctctcttcttcttccccatgctagcctttccttaaaatgatgtagggtatctggcagataaaatttctaagcagcaaagcattcaaagagtgacttgggtgctcctaaaagcattccattttcaaagggaaacagagcataaaagttcagaaaatttacagcctgacaatgcagtagaaaagaaaaacccattttttgaggagaaactcaagctggctgcagaaatttgcataagtaacaacaagccaagtgttgatccccaagacaagggggaaaatgtctccagggcatgccataggtcttcatggcagcccctctcatcacagacccagaagcataggaggaaaaaatggtttcatgggcagggcccagggtccccatgctatgtacagcctagggacttggtgccctgcatcccagatgctcccactgttgctaaaaggggccaaggtacagcttggtctatggctccagagggtgcaagctttaagccttgacagcttccatgtggttttgagcctgcaggtgcacagaagtcaagaatggaggtttgggaacctccacctagatttcagaagatgtatggaaatgctaggatgcccaggcaaaagtttgctgcaggggcagggccctcatggagaacctctgctagggcaatgtggaagggaaacgtggggctggagcccccacacagagtccctactggggcactgcctagtggagctgtaagaagagggccaccgtgttccagaccccaaaatggtagatccaccaacagtttgcactgtgcatctggaaaagtcacagacactcagcgccagactgtgaaagcagccaggagggaacatataccctgcaaagccacaggggcagagctgcccaagatatggggacctacctcttgcatcagcatgacctggatgtgagacatggagtcaaaggagatcatcttggggctttagaatttgactgccccactggatttaggacttgcatgggccctgtaactcctttgttttggccaatttctcccatttggaatggctgtatttacccaatacctgtacccccattgtatctcgtaagtaactagcttggttttgattttacaggttaataggtgggagggacttgccttgtctcagatgagactttggactgtggatttctgggttaatgctgaaatgaggaaagactttgggggattgttgggaaggcatgattggttttgaaatgtgaggacatgagatttggaggggccaggggtggaatgatatggtttggctctgtgtccccacccaaatctcatcttgaattatactcccataattcttacatgttgtaggagggacccagtgggagataatatgaatcatggaggcagtttcccccatactgttcttgtggtattgaataaggctcacaagacctgacgattttatcaggggtttccgcttttgtatcttactcattttctcttgccactgctacgtaaaaaaaaaattcacctcctgccatgattctgagaccatcgagccatgtggaattgtaagtccaattaaacttctttttcttcccagtcttgagtatgtgtttatcagcagtgtgaaaacggactaatatagctggcttcgtagactgaattgaaaaaaactgcctactttaatttctaaaaggtatgtgtaaaattgatgtaatttctaaattatatgtttgatacaattcatcagtgaagccttctggacctagactttcctatattagaaggattttgattacaaattcaatttctacaatcaatatatggctgaccacattttctatctcttctcaggtcagttttcataagttttccctctcaaggaaattgttcatttcatttgcttgtcaaacttattgacatgagattatcaatatttctttttgagatctagagtgtgtactgatgttctctcttttattgctgaccttgttaatgtgtatgtttttgtcttgatcagtctggctagaaatttataaggtgtacgatttttccctatagaaccaatatttggattcattaattttctctttctgcttcagttttttattttattattatttccttccttctgcatgcattggtttaatttgttcttctttgcttcttacaggagaaactaatttactaatttgagacctaccttctttcttaatataggcatttaaggatatcagttttttcttcagtactgcttgttgggaacaaatgctcagtgttgtaaagaaagatcagcactgagacaaaggatctctcagcaaggcaattgacttctgcagaaaggatgctacttatgatggaacgatggcgagtgcacacctgaacaaaggagagcaggggttttttataatctcttaatgcagcttgtccctgtaactgtgtcttgtctccattggctggagctggactgcacaatctaagctgaacctggctggctaacttgaaaagtgcaggaatgtggttataccaacagagagtgcagtcttggcgggaggagctgttgcaacaggagggttaatctatagagtgggtagcagatgtgggatgtggtctccatagataaggactggcgggaaatttgtttaccagggcaggggatacagagcgtaaggaagtctggccttgaaagcagggaacaaagagccaggatgctgagcaagttaacccttaaagaggaactctttttatatctaacactacttcaactgcatcccatacatttgatatgttgtgcttcagtattcttcagaaaacagaagactttctaatttctcctgtgatttcctctttgaataagttgttattcagaattttgatgtttaatttccaatccttggtattttcatgatcgtccgtcttagtcaatctgggcagttataaaagaattccatagtctatgtggcttgcatacaacagaaatctatttctcacagttccggaggctgggaagtcaaagatcaaggcctgggaagagtcagtgtatggtgagggctgcttcctgattcatggatgttgccttttcttggtgtccccacgtggtggaaggagcaagcaatctggggtcccttttataagggcattcattttattaatgagggttttgccttcactgcatgatcactttctaatggcacaacctccaaacaccatcacattagagattaggtttcaattatgagtttaaggatgacaaaagcattcagtcccacaagatcatcttattgttacagatttctaatgtatttccattatggccagaaaatatattctgtatgatttcaatgttttcaaatttattgttttatggcctgaaatatggtttctcctggtaaatgtatcattcatacttcagataatttgtgtttttcattgatgtgcatatgcatataaataaattaagtctgggtgcttgataatgcttttcaattttctatgtctttgctaaatttttcttagtttttgtatttatagctgaaagaaagctttaaaatgtctaaccatgtttgtagaattctctacttctctctgtaattttgtcaatttttcttcatgaactctaaagatttgctattggatccatttctggttgcatgtctttctgttgattttacccttttgttattatgaagcgcctctttttctctctggtaatacatattatttgaaaatcttttactggtagtaaaataaccatttcaatcctctgtgcttaatgtttgtatggcattgcttttttcatcaatttttatttatctgtgccttcatattgaaattgcatgttttgcatgcagatgtatgttcattgcagcacttgtcacaatagaaaagacatggaatcaacctaaatgcccatcaatggtgaactggataaagaaaatgtggcacatatgcaccatggaacattatgcagccataaaaaagaacgagatcatgtactttgcaggaacatggatggagctagaggccattatcctttgctaactaatgcagaaaaagaaaaccaattgccacatgttctcacttatgagtgggagctaaatgatgagaacatatggacatatagaagggaacaacacacaccggggcctacttgaaggcaacgggtggaaggagggagaggatcaagaaaaataatgaatgggtgctaggcttaatacctgggtgggtactaataggtacagaaactatatgactgtgggcagcaagccacccaggtgccgaggcaagagactgaaggcacaagctcttccagtataataaagaaaatacttaaaataaaaatagttgtattagacataaaatatagatatggttatgtataaatattactaatcattagtttatgacattactctttattccaatattataataatctttgttctacaattataacctagaaaaaaccaggccatacagagataggagctgaagggacacggtgagaagtgaacagaagacaagagtgtgagccctctgtcatgcctggacagggccactagagggctccttggtctggcggtaacgccagtgcctgagaaggcacccatcactcagcagatcgggaaagggagtctccctttgcccgggggagttagagaagcctctgctccaccacctcttgtggaaggcccgacatcagtcaagcccgcccacagccatctggaggactaaacgtctccctgtgatgctgtgcttcagtggtcacgctcctgtttgactctcatgttccaccctctacacctggctcagccttctaaatagcagtagcaaaaattagtgaaagtactaaagtctttgaaatacatagaagaaataatgacataaactgtcccctctctctctccgcctcggctaccgaacagggaagggccccctgtctggtggacacgtgactcacgtgaccttacctatcattggagatggctcacactccttaccctgcccccttgtcttgtatccaataaataacagcgcagcctggcattcgaggccactatcagtctccgtgccttggtggtagtggtcccctgggcccaactctcttttcttctctttgtcttgtgtctttatttctacactctctcatctccacacacaaagagaaaaacccacaggtcctgtagggctggagcctacatatgacaaactctcatgatacaaatttacctatacaaaaacctgcacatgtaccctgaactaaaaataaaagttaaattaaaaaaaataaagttcatgtcttgaaaagagcatatggttgggttattttttttaatccagtcacagaatctctgcccttaattggagtgctgatttatgtaggtttttgtcattattgatatgataggttttaggtttgtcatgttatttgctcagtttttctttctctgtttctcttttcctgaccaatgatttctcatcagaaaccagagaaacaaaataaactagaataacatctttaaagttctggaagaaataaaaggtcaactaagaattctatatccagtacagatgtccttcaagataaatgcaaaataaggagatatttcaggtaaaagataattaagagaatttgtcaccagcagatctgtacgataaaaattggtaaagaaagtgtctcaggctaaaagcaaatgataccaggtggaaaatgagattatcagaaaagatgaagaatgtgagaagtggtaaatattaagtgcgaaaggctatcttgctcccccacccccatttaatcttacttcatatacatagaactgtttaaaggtaaaataagatagctttctgatggggcttataacctatgtaaatatattacatataatatctatggcataaaagatggacgttttatagaggataaatggttgcaagatttctatatttatgtgaactagtacattattaactgaaagtgggctgtgaaatgttaagaatgagttaagttctgaaggaaatcaagacacaaaaaaattcaatagatcaacaaattcaggagatgatttttgaaaaagttaataggatagataggctgatagctagactaataaggaagaaaagagaggcgatcccaataagcataattagaaatgacaaaacagatgttaccactgactctgcagaagtaaaaataaccatcaaaagctactatgaacacctgtatgcacacaaactagaaaacctacaagagatcgataaattcttggaaacatacaccctcccaggaagaaattgattccttgaaaggaccaataatgagctccaaaattaaatctgtaataaatagcctactaaccaaaaaaagccctgaacctgatggattcacagctgaattctaccagatggacgaagaagagctggtaccattcctactgaaactattccaaaaaattgtaaaggaggaactcctccccaactcattctatgaggccagcatcatcctgataccaaaacctggcagagacaaaacaaaaaaagaaaacttcaggtcaatatgtttgatgaacattgatgtaataatcctcaacaaggtacttgcaaaccaaatccagcagtccatcaaaaagctaatctcaatgatcaagtaggcttcatatccaggatgcaagattggttcaacacgtgcaaatcaataaatgtgattcatcacatacatagaactaaagacagaaaccacatgattatcttaatagatccagaaaaaccttttgataaaattcaacattcctttatgttaaaaacgctcaataaactaggtattgcaggaacatacctcaaaataataagagccatctatgacaaacaaacagccaacatcataccaaatgggggaagcattccccttgaaacccagcacaagacaaagatgccttctctcaccactcctattcaacagagtattggaagtcctggccacagcaataaggcaagagaaagaaataagggcataggggaagtcagactacccctgtttgcagaccattaccagtgaatgttcccttaaggctcacaggctcttatatcagcttgtggtgagtgctgctaactagtctttaatggattaaaatgtataatgtgtttcacttgtgtattagtatgttttcacactgctggtaaagacatacctgagactgggcaatttacaaaagaaagaggtttaacggacttaatggttccacatggctggggaggcctcacaatcacggtggaaggcaaggaggagcaagtcacatcttgtgtggatggcagcaggcaagaagagagagctcgtgcaggaaaactcccatttttttaaaaccattagatctcatgagactcattcgctatcacaagaacagtgcaggaaagacccatccaaaaattcaatcacctcccactaggttcctcccatgacaggtgggaattgtgggagttacaactgaagatgtgatttgggtgggaacacagccaaaccatatcaacttgtaaattactacaaaactgtcaacacttagccacttctgcttcctcaggaaggtcggggcagcagatctgtgtgttaaatatctatgtgaagttatttccaggaagaagtttcatctgtggtttcttcttccccaggtcccacagtcttcattacaacctcacggtgctgtcccaggatggatttgtatagtcagggtttctcgctgagggacatctggatggtcagccgttcctgctctatgacagacagaaaggcagggcaggggccctgtggacagttggcagaagcagtcctgggagctgagacctgggacacagagaccgaggacttgacagagaatgggcaggacctcaggaggaccctgactcatatcaagggccagaaaggaggtgagagtcggcaggggcaagagtaatggcagaggccttctccaggagagttggaggcagagagcagggacctgtctcttcccactggatctggctgagggtgggctgagaaataggggtcagtggggctcagcagggaggtgagccggcactcagcccacacagggagacatggaggagggccagggaggggtcccagctgggctgagttcctcacttgggtgggaagatgaggggttcaggaatgaactgctgggtgggggcaggcttgcattccctccaggagattagggtctgtgagatccatgaagacagcagcaccagaggctcccggcatttctactatgatggggagctcttcctctcccaaaacctggagactcaggaatggacagtgccccagtcctccagagctcagaccttagctatgaatatcagaaatttctgggatgaagatgccacacaggccaagacactttcaccctgtgatggcagaccgtctgcagaaactacagtaacatctcgaatcctaggagggcatcaggagaacaggtaccgaccctgggcaggggctttcctctcccccatttcactagagtcactcccctgccagctctgtcctgggaaaccctctctgtgctatggatgcaggcgtttcctgttggcgtattgtgtcctgactttcctctcttgttagagccactggataaagacagtgggttggggactgaaccatccagtgttgtaatctgggaaagcaatggcccactcccaacagaatcctcaccctggggtgggtgttaggcaggagaggaagccctcagggctagggctgccccctctgcctcccagcctgcccatcccagagagttccctcctggcctcatgacccaggagtccaatcctgacatccctccccttcagcatcaatgtggggatctcagagcctgaggccatagtctgaggcccatcctcctgccagcccaaaggaattgggccccagggtaaggacagacttgcaaaagatccggggtccatgagggcttcagccagagtgagaacactggagaggagcagccctgttccctgagtctcccttagagggagcggggcttggccatgtgcctcactggctctgccctttcctatccagtgcctaccatggtgaatgccaggcctcagagaacaaagtcacccccacatgctgggcttccggcttctatccccagaatatctctctggcctggtgtcaggttggggcattttctgagccaggatgcccatcggtctgtgggtgtcctgcccaatgggaatgggacctaccagacctgggtggccactaagattccccaagaagaggagcagagggctacctgctatgtgggacacagcaggaatcacagcacttaccctggtgtcctctggtgagcctggggcgaccctcaagtgttctgacctagaaagggtcaggccaaggtgggcacagcagagataactggaactctgagtgcccagtgtgcaacaaggccctttttttcagggaaagccctgatgcttcagagtctatggcaaccgttccgtatgttgcggctgctgctgtttttgttatcattattattattctctgtgtcctttggtgcaagaagaaaatatcagctgcagaggacccaggtgaaaaaagggggcagtggctggagatgggagggaccctgtctgggcagtagggtcccctcatagctcctgcacagacaggcatgtaggtgacagggctttggaacagggtttggaagttggggtatttgggaggggaataggagctacaatttcatctagacccctaagtcctgcccaagccagggccgggccaaagccctcgaatgtccatctgtggcctcctcttgctgcaggtgaggagtgggcagcaaggagggccgtggcacctgctctgtcctcatccccatccctctgtctctcaggctcaccagcgtgcatcagcgtggggtgagctgggaatcatgtgctgattgctgagggcctggatgatgatggcttcagagggggcaaatagtaaagacggctgtgatctggggagggctagaaactggagaggaatatgaggagaggtggtgcctctagtcccttcctctctgcatccccctcccctgtttctccagccatcaggaggacaccaagaaaaagacctatgaggcccagactggggggcctgcctgtgcagccccttggagacccccttgtaacagggagggttctgagtgcacacagccatctttgtccactttgtagctccccacgcgcctcctccaggagctgtctcgggggtgtcgtgtctcctggatcactcgaggccatgctctttccaggttcccaccacatggccctgcaccctgagttcccttgcagataatatggatgagaagatacgcagatgtctctgagccatttggggagtggtgaccagccccttgtcagggcagctgtcatccctgttttcatcctacttctaggtgtttccttgtccaggccctgaaggacacagtccctcagggacacagtgctcagggaccatgttttttgggctttgttctgtgctctgtggcctcaccttgccctccctgagcctttctcaaggtggtcactttcctgtaaatttggagtaaaggatggtcaggatgatttcccccacagtcagttgtttgaggggaaagtaaaagagaaaacaggaagttttgtgtttctgcaaagacagaggcagtgcaggggacagtgagaggctgggtgtccaggaaactggagtctttctgccatttccccacttttttgcacctggtggtgggggtgggggtttttcatccttgaacctaattgcactgtctgttggcccctcagtcctgggcagatgggaaggttcatcccctgccctgcagcaagagggccccgtccaggaggcacccacagcaggggcagtgcaggtttgtggtcgctcctgctttcacctgcactgtctcctatagaggggttgtcacttctgggtccccgtgggcaggaaagtttgccttgtaggtcacggggcattggccagggaaagggtgtgaaagtcatgtgctaatttctcaaaaattctcctttaaatattgatgtccaataaagatgttcacaatttccgctggataatcttaataggatttcctctaatattgatgttgtaaagcatgtacaatcaaatgagaagtcaagcttggagcttcctctccaggagggtccatgttggagatggtggttgtggcagtggcaatcctggagtgcagagggtgggtggaggcagcctcaggctgaggggtctccagaaaccccctgctccacagggagaagaagaagattccctgtgggctgtgagggcagtggcctgggtggaagccctgctaggaacagggcaggaaggtcttgcagcctcagcaagcagcagccctggggtggaggtgcatttccaggggtgagtggaccaggcaggagcaaggatggcccaagtgcaggtcacggacccgggtgggtgctgagggtctggaaaggttgggtgtcctcaagcgtggagggtcccaggatccagtcaggtgcagacccggtggcagccacgtgtttttgtgccgagcccccaggcttcttgatgggctctgcagttaggggctggctgctcagggctcggagggtggaacgctgagctgcaggtggagcggggagcccagtgtgcagggtctgccctgttgtgcaagtgcctctgtaggtgaggagggcctggggactgagagggagaaggaccgcgtgcgtgacccagcccaggcctggtaggacacggagctaggaccatcctctctttggggaggtttcccactgtgtctaggctggtggggcttgggaggaggggagggccccgggttccctcctggatctgattcttgtcctttagtcatgaggccctttcattccccacatggtggatggtgggcacagggcaggtatcattgttgagggaatcacaggaggagactggtggaggctggagaaactaggatgggagggaggaaaaagtgggggcgtcagttcttccctcagagaaagggtgaatctgatttcggagtttctgaggagggagaaatcctcagggaatgaaaagcagcactctgcacccagtggagcatttactgtttctctcttttctccagagcacatgagcctacgaagcccagatcaacacctggttgggacaggagaccaccagggcaccatacagctggaatttcagtctctggtgccagctcctgggtctgctggctccactggattcaactccctacccaggtctcaccagcactttccctcttgatgcctcagtttcctcatatattaaatgggaaactaacagcacttatttcttgtggtcagggattgacaactgttagttgctatgaggtgtttgcagctgtgccataatattcggtattattatttttgttgttttgttattatcttattaacttttattatcttttaatgtattgtatgtgcagtaattacatgcacaaaagcacatatgtgcctttaaacacattgtatgtgcataaaagctttatgagtgtgtgtcctgttgacggttcctcctggcaagcctgggaccagcctttttggcaccttgaggtcccctcacccttcgcacactgttataaattaccccatgtctactatgtctgcataattttatactgtggatttttactctttaaatagacatttctggcctgtgctttatttcatgcatctgggaagagtagaatacaaggttcaggggaaaaggagaggtctgtctcaatgccttgacacagcatgaagaaatctctccctcttcctacctctccctgccagttcccagtgattgacagattcacagcaaaacagaaaaggaaaggttgggggtgggggtgcacatctggggccaaaattcaggggctgactctgggggaacatctgccctgaagagttggatccttcatgtgatgatgttgagctgaagtgtaatatcagagatgggggcagagagggctttgagtttccctggtattgaagaataggagtcagactgcttctggggtgaagcgactgctgggaacatgtgaaccaaattgatgaagaataagtgaatggggaatgtgggtgagtaaagcaagcatcagcagtcagtttctgccatcagttcaggctgatcggggtagggaggtggggagatggatattccccaccctgttgctcaatccttcctgactgctgggtgcaccaaaatctcagaaatcaccactaaagaattaattcaggtaaccaaacaccacccacccctaaaaaccttgaaataaaaaataattttttaaaaaagtggccgggcacggtggctcacgcctgtaatcccagcacttcgggaggccaaggcgggcagatcatgaggtcaggagttcaagaccagcctgatcaacatggtgaaaccccatctctactaaaacgacaaaaattagctgggcatggtggcacatgtctgtaatcccagctactcaggaggctgaggcaggcgattctcctgaacctgggaggcggagttttcagtgagccgagatcgcaccactgcagtccagcctgggtgacaaagcaagtctccatctcaaaaaaaaaaaaaaaaaaaggaatgatattggatatccttattttgtccccaacacagaggagtagttttcaatatttttctcattaattttgactttagatagaggtatttcttttttataaataactttattagcttaaggaagttctcttttatttctggtttattgagtttttataatgaatagttgttgaattttatcaaatgattctcatgcatctgttgacataactgcacgtttttctacctttttctattcatgtggtaaattactctgattttttaaagtcacatttctcttataaatcccattcagtcccattgtacattatcctctccatatattacttgcttctattttctaatattttagatggaattttggtggctgtgttcatcagttcattcagatggtggatatcttttttgtaatgtcattgtcatgtttaagttcttctctgggctatgttgtctcataaaattagttggaaggtgtttactctttttttattatctaaaagaatatatgatagtctgccctccatgtctgtgtgtttcacatctgtgaatttaactacctgaggatcgaaactgttgttgctgctgatgtatactatgtagttaggcctacctacagcggttacatctgtactgaagatatatagactttttcttatcattatttcctaaacaatatagtataacaactatttgcgaataatttacattgaattaggtattagtaatctataggtgatttaaagtatatgggaggatgtgcataggtaataagcaaatactagaccattttatacatgggacctgagcattcatagattttggtatccacagggggccctagatcccatcccaaaaggataccaagagatgactgaataagactgacttttttaaaaaaagttttggaagaattgacaggggaaaaaacgtgggcaaagagtgtttttggtgggaaagaatttaattagaatcccatttcttaatggatataggactacttatattttctattcagttttctgttggcttgttcaattgtcgttttcaagaactcatttcattgcacctaaattttaaaaggtattgtcaggaagttgtgtctaatattctcttattttcattttaataaaatatacggttttatgttgttctttatagtgttcatttctgttttctctctttttatgattgatctttctggggattttgaaatagtttgcccatctttccctctattttccttaacatattaatcataaatactttgagaatgttcttgcttgcctgcttcaatatccacatcaactcttagcctgattttttttattatactttaagttttagcgtacatgtgcacaacatgcaagttagttacatatgtatgcatgtgccatgttggtgtgctgcacccattaactcgtcatttaacattaggtatatctcctaatgctatccctccccacttcccccaccccacaacagtccccggtgtgtgatgttccccttcctgtgtccacgtgttctcattgttcaattcccacctatgagtgagaacacgaggtgtttggttttttctccttgcgatagtttgctgagaatgatggtttccagtttcatccatgtccctacaaaggacatgaactcatcattttttatggctgcatagtatgatagactggattaagaaaatgtggtacatatacaccatggaatacttagtctgattttatctctacttgttgcattttctctgctgcttggcatgccacatattctggatgatgtgttatagaggctctggattttgccatcttcctccacagactgctaacaatttgatagttcattaattataaaagaattacctttggtaaaaatcggacccactttgattctgcttaggcttgattttattttattttattttattttatttatttttttgttatactttaagttttagggtacatgtgcacaatgtgcaggttagttacataggtatacatgtgccatgctggtgtgctgcacccactaacttgtcatctagcattaggtatatctcccaatgctatccctcccccctccccccaccccacaacaatccccagagtgtgatgttccacttcctgtgtccatgtgttctcattgttcaattcccacctatgagtgagaatatgcggtgtttggttttttgttcttgcgttagtttactgagaatgatgatttccaatttcatccatgtccctacaaaggacatgaactcatcactttttatggctgcatagtattccatggtgtatatgtgccacattttcttaatccagtctatcattgttgggcatttgggttggttccaagactttgctattgtgaatagtgctgcaataaacatacgtgtacatgtgtctatatagcagcatgatttatagccctttgggtatatacccagtaatgggatggctgggtcaaatggtatttctagttctagatccctgaggaattgctacactgacttccacaatggttgaactagtttacagtcccaccaacagcataaaagtgttcctatttctccacatcctctccagcacctgttgtttcctgactttttaatgattgccattctaactggtgtgagatgatatctcatagtggttttgatttgcatttctctgatggccagtgatggtgagcattttttcatgtgttttttggctgcataaatgtcttcttttgagaaatgtctgttcatgtccttcgcccactttttgatggggtggttttttttttcttgtaaatttgtttaagttctttgtagattctggatattagccctttgtcagatgagtaggttgtgaaaattttctcccatgttgtaggttgcctgctcactctgatggtagtttcttttgctgtgcagaagctctttagtttaattagatcccatttgtcaattttggcttttgttgccattgcttttggtgttttagacatgaagtccttgcccatgcctatgtcctgaatgtaatgcctaggttttcttctagggtttttatggttttaggtctaacgtttaagtctttaatccatcttgaattgatttttgtataaggtgtaaggaaaggatccagtttcagctttctacatatggctagccagttttctcagcaccatttattaaatagggaatcctttcccaaggcttgattttagactttgctactttgctatttcagtgtggtacttactccaaggccacggccctcactcatagtgcttcaccatcctcatgtctcaacccgggtttggctgggctaaattaattccaatatctcctcacactatgaagcctttggcatttctacatagcatgcaatccccaagcagctgttctctggtgggcttcttacagtatcacctggagcatatgcagctttggagtgcagattttgggagtttcttcgctgtagctccctccttcagcaccctacccttaaatcccagtcaaagtgccaagcctgaactctgatctctgattcctttgctactgagattgattctctctgcttgggttccatttcccttcattgaattttgaaaaaaatcctcttagaaagaaagctgatgaggatgtgagtctctctttcagggactccattccctggagggtgatagtcctgctctggctgctgttttgcagctgcacaactgcatcgtgttttgtctggcttttatacttgtttacagtgggaggatgagttttaaatgagctagtctatcacagttcaagtcagaagacctctaatccttcaatagtcattgcatttgaaaatctgaatagggtaatttgacaattcacaggcaaagttaatatgttatatcttagtgcccagttgaaacctcaatttcatctttaacaaccttatacacacaaaatacacacacacacacacacacatcactgtgttatacagtcatgcactgcttaatgatgtttctgtcaatgattgatcacgtatacgactgtcatcctattaaacggagctgaaaaattcctatcacctagtgacattgtagccattgtaatgtcataacacaatgcattaatcatgtgcttgtggtgatgctgatgtaaataaacctactgcactgccaatcctataaaagtctaccccatacagttaaaaacagcatgtaatacttgatgataataaatatgttactggtttatgtatttactatactttttatggtgattttagagtgtgctctaattattttttaagttaaattaaaacagcgtcaggcaggtcctttaggaggtattccagaagaaggcattgttatcacaggagatgacagttccatgcttgttattacctgtgaaataacagtgggacaagatgtgaaggctgaagttggtgatattgttgatcctgaccctgtgtcagcctaggctaatgtatgtctttgtttttaccaaaaaagattaaaaggttaaaaaattaagtagaaatagtttctagaatgagaatataaggaaaaatatttttgtatagctgaataatgtgctggtgttttaagctaagtgctattacaaaatagttgaattttttaaaaaattaaggtttataaatatgaaaaagttcaagacttgaactcagctttggatcaagtggatctgatagacacctacagagctttccacccaaaaacaacagaatatacattcttctcattgctacacagcacctactctaaaattggtcacataatcaaaagtaaaacactcctcagcaaatgcaaaaagaactgaaatcataataaacagtctctcagaccacagcacaatcaaattagaaaccaaaagtaagaaattcgctcaaaaccatacaactacatggaaattgaacaacctgctcctgaatgactgttgggtaaattattaaattaaggcagaaatcaataagttatttgaagctaatgagaatgaagagacaatgtatcagaatctttgggacacagctacagcagtgtaaagagggaaatttatagcactaaatgcctatatcaaaacaccagaaaaatctcaagttaacaatctagtatcacaactaaaagaactagagaaacaaaaacaaatcccaaagctagcagaagacaagaaataaccaagatcggagctgaactgaaggagagagagacacacaaaacccttcaaaacgttaatgaatctaggagctgtttttttgaaagaattaataaaatagaacactatctagactaatagagaagaagagagagaagaatcaaataaacaaatcagaaataacaagggtgatattaccactggccccacagaaatacaaacaacaatcagagaatactacgaacacctctatgcaaataaactagaaaatctagaagaagttgataaattcctgcccacatacaccctcccaagactgaaccaggaagaaattgaaactcttagcaggccagtaatgagttctgaagttgaggcaataaatagcctaccaaccaaaaaaagccgaggaccagacagattgatagctgaattctatcaaaagtacaaaggagagctggtaccattttcactaaaactattccaaacaattgaaaaggggggactcttccctaactcattttaaaaggccagcatcatcctgataccaaaacttggcagagatataacaaaaaaagaaaacttcgggccatgcatgatgaacatcaatgcaacaatcctcaataaaattctggcaaaccgaatccagcagcacatcaaaaagcttattcatcacaatcaagttggcttcatccccaggatgcaaggttggttcaacatacacaaatcaataaatgcgattcataacataaacagaactaaagaaaaaaaccacatgattatctcaatagatgcagaaaaggcacttgataaaattcaatatactttcatgttaaaaactcttaataaactaggtgttgaaggaagagatctcaaaataataagggcaatatatgacaaacccacagccaatatcatactgaatgggcaaaagctggaaacattccccttgaaaaccggcaccagacaagcctctcaccacttatattagtttcaccatcatgagaacagcagtttcttaagctgataaggaacttcagcaacgtctcaggatacagaatgtgcaaaaatcgctagcattcctatataccaacaacaggcaagcagagagccaaatcatcaactcccattcacaattcctacagaaagaatgaaatacctaggaatacagctaacaagggaagtgaaggacctcttcaaggagaactacaaaccactgctcaaagaaaaatcagagaggatacaaacaaataggataacattccatgttcatggataggaagaatccatatcatgaaaatggccatactgcccaaagtaatttgtagatgtgatgctattcccattaaactatcatagacattcttcacagaattagaagaaaaaaaaacactatttttttttttaagatagagtcttgctctgtcacccaggctggagtgcagtggcgtgatctcggctcactgcaacctccgcgtccccaggttcaagcgattctcctgcctcaacctcccaagtagctgggattgcaaatgcgcaccaccacgcccagctaatttttgtatttttagtagagatggggtttcacaatgttggccaggctagtcttgaactcctgacctcatgatctgtccacctcagcctcccaaagtgctgggattataggcgtgggccactgcgcctagcctgaaaaaaaaaacaaaactatttttaaattcatatggaaccaaaaaaagagcctgaatagccaagacaattctaagcaaaaagaacaaaactggaggcatcacattacctgacttcaaactatactacaaggttacaatactaaaacagcatggtactgatacaaaaacagatacatagaccaatggaacagaataaagaactgtgaaataagatcacacacctacaaccatctgatctttgacaagtctgaccaaaacaagtaatggggaaagaattccctatttaataaatggtgctgggagaactggcttgccatatgcagaaaattgaaactaggcccgttccttaaactatatacaaaaattaattcaagatggattaaagacttaaatgtaaaacccaaaactataaaaacgctagaagaaaatctatgcaatactcttcagaacataggcatgggcaaagatttcatgatgaagactccaaaagcaattgcaacaaaagcaaaaattgactaatggaattaattaaactaaagagcttctgcacagcaaaggaaactatcagcagagtgaatagacaacctgcagaataggagaagatttttgcaatctatacatctgacaaaggtctaatatccagagtttacaaggagcttcagcaaatttacaagaaaaaaacaaacaaccccattaaaaagtaggcaaaggacatgagcagacacctctcaaaaaaagacatacatgcagccaacaaacatatgagaaaagttgaacatcactgataattagagaaatgcaaataaaaaccacaatgagataccagagtggctattaataagtcaaaaaacaagagatgctggtgaagtcacagagaaaaagcaatgctttcacactgttggtggaaatgtaaattcgttcaaccattgtggaagacagtgtggtgattcctcaaaaacctagaggcagaaattgacctagcaatctcattactggatacatacccaaaggaatataaatcattctattataaagatatatacacgcatatgttcattgcagcactattcacaatagcaaagacatggaatcaacataaatgcccatcaatgatagactggataaagaaaatgtggtacatatacaacatggaatgcgatgcagccacataaaggaataagaccatgtcctttgcagggacatgaatggagtgggaagccattatcctcagcaaactgacccaggaacagaaaacaaaacaccatgtgttctcacttataagtgggagctgaatgatgacaacacatggatacatgggggagaacaacacacactggggtctgttagagggcatggggctgggggagggaagcaccaggaagaatagccaatggatgttggccttaatacctaggtgatgggacgatctctgcagcaaaccaccatggcacacatttacctacgtaacaaacctgcacattctgtacatgtacccctgaacttaaaaaaagggtggagaaaaaaagattaaaaagttacagtaagctaagattaatttattattaaagaaagaaaatgatttttaaaattaatttagtgtagcctaaatgtacagtgtttataaagtctaagtagtgtatagtaatgccctagacttcacattcactcgccactcactgacacccagagcaatttccagtcctgtaagctccattcatggtaagtgctctagacaaatgtgccagtttttaaaaaatcttttaaccacatttttgtggcaaaattttgtgggaaaattcaaagtcttttttctactgttcttacaccccaacaactatcaacacagaaggcttctgcgatgaaatgtaggggatttctccccaaaaacaagcaaacaattggttctgttatggacgccagctgggtatcctctaactcaattctgacactatctccctggagataattttagatcccgcaagttgatggctcagtcctcacgactgtcaccctctcacttctgatgacaatctcaagccccagattattttgcctgtgttgctaactcactgactataaatcagggttcccaaaacccaccctcaggtttgattgatttgctagaatggctcatagcatgccaggaaacacttacatacattaaccagtttatttaaaaggatattttaaaggataaagagccacatgaagagataagagccacatgaagagatacatagggtgaggtctgaaagggtcttgagtgcaggagcttctgccccatgtgtttgggaagtgctaccctccctggcacatgtctgagttattgttcaccttcctataagcctccctgtgttcagccatacagaagctctctgactcttcccttttgggttttgatggaagccatatttcttaggcatgattcattacatcatggccatcagcttaaccttcagcctctcttgccttcctgccaatggtataatcctatgtctaaaaaaatctaaagatgccaccaaaaaacaattagatccaataaataaattcagtaaagtggcaagatgcaaaatcaacatgcaaaaatcaatataatgtctacacattagtaatgaagtagctaagaaagaaatttaaaagcagtcccatttatgatagcgacaaaaaccccccagaaaaacaggaataaatttaagcaaggaaatgaacaatctctttacaaaaacctacacaacactggggagcagttccaagatggccaaataggaacagctccagtctatagctcccagcgtgagccatgcagaagatgggtgatttctgcatatccaactgaggtaccagggtcatctcactggggcttgtcggacagtgggtgcagaacagtgggtgcagtgcaccgagcataagctgaagcagggcaaggcatcgcctcacccaagaagcacaaggggtcaggaaattccttttcctagccaagcaaagctgtgacagacggcacctggaaaatcgggtagctcccaccctaatactgcgcttctccaatggtctgagcaaatggcacaccaggggattatatcctgcacctggctcggagggtcccaagcccatggagcctccctcattgctagcacagcagtctgagatcaaactgcaaggtggcagcaaggctgggggaggggcgcccaccattgctgaggcttgagtaggtaaacaaagcgaccgggaagcttgaactgggtggaaccaactgcagctcaaggaggcctgcctgcctctgtagactccaccgctggaggcagggcatagccgaacaaaaggcagtagaaacctctgcagacttaaatgtgcctgtctgacagctttgaagagggtagtggttcttccggcatggagtttgagatctgagaatgaacagactgcctcctcaagtgggtccctgacccctgagaagcctaactgggaggcatctccctgtaggggcagactgacacctcacacggccaggtacccctctgagacaaaacttccacaggaacgatcaggcagcaacatttgctgttcagcaatattcactgttctgcagcctctgctgctgatacccaggcaaacagggtctggagtggacctccagcaaactccaacagacctgcagctgagggtcctgactgttagaaggaaaactaacaaacagaaagaacatccacaccaaaaccccatctgtacgtcaccatcatcaaagaccaaaggtagataaaaccacaaagatggggaaaaaacagagcagaaaaattgaaaattctaaaactcagagtgcctctcctcctccaaaggaatgcagctcctcaccagcaacggaacaaagctagacggagaatgactttgatgagctgagagaagaaggcttcagacgatcaaacttctccaagctaaaggaggaagttcaaacccattgcaaagaagttaaaaaccttgaaacaagattagacgaatggctaactagaataaccaatgcagagaagtccttaaaggacctgatggagctgaaaaccatggcaggagaactacgtgatgcgtgcacaagattcagtagccgattcaatcaactggaagaaagggtaacagagattgaagatcaaatgaatgaaatgaagcaagaagagaagtttagagaaaaaagaataaaaagaaatgaacaaagcctccaagaaatatgggactatgtgaaaagaccaaatctacgttggcttggtgtacctgaaagtgacagggagaatggaaccaagttggaaaacactctgcaggatattatccaggagaacttccccaacctagcaaggcagaccaacattcaaattcaggaaatgcagagaatgccataaagatactccgtgagaagagcaactccaagacacattaattgtcagattcaccaaagttgaaatgaaggaaaaaatgttaagggcagccagagagaaaggttgggttacccacaaagggaagcccatcagactaacagcggatctctcagcagaaactctacaagccagaagagactgggggccaatattcaacattcttaaagaaaagaattttcaacccagaatttcatatccagccaaactaagcttcataagtgaaggagaaataaaatactttacagacaagcaaatgctcagaaattttgtcacctccaggcctgccctacgagagctcctgaaggaagcactaaacatggaaaggaacaactggtaccagccactgcaaaaacatgccaaattgtaaagaccatcgatgctaggaagaaactgcatcaactaacaagcaaaataaccagctaacatcataatgacaggatcaaattcacacataacaatattaaccttaaatgtaaatgggctaaatgttccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcccagtctctgataaaacagactttaaaccaacaaagatcaaaagagacaaagaaggccattacataatggtaaagggatcaattcaacaagaagagctaactatcctaaatagatatgcacccaatacaggagcacccagatccataaagcaagtcctgagtgacctacaaagagacttagactcccacacaataataatgggagactttaacaccccactgtcaacattagacagatcaacgagacagaaagttagcaaggatatccaggaattgaactcagttctgcaccaagcggacctaatagacatctacagaactctccaccccaaatcaacagaatgtacattcttctcagcaccacaccgcacttattccaaaattgaccacatagttggaagtaaagcactcctcagcaaatataaaagaacagaaattataacaaactgttgctcagaccacagtgcaaccaaactagaactcaggattaacaaactcactcaaaaccgctcaactacatggaaactgaacaacctgctcctgaatgactactgggtacataatgaaatgaaggcacaaataaagatgttctttgaaaccaatgagaacaaagacacagcataccagaatctctgggacacatttaaagcaatgtgtagagggaaatttatagcactaaatgcccacaagagaaagcaggaaagatctaaaattgacaccctaacatcacgattaaaagaactagagaagcaagagcaaactttacattcaaaagacagcagaaggcaagaaataagtaagatcagagcagaacttaaggagatagagacataaaaaacccttcaaaaaatcaatgaatccaggaggtggttttttgaaaagatcaacaaaattgatagaccgctagcaagactaataaagaagaaaagagagaagaatcaaatagacacaataaaaaatgataaaggggatatcaccaccgatcccacagatatacagactaccatcagagaatactataaacacctctacgcaaataaactagaaaatctagaagaaatggataaattcctcaacacatacaccctcccaagactaaaccaggaagaagttgaatctctgaatagaccaataacaggctctgaaattgagtcaataattaatagcttaccaaccaaaaaaagtccaggaccagatggattcacagccaaattctaccagaggtacaaggaggagctggtaccattccttctgaaactattccaatcaatagaaaaaagggaatcctccctaactcattttatgaggccagcatcattctgataccaaagcctggcagagacacaacaacaaaaaaaagaattttagaccaatatccctgatgaacatcaatgcgaaaatcctcaataaaatactggcaaactgaatccagcagcacatcaaaaagtttatccattgcaatcaagttggctttgtccctgggatgcaaggctggttcaacatatgcaaatcaataaacataatccatcacataaactgaaccaatgacaaaaaccacatgattatctcaatagatgcagaaaaggcctttgacaaaattcaacagcccttcatgctaaaaactctcaatacactagatattgatgaaacgtatctcaaaataataagagctatttatgacaaacccacagtcaatatcatactgaatgggcaaaaactggaagtattccctttgaaaactggcacaagacagggatgccgtctctcgccactcctattcaacataatgttggaagttctggccagggcaatcaggcaagagaaagaaataaagggtattcaattaggaaaagaggaagtcaaattgtccctgtttgcagatgacatgattgtatatctagaaaaccccatcatctcagcccaaaatctccttaagctgataagcaacttcagcaaagtctcaggatataaaatcaatgtgcaagaatcacaagcatttctgtacaccaataacagacaaacagagagccaaatcatgagtgaactcccattcacgattgctgcaaagagaataaaatacctaggaatccaacttacaaaggatatgaaggacctcttcaaggagaactacaaaccactgctcaacaaaataaaagaggacacaaacaaatggaagaatattccatgctcatggataggaaaaatcaatatcgtgaaaatggccatattgcccaaggtaatttacactttcaatgccatccccatcaagctaccaatgactttcttcacagaattggaaaaagctactttaaagttcatatggaaccaaaaaaaaagcctgcattgccaatacaatcctaagccaaaagaacaaagctggaggcatcacgctacttgacttcaaactatactacaaggctacagtaaccacaacagcatggtactggtaccaaaacagagatatagaccaatggaacagaacagaggcctcagaaatgacaccccacatctacagccatctgatctttgacaaacctgacaaaaacaagaaatggggaaatgattccgtatttaataaatggtgctgggaaaactggctagccatatgtagaaagctgaaacaggatcccttccttacaccttatacaaaaattaattcaagatggattaaagaattaaatgttagacctaaaaccataaaaaccctagaagaaaacctaggcaataccattcaggacataggcatgggcaagaacttcatgactaaaacaccaaaagcaacggcaacaaaagccaaaatagacaaatgggatctaattaaactaaagagcttctgcacagtaaaagaaactaatatcagagtgaacaagcaacttatagaatgggagaaaatttttgcaatctacccatctgacaaagggctaatatccagaatctacaaagaacttaaacaaatttacaagaaagaaacaaacaaccccatcaaaaagtgggccaaggatataaacagacacttctcaaaagaagacatttatgcagccaatagacacatgaaaaaatgctcatcatcactggtcatcagagaaatgcaaatcaaaaccacaatgagatagcattcatgccagttagaatggtgatattaaaaagtcaggaaacaacagatactggagagggtgtggagaaataggatcacttttacactgtcagtgggagtgtaaactagttcaaccattgtacaagtcagtgtggcaattcctcaaggatctagaactagaaataccatttgacccagtgatcccattactgggtatatacccaaaggattataaatcaggctactataaagacacatgcacacatatgtttattgtggcactattcacaatagcaaagacttgacaccaacccaaatgtccatcaatgatagactggattaagaaaatgtggcacatatacaccatggaatactaagcagccataaaaaaggatgagttcatgtcctttgcagggacatggatgaagttggaaaccatcattctgaggaaactatcacaaggacagaaaaccaaacactgcatattctcactcataggtggaaactgaacaatgagaacacttggacacagggcggcgaacatcacacaccggggacagtcatggagagggggctgggagagggatagcattaggagaaatacctaatgtaaatgacgagttaatgggtgcagcaaaccaacatgtatacctatgtaacaaacctgcacattgtgcacttgtactctagaacttaaagtataataaaaataaataaataaaattaaaaaggaaaaaatatatatgtagaatatatataatatatgtatttatttatttatagaaagagaaattgaaaaaattctgaaaataaatgataatggaaatgcaacataccaaaacctaagggatacagtgaaagtaatactaagagggaagtttatagctataagtagctacatcaaaaaaaaaagaaaaacttcaaataaacaatacaacaatgcatcttaaatagctagaaaagcaagggaaaaccaaacccaaaattagtagaagaaaagaaatatgaagatcagaacaaaagtaaatgagtttgaaatgaagaaaacaataccaaagatcaatgaaacaaaaagtaagttttttgaaaagttaaacaaaattgacaaatcattagccagactaacagaaaaagacagaagacccaaataaataaaatcaaacatgaaaaaagagacattacaactgatactgcagaaattcaaaggatcatcagtggctactatgggcaactacatgccaataaattggaaaacctagaagaaatgggtagattcctagatacatataacctaccaagattgaatggtgaacaaaatccaaaacctgaacagaccaatagcaagtaatcagataaaagtcataacaaaaagtctcccagcaaagaaaagccctgatggcttcactgctgaattctaccaaacatttaaagaaaaactaataccaatcctgttcaaactgttccaaaaaattcaggaaggaatacttccaaaatcatcctacaagggcagtattaccctgataccaaaaccggacaaagacacatcaaaaaaaggaagctataggccaatattactgacaaatattgttgcaaaaatcctcaacaaaatactagcaaataaaaatcgacaacacattaaaaagatcattcctcatgaccaagtgggatttatcctagggatgcaaggatggttcaaaatatgcaagtcaatcaatgtgatacatcatattcaacagaatgaaagacaaaaaccatataatcatttcaattgatgctgtaaaaacagtcaataaaattcaacattccttcatgataaagactgtcaaaaaactgagtatagaaggaacataccttaacataataagccattatgtacaacaaacccacagctagtatcatactaaatgaatggggaaaaattgaaggcctttcctctaagatcagtaacacaacaaggttgcctgctttcaccaccgttattgaccatagtattggaaaccctagctagagcaatcagacaagagaaagaaatagaagtcaaattatccttgtttgcagatgatataatcttatatttggaaaaatctacaagactccaccaaagaactattagaactgataaacaaattcagtaaagttgcataatacaaaatcaacatacaaaaatcagtagtagccaggtacagtgtctcatgcctataatctcagcactttgggagatagaggagggtgtatcacttgagcctggaagtttaagaccagcctaggcaacttagggagactgcatctttaccaaaaaaaaaaaaaaattgtaattagctgagtgtggtgacatgtgcctgtggtcccaactacttggcaggctgaggttgtaggttgagactgcagtaagttgtagtcatgccactgcactccagcctgggaaatatggcagacgctgtctcttaaaaaagaaaaattaataagacgtgatagtgcatacctgtggtcccagctgctcaggaagctgaggcaggaggaccacttgagcccaagaagtcaaagcagcggtgagctgtgttcataccactgcactccagactgggcgacagagcaagaccctgtctcagaaaaaagggaaaccctggacattcctacacctgaggcctcttcaatggctgctgccaatgactttggccacaagggatgatgtatgaaggaaacatgggccctgaaataaaattggtctgaatttgaacatggcctttaccatttttttattactatggacaaattaccctcattactgagcattggtttcttaatatataaactgggagtaatatccccaattaataacaatgggacatagcaggatggggttgcccttttcacccttttcatccctcctctcactcactggatgagagtttctacacaataatcaattggtgctgtgctgtgctgtgtcactttgcatctgctcatgagaggatattttgtctttaagatgcctactctaaagatatgaagagctaggaaaatggtaattgctgcccttaagcaagcacttggtgcagtggcagaacaaagttggaattttggggttggggtagacaaggaaagagggctgcagacttagggaagaagaacaccttgttggccatgtgaggagcatccagcacttgctacagttagtgggagcaaaacagtacagagataggtaaatcatgctgtggactgtgagtatattcttgatcagccagtgattattccactctctactgcctttaattggagatctacattaagctacacacacaaacacacacacagcttatctgggtagggatgaataagaaaaccggtccttttcacaaagatctgcagctgaaattcacatcatctgcatggtccaaaatgggaatccactgatgctgtaagtccatccagcctagtggagcatagtgtgggctagataaggatgatatgaaataatgaatgcaaaacaccagcacaggaagcggaatatggcacatgtgcaaaacactgcccattccttgtaaagccaaaatagtatgtatttatttaaaggacctgggtcttcgagtcagacagacctggatatcctgggactgctctgatcagcatgacatacagaaagctatttgaggcttcatagagctcagttctttgtctgtaaatactttcttttgtgtgaaaattaaattaaatagcaatagggcttgtaacacatttgacacaattgctggtactgcaatttgtggtgctaatgacaacgttagtgatgatgattttcttctgtagggcaccatgttctctagggaatggtgaattctagaggccaagtcttaccctaaagttccatgtcaccctatgaaaaagcatttgggataaaacaggcttttgagtccctctaaaaacagagcatgtgagtagttggtatggggatccgagttgggttggggaaagaggcaattatttttattcccttcagtatgttctatcctctctgatatttctaaattatctacactttctccatcaacattccctttttaatttgtaaatataactttttctcattataatgtaatatatattcactgcagaaaaattaccaaatatttcaaatgatcaattacaaatttaaactatcccatgatccttacagcagagatatgtggtttcatttccttctagtcagttatatattttcctgctgctgccccattactggatgtgtgccattctctctctctctctatctctctctctctctctctctctctctctcccacccccaaagttatgaccacagacctcagtggcccacagccctgcactctccaaatgccatctcccaggtcagttcactcttacaattcctcagggggctgtttctcactttgttctctgccctcacatccctccactccttccacactccctatttttaggttatacatttatttctctttcacgcaggaaaaaaaggaggacccaggtgagaaatgcatcaccatcccattactatccccaaatctgcacttgtatcctcagccttcccaccagtgatgatggatgatccccgctcctaagaccacccctgcactcaagcataagatcaatccttccttcccctatatcatcaatttccactctctactggcccatcatttctacaggcagacgtgctgtaatatctccccccaaaaaaacaaacaaaactggactaaacaaatcaaaacaaaatcttcccatcgaaatttatcccttgatctctgatcccatgtctccctgcaactactgccctatactatggcagtcttcataggacaatctctgagtctattcttcatgtagtcttttgaaacattgcattttttgttgtttgtttgtttgtttgtttttttgatacggggtctccttgtgttgccctggctggtcttgaactcctgggctcaagcaattctctttccttagcctccaaagcactaggattataggcttgagccaccacacttggcctgatagtataatgttcttacactttttctttcttttttgcaaacatttttccattttattatgacttttgtcttccaaattatctaatgaattgttcatttctatgattctgtaatcacatttttaatttccagagctcgttcttgtgtataattttacataaatgagttcctatttcataaatgccacttattttcttacatcctttatatattattgataatagtagcaggggacttgttgggtctccttgttatcttctttcacgatattatgaaattttctctcagaattcataaatgtagtggtttcacatttatcttggtaatttttgctaaatgtccgtctctctcatgacagtgcaagctccatatcatcaagatcttactttagctcttcttctatcttcaatgtctagctaatatcttgattcaccttgaaatatacaccggatgatggactttagtgtggtgtgggcagtgaagtcacacatgcccttttgtcctcccgagctctaagcctagcagctgcctgtcatagaatgttcacggacattgaaatggttcacttgcatggggtgcagagtcacactcacctaccttatgggcagagcatcaacaaaagatgagtcaattaggtgtctgagagaagatctcctggcttcaatccagcttcaccacctcctcaacctctctgagtcacatagtagattcctgatgggttttctctgatgattaaattatatattgtctatgtattatacacattattactgactgagacatattaagtgtccacaattcatagctaacatcatattgattatactattttggttgttttcattcttttgttttataaacgataattcaaggaatattcttgttatatatttttaaaaacgtgtgattttcttcttaggctacatttttagaagataagttttttgcatcaacatgatcttcttgagacattttccaaaaatgctctttagacactggggtgttttttctttgagatggggtctcactctgttcctcaggctggagtgcagtggtgtgatcacagctcaccgtagccttgacctccccggctcaggcgatcctcctgggactacaggagggtgccaccatgcctaattttttttgtattttttgtagagatggggtttcgccatgttgccctggctggtctggaactcctggactcaagcaatctgcccacctcagcttcccaaagtgctgggattacaggcattaagccaacatgcctgactctttagaaattgtatgccagtatttaatcccatcaacttttatgacagtaaatttcccctattctccactcaatattattatctttgactttcatctttgccaagctaagatatattaaacttccatcccatttcctaatccacattttaattttgttgacatttacttattactattatatttgacacttgcattttctatgccaaattatgctctaatattcattaatccttttccaaatgggacgtagatatttttaaatgttgaatttaagaaagaaaacaagaagcctctgatatctaggaactgatctgacacttatggctgggactccttgttatatgaagctggcccaatgttcattgttaagccatgttattctcctattggaccacaatcaccacaaaacaccaacattagaaagttcactctgagatgatgataaagtgaggaaatacaagaacacttcataattttgtctaagcactctctccactaataccaggggctgatgcttgtctaccaattacagctttattctgctctagtccaccctcactagagctaagatttgttgagacattcaattacagaattgcccctgcttcctgacgagtacccaatctagagtgaagcccacttcctcaccctccccaggatcacccaaccaaagcccaaatcctttaagaatttctttctaacaccctcttaccaaaacaccacatggctcacagcacctattcttgcactcaggaaccagtaataaacccaacttcttcacccactaggatatgttcctagtggactttggaagaaagcttcggacgcattattattttgtctataaattttttatgtgtctttgaggttgattatgagaaactgtctgtatatatctatgtttgtggttaccaaagagaagttttttaatttataagtacttaaaactaccctcatacttctttatggtgtttatttttaggtcatgcttagagaatccttcttcactgcccaattgtagacacttcatgtattgttccagctaggttgtgacaatgaggaaagaggagtccaagggtgaagaaaacaaaattgttggaatacaaggggaggaggggcagcaggtaaagaattctaaggtttaagtctcttgttttataatttaaaaaatatgtctacagagccttcaggatacttgacatatgtcatatccaatagtttgtcttgagaaaaatggatacttatcttctccttgtattcacctggttaaagcaaacaataacaacagaattccagtgcaatatagacaatgattagccctggcaatgggcatttttgaacacttaaaatgttgaggtgataaatcatgtttcggttaatgtctgtaccctccacttatacatatacatattaattagactttcgtgggcttgctgtgttttaaggacgtgtctaaggcccatgtggacaaatccgtgacttctcgatgaagataatttaatatatattcaatctgagagtcccaccatatattttgggggagattgaaaactatgagcactctagatatgcactgttaaatatggtaactactgggcatacatagtgtagggtttgtttttgtttgtttgttttcattattagtacaaatccattcaatgggcaagatagaccaatctattttaacataacagaatacaaatagtcaatgatagggtttcaggttgtatctaacctttaagaaattatcacttgctaggacttccagtactatgttgaaagaagtggtgaaagtgggcgtcctcgtcttgttccagttctcagggggaatgctttcatcttttctctgtgcagtataaggttggctgtgggtgtgtcataaagggcttttattactttaaggtatgtcccttctatgctgattttgctgaggcttttaatcataaagggatgctggattttatcgaatactttttctgcattttattgaaacgattatttcagagagagagagagagagggagggagggagggagagagagagagagagagatggggtgaaggaacaggctgggaacctgggaggagacccggccgcaggcgcgcagcctggaggcgatggtgagccctgccacgcgtgagtcacggaccacccccgccgcgctctgctccccgcctggctctcttcttcccagcccctcccttcctcctcctgctccactgatccctactcaggcttctttcgctgaagaattccagaagggacagaactaaggatgaagtgtggcatttgaacagggtttacggctagatcctaggaggtcattctaagggtttacattgcatcaccgtctgtggttacaaagagctttccgggagaactttccatttgtaggtttggtcagggagaccctgtgatcaccccagtgcccagagaaggaaactgaagcccagggttctgcagaggcttgcccaggctacacagatcttcagctagattcgaatagttaaaaatccaggtgatcaaaggcggagcagcgtcttccaagagcccggagagagaggacaccccactcctggacgttatattctgcagcccgctgctgggaaatcccaaggggtatgcgaccaggttggagtatcctgggcccagggcccacgaaaatggctttcactgttggaggggatcttgaatccagaatctgttcccaaaaaagagaaagaaaagcagatttgggtgacctcaaaagtttcaaactaccttcccacgtatcctaaaaaaaaaaaaaaaaaaaaaaaaaaaccttcatttttaatatataaagacactgaaaattcaacagtttaaaaaaatcaataaaataggaaagtggacaaaacacatgacaaatatttcttttaaaatgatatgtagatgggaagtgaggacacaaaaatgtggtccatatgcggagcttgcagtgagccgagatcgcgccactgcactccagccggggccacagagcgagactccatctcaaaaaaaaaaagaaaaaaaaaaaatgtggtccatatgattcatcattggggaaatgtaattaaaaccattatgagatattactacacccctatcagaatgaataaaataagaaatagaaataacaccacatgctggatgtggagaaaatggctgaatcactcattgctggtgggaatgtaaaatggtacagccactctagaaactagagtatggcgaaaaaaaaaaaaaactaaacatgccattgcactctagggcatttatcccagagaaatgaacacttaagttcacaccgaaatcagcatacagcatataaaggttcgtagcagagcagagacctgagcaggaaaaaaaaaaaaaaaaaaaaaacccactgtcacagccagacagaatcagttctggaaactcccaaaagaactagaagccaccaagaccggcagcccaccttgggcagtgacagtttctgctcaagggagacacaacctgaagaaggaaaacaagaccaaaattgagaagcaatcttttaatcacagtgtttgcaaacacatagccaggaaagaatgttagcacagaggtcagaaaggcagtcactcatggagctaggaaagggaagaggtgtgatgggagggggcaagcaaggcatttgtgggacactggacaactgtgcttcttgacctaggtggtgcttgtgtggtcatagtcgctagttaaatattgtgtacatttgtaagtaacttttctgcatatattttatatctcacaaaaaaagaaaagagatcagactcctcccagaaaaacaatgaaagaaggaggtgtcacaccaagatcagtcaaacctccttcctacatttgtaaatccatccaagcactagctctgtgaccctcagattcctcatctctattgagactcagcatctgcaagagtttaagaacaagaccatgggtagatcatactgtcataaaatagaatctgtttcttgtgatacaacatgagggaccccacctcaccccccaaaataggtactgaacaaaggttcctattcccagaaaccccctcttccatctttggattcatccctgagattgcagaatgcttctggctgaaggcaaagccccatctttatgattcccctcctccttcgtccacctctccaagatgtaggcttctccctcatgcctcagactccagggcctgtttcagggtcaggatcatagttcccttcttcagagaggaactcttaatgaagctgacccaatttgctctggagagcactggaggcacctgctaagcctctcccttcagtggagagaaattccagtggaatcccagagacccttggcaaacccactgcagaccaccctgctgaacccatctccacactcaccactgcaaggaaacttcaaactgagttctactaaaaagcaatttcggctcttacacttcctctttagtgttcttctagcttactaggcaagtaaccacagtgtgcctccattaattaataaatccccaaaacactggtcttatgaacagtgtattgatcagggctctccacagaagcagaatgaataggcgacatatatctccagttgatctgatgaggcccactcacattatggagggcaatgtacattagtcaattccactgatttaaatgtaaatcatttttcgaacacactcatgggaatacctagaataatgtttggccaaatatctgggctccttcgtgacccagtcatgttgagaaatcaaattaatcctcacaaggaacaaatcagataatattcacttggatattagactagagccttggacataccaagtgctctgtaaatgttagccttacaaatgtaaggtggtgttttagatttacagaacacagtatatcctaaggtatcacaggcttgttgatgaactctgttgggaaaaataatacatgggaaatttagttgtggaaattgaattttgttattttatttttgtctttgcttttctgtgtgagtgaaggagtataaggcaaatttctgagcacacggggcatgcactaaaggggtttcatttggcatttggagccagttttgtcacactataggaaaactaaaccgttatttaagaacttccctgccagctctcacgttggggactggctggtccatctagcctggttggttgattccaaaaatatgtgtagggaggtagagtgactaaacgtgaagaatggggaactctggaagtgcagaattgaagcccagaagggaacagaagcctccctctacttcacagaagatgactaggacatgctcatccctgggatagaaaatccattggacttggagactcagtgagttgtattcccgatctcaccactggagggaggtgggagaggcatatgagtgagtgtggaggggctcagaagcccagccagctagtgtgcaggttgccctgcagattctcaccagggctgctctgaagcccagagggcaccccagaggaggaagggaatgacaaagcctgcctggggtcacaggaaaagaggagagaggcagactgaaggaagcccaagactacaaagtgaaagaaaatgccttttagtcactcaagacattgtcagacacagactgggagcagtggctcacacctataatattagcactatggtaggctgaggtgaggccgggagttcaagaccagcctggacaacaatgcaagaccctatctctacaagaaataaattaataaaagacttcttcggacatgactagaacccaagaggtgggtacctggtagagttatatgggaagaatggagcaatgggtttggcagttggggtggggaaacagggaggaagggaatgaaaaaaactcttgagggtagatgatggtgccagtctgagaatcaagcaccagttccattctactgtgcatctagtcacgttggcatagacttccaggcaggaggaggagcaagcggtgggatcagctacatgtgggcttccaaaggtaatcccaggtgccacctctcctccatacttactaggaatcccaggcccttccctgaagtgacaccatcctgcattctttgtacctctctttccacttcttctcacagcttttccctccctcctccattctcctggccaggacccacactcaccccacctaacctctctcttttgatcagtcccatagttcagaaaggaacagaaatgccagctgaataaaaatttatttcgtgctctctgggcatgtatttgagaacaataacattgtttccggtctcaatgcactttcaccacatctgattttcagctatgtggggaaggccatctatctgatcaacccatcacccagtgaaggaaactgaggcccagagccctgaggatgcttgcccaaatcaccctgcccttcagctaaatcacccagaacaggatcttgcaagggccctaagagtcagagaagacagcagcccctcgtgttggattctcctgcctgcccaggaaactgggtgggaaccattcagattcttcctgcatgaaaagggtgacctgtgtccttggggatcctccagtggccctagttgctcctgctggggatgacctcaactcctgaatccaaccctgtaaaataagaagaaattcagacattgcaaggcatgaaaaattttctcccaatagcaaaggtgaaggatgtactcggagaggagggaacataccaagaagagaaggaaggaatatatattgaaaagaatacaaaacaaaaataaacagaccaagacgtgggatgtatagaatcaggcatcaacccatgaaaaggtgaaaaggtgaaaaggcaacaggaccagaaaggaagagggtcgcctgggtgggtggacagcacagcagaggggacgccatctccaagaagatgaccttgacaagagccaccataagtttaaaggtatggagaagacatttactcaactaagggacagttggtgaattcatttgttaaggttcatggaaagtaagaaaatgaaaacgccgggcaattatcaattctctgaaaacatcaacatgtatggaaagaaaaactaagagagtttaccatgtggctcaggtctgagtagcattcacgtaagtcagtaattttaactctggctctcaatgcactcaaaatctccacctgcctacatgaggaggatgaaaatgtgtgtgctgtggaaggtactatggactgaagggattttgaaaagtcaatacttaatatctaaaatggaaatgtttgaagtggcataaatgtatattatcaagagacataaagataaagaacaacatatgaagtaaaaggcttctatgtggttgtttgccaggaagctggtggctaggaaggattgagagggagtagaggggagaccatgttttgtaacaggggaaatgaaagggaagcaggtagcacctggagcctgcctcatgtagagaacagggttccacgcagtggtccaggatctcagggacttactgtggctgaggccacctgcccccaggacaagcccttggcactgagtctactgaaatgtgggcagggagaagaggaggccttcggaccttttacctgagcagcctggtttactctaggctctgtcttgtttcctgtccagagattaatgcaacaaactgtctccaaattcatccaagggagtggagttccttcccctactcccgatccccctcaacaccatcctttctggaagtgttattctgaacatgttctcggatttgtttttatcagtggagaaagagaggatagaagagcactcacccagcagagccagagggaggcagctccaaggactccagtggccaccagagcccaccaggacccagggctggaggtgcacagtgagatcctcagcgcagagggagaaatctcctaagggtaggaaggaataacagaattggggagcatttccttacttcacagcaagtgcaaacatgatgggaaggcatagagaaaaaggaagaaattatagggaaatgtgcttatttagggggaggcaatactgcgggaggggtacaacagacccagcactggtgggggctaggagaaacaggtataatccttgactagagaatggatacttgaggtcagaatagttactaaatgaagaggattacatacattttaaggacgttgatttacgttatactttgtcattggaatttaagggaaaagaaaggaaattaataaataaaaacaggctgcatgtggtaaaatcaatagtcagccctgggacttgtgtttgcaaaatgctttatccaggtgcgacaccgctgacgtcctggattccccaccctctagcacccagttccctctcctgtaatgagaccggggtcaggaggagagatggacagatgagcccatgctgaaggcagtcagtcatctgtgcctgcagatgagaaactgcagtttgcaccactagcctccagcacagagattccatcccagctcagtatttagtatttagagatgtagtatttagtatttagagattcctaaacactgaggggctctgcccagtctccttcctcacactgtggggccttggctttccctcccaactccacacccccaaatgctggtacaatgctcaggttcatcctggacaccgctccatccgacaggggaacacttttgatccagacgctttgacaacctcgttcagtctcctctggagagagccgccaaaccctttgctgatgagctgagactgaccggggaactgtgatctcggatgtggttgaggatcaaaatcaaaattatagtcgactcttaaagaccaagtaggctctaaccacggaattcctctctacccactgattcccccaaaagaggaagaagcctcttctctaagtacactaagctgaaaaactaagctgaagtactaagtacattcagctttcactaagctgaaacagcaaagcgctgaaacagcaaaccgcaggcataacagaaaaacctcaacttaaatagtgctgagctgcaacttgttttccgcggcttgtagtcgaggaggagcccacgaggctttagctgctgcaagatccaagcgcgctcccgcccagcggtggccccgggctcagggaaccagcgctgcttctctccgaggctcgcggcctgagaaaccttccgctccgaatgcgggctggcctctccgggaagccttgaaactcaactcctgggtgggccaggaaggttgtccgagttgggcagcgccggccggggcccccctcagagccgagctgctcgcctccctcgagacccagcgcagcctggaggagagaccgggtcctctcaggtggggcacttggtgactagagaccccatgagcccccaccctccagcctggggcgggatagcccaatcggatgctggggggtccgtttggaaaccactctctgctttgaggacacgcgcggagcttccctgggagcaggaggctctgaaggaagaggggcagacgcgaagcctctggccagccgcgcctccggtccaggcctccctgtgtccacatcaggtctcccggcttttcacaacagtgaccttgacagcgcccagagtccgcggcttccatccagtcccctcttcccctgcgaggccgagagggtgcagagctggtggcttcaggaggtggctgtgagcgcgggtctggggccaagagcagaggacaggagaagactgccaagccaccaccggtcctgcgacatattcaccagctgccggcggcgaggtcagaccccagattcgggtttgcccagcaggcgctcggcttccatgctcgctctccacctccctgcctctcttaaggaggacctggcccattaggaagcccggggcgttctgtggactgggtggtcaaaaatggtgtgtggaggagggagtcaattgagattagacgtgaaaaacggggaacctggggaccgcaggttggggcccaggagaggaccgaagcttccatccaagactaagtgaggaacactgcggcaagaggaaggaagattgagtcgcagttgacttgtggattttatcggttttagtccctgtgtgaccgccagaagtctgcagctttatccttgatgagttctgaaggcccctgaggagagctgagcccaagagactttttaattccacggaggtacttcgcctgaggcaggtctcttctgtgcccagggaaggaaggctgggagtgagggtatctgaaaatattcacatgagaaaaggtcaagtccatttttgctatcctgtactgaacacagatcaattaactggtcccaggattgatagcaacaggcctataactggtctcctggttcctatccagcccttcccccataaaggcagaatcctgtcttcttggaacagtgaatccccagcagaggacctcagcctgggctgcctggaacctgctaccctgcccaggagctgtcaacacctggagcgcagtgcaggaagaatgcaggggcgcttggtggggaggtgagtgagtgcagagggtctccgggaactccttgggcctttggggtagctccctctcagactgtcctgcaggtccttacaaggcccactactgagcaggaagaatgtccccaggagaggcaaagggtggggcaaaggcgggtatggggtcgcttgcactttgcagcaaactggagagtgagatgacaggcaaggagtactggccctcacatggaaacctatatcacactgcccaaagggaataggaaaggaaccacagcgaggtccacaggggagggctgggggaagccttacccagggcggcgagtgcagcctcagtggcagaaatcccagcgggccccctcctgctgcagaccccgctcctcctgcgaggccccagacgaagcccgacccccagctgcctgcgcagcctccaggcaggggtcgcggggtgcttcgacgagagagtctgggccaaagcgccaaaatccgccgctgtcgctcagccgcagcctgtttggggctggggagcctctcctggtcggtgatcgtcgcggacaatagacgagaccagaaattagatttggttccgggatcaagaacctttaatcagggaatggagatggcaggggacgaggcctaagagatgtagacagcaggtcctgtctgcttaggtcgcaaaggggaagaaggggcgggactcggggtcctggactggggctgggaagggtccgctccaggagggtgtgggttccgatgcctgggtcctggaggtccggggagtcgcggagggacctccctccggtaaccgacggattggggacaaatgctctgcccagtctgatcccagacatccttgtaacccaatatagttacagctccgacgccatgttcttcctgggtccagctccaacgccatgtccttcctgggtccctccaaagtagggttggaggatcaactagtggattccggcgaggaggtatcttcctccctggaagcagcagaacaaatttcagggactcgggagtccaaggcctcattccaaaaacactgagagattgggtactgggcgcacagtatgtctgtggggtcacgcagacctgggaaccagatcttagggcctgcagacctccctctgccttgagatcagactccaccgccagtaactgggaggaaacatctgtactccaggatttagagacaccgacacgggagcagggcgcccccgtgtgcacagagccctgttctgcagctggaaaccgaacgggaccctgtggaagtcgcgggtggggaagcgaaaggggagctgagcgtctgtcctcagtccttgggccacacgggggcgctgccgctctgcgctcggattctgatgagccgctctggagaggatggggcggtggtctgagtaagacacagattgttgatccagaaaggatgtatcaatgaggtggggctggggttgtccagggagtggaaaggccttctgagaagccctggactgcgcggggttccggctctgcggaacagaggagggctctggagcggcctgtctctgaggtttccaactcctccttgcaaaccctccctccagccttttcatggcaacactccaggaaaatggaaagttgatcatttttttcttccactccttaatcctttcctgactgctacttttaaataattttattttagaagagttttaaatttacataaaagttgcaatggtagtacagagttgccatccgctccacagtcagtttcccctgatgttaacatctctcattactatggtccatttgtcacagctaatgaagccattttcataccttattattactaaactgcagactttatttggagttcattagcgttcccctaatgtcctttctgtgtttcaggattccatggagaatatcacactacatttagtctccgtcgtgcctccgcggcatcctctggtctgtgacagttcctgagattttcctaatttttgatgcccttcacaatattgggaagtactgaccagatatattgtaaaatgtccctcaaactgaatttagttggggtgtagatcatggttagactatggttatgggtgtttagatgaggtgaagtgctattctccaaacaccttatcaaggttatagaatatcaatttcatgtaccactgttgatgttgaagttgatcacctggtatattagcttcctgtagctgccacaacaaatgccctcaaagttggcaacttacaacaacagaaaattattctttcacagttctggaggcccaaactgcaaaatcaatatgcagggcctcactccctctgaaagctctaagagcaaatccattccttgagtcctccagctctggcagctgcagggcattggtcagcgttctttggcttgtagccccattgctctagtctctgcctcattcttcacatcaccttctcctcttctgactctctcttctgtgtacctgttagaaagacacttgtcattggatctagagcccacctgggtcatctaggaggatctcctcatttcagtatcctccgcttaattacatctgcaaagaccctttttttccaaacaacttgacattcacagctgctgggcactaagacagaaacatatctttatggggtccaccattcaacccactacatctggctaagctaatatttccagaatggcaatccatcagtgcaccctaggttacaatcctcattctcattcccaaataaactcaacatatttggacatttctaatgtcatgttttttaggttgaataatctagtgtcagaaatgatcctgaagaaagattatctttggaagagacttatactgagtttgttgcttgatttttcctctgcttctgaatatcttttgagagcaaaatttactttctaaaatggtaaggatgagtcaactccttaaaagctgtttgggctgttgtcaccattctatgtgagccttcagtctccccaaagagaaattttttgttgtcaggataaagtggtacatgaataaacaagatttccattaggcagcgtgccagtctcaagaaaattctggagaaaatggtgacaggatagacaattagatcacaggctgcctgcacatcaagtaaaaacaaaaatcctatgctaggcacacactattaaaaaacaaatcgctccaacccctaccatttcctcacagagattatagaatttttcttttgctgttgagaaattaataagaggcagaacaggatgccaaaactccaaagcatccaatataggccctcttctgggactcctgtcagctatatgttcaaaaattattgtcagtggctcatgcctgtaatcccagcaccttgggaggccgaggtggaaagattgcttaagctcatgagtttgaaaccatcctgggcaacatagcaagagttcatctctattttaaaaaattaaggccggtcgtggtgcctcacgcctgtaatcccagcattttgggaggcccaggcaagcggatcgcctgaatttgggagttggaggccaacctgaccaacatggagaaaccccgtgtctaataaaaatacaaattcagccagatgtggttgcgcatacctgtaatcccagctactcgggaggctgcggcaggagtacagcttgaactcgggaggcagaggttgcagtgagccgagatcatgccattgcactccagcgtgggagaaaagagggaaacttcatgtcaaaaaaaaataaaaataaataagaaaagaaaaaaattaaggtcgtctcttgtgtactttttaaaatcaatggatagagtatagcaaagttaatttggatcttcaatggccatccttggggtcttttgagttccccaaacttgtctttcttaaaactaaagtaggctgggcgcggtggctcacgccggtaatcccagcactttgggaagtcgaggcgggcagatcacgaggtcaggagattaagaccatcctggcttgcacggtgaaacctcgtctctactaaaaacacaaaaaaattagctgggcatggtggcaggtgcctgtagtcccagctactctgggaggctgaggcagaagaatggtgtgaatccgggaggcggagcttgcagtgagcccagatccagccactgcactacagcctgccgacagagtgagaatccatcttaaaaaaaaaaaaaaagaaaagaaaagaaaagaaaaaagaaagaaatttctgcattacctatggatgttaaatctacttgagtagactttaattccaagtttgtgaatagcttttcttcaaaacatgctgaacttggtaaaagagccagcaatttagggaaactatgtgcacttctgatcttgtccatttgataaatcacctgcctgtccccttgaggaccctactaagaaaactgcttaaaaactttttttaaaattttttctttttgagatgaagtctcactctgtcaccaggctggagtgcagtggtgcagtctcgactcactgaaacctccacctcctgggttcaagcaattatcctgcctcagcctcccgagtagctgggattacaggtgcccaccaccatgcccagctaattttttgtatttttagtagagacgaggtttcaccatgttggccaggctggtcttgaattcctgacctcaggaatccctgactctccaaatgtccccacttgttatgtcattcccactgacaaaacaaaaataatgctatcttgtgttaggctgttcttgcattgctataaagaatacatgagactgggtaatttataaagaaaaatgagtttaattggctcacagttctgcaggctttatgggaagcacggtgctgggcatctgatcagcttctgatgaggtcgcaggaagcttaccatcatggcagaaggcaataggggagcaggcacgtcacatagcgaaagcaggaacgagagagagagtgggaggggaaggacgccacacacttttaaacaaccagctctcactatttcaaagacagcaccaaggggacggtgctaaaccattcctgagaaatgtgcccccatgatccaatcacctcccaccaagacccacctccaacactggggattacaattcaacatgaaattggggtggggacaaatatacaaactacatcacaccctttcactgctgaatctaatacctgtctctgtataggcaaaactgttgatattggcaaactttataatatacctcctataaaaatccagcttgatccatcaaaacccctgcctaatatcaaacaatatccacttaaaccagatggtgttataagtcattaaacctattacagaaggacataaaaagcaaggcctcattattccatgtactcatccttctaacaccctaattatacctattaaaaaccaaacaactgggattaaaggtttgctcaggaattctgagcaataaactatatagtgattccaagacatcagtggttccaaatccctatatctcattaaactcacaacctattgataggaggtttttcactgtcattgatctatgaagtgcattcttcagtaatccagtggatcaggccagccagtatctttttgcctttaccttggaaggccaacaattcacctggacagtaatgcctcttgcttttactgaaaacccttcctgtgtttttcaaatattaaaggaacacttggaggagatagtttctccttaaggttccaccttactacaatatatagatggccgccttctttgctctgcttcacagatagcctatgaaaaaaatggtgtacaactgttaaagcaactgactgctaaagaccatgaagtctctgacgaaaaattgcagctagtgaaaactcagaagaaatatttgggacacttaacttcagaaaatggattacatttagacccagattggcactttgtaatttcttcagtcaagaaccaagtgccacagaaaaacacagaatattataatgctgtatttgtggtgtgtaaactactcgtgtcttaagtagaaagcataaaaggtgaaccaataaaaaataataactacaagacttttcaacacatagacggtacaaggccagctgcagtggctcatgcctgtaatcccaggacattgagaggctgaagtgaacagatcatttgaactcaggagtttcagactagcctgggcaacatggcaaaacccagtctcttttaaaaaatggaaaaaattagctggttatggtggcacgtgtctgtggtaccacctacttaggaggctgaggtgaaaggattgcttgtgcttcggaggcagaggttgcagtgagctgagattgtgacactgcactccaggctgggtgacagagtgagatcctcatctaaaaaaagacatagatggtataagaagatataaatagaaacaacaaaaagttaaaaagaaagaggatggagttaaagtgtgaattcttattacatatctttcggtttttgtttatacaagcagtgttaagtttttatcagattaaaataatggttataagatatctgcaagcagcctggtgatctcaaatcataaaaaatgcaacagatatacaaaaaataaacaacaggaaattaaatcatatcaccagagaatcaccttcactaaaaggaagacataaaggaaggaaagaaggaagagaaaacaagcaaaacaacgagaaaacaaataagaaaatgtccttctttatcaataataacactgaatgtaaatggtctaaactctccaatcaaaagaaatggagtggtggaatgaataaaaaaaaaaaaaaaaaaggacccaatgatctgttgcctacaagaaacacactcacctataaacacacacatagactgaaaataaagggatggaaaaagattggtcatgccaatggaaatcaaaaaagtgcaggagtagctatacctatatcagacaaaatagattttaagataaaaactataagaagagacaaagagggtcactatataatgataaaggggtcaattcagtaagatgctataacaactataaatatacataccccaacactggagcacccagctgtataaagcaattattattagagctaaagagaaagatagatctcagtacaatcatagccagagacttcagcagcccccgtttcagcataggacagatcgtttagacagaaaagcaccaaagaaacattggacttgatctgcactatacattaaatggatctaatagatatttacagcatatttcatccaagagctgcagaatacacatatttcttctcaggacatggatcattctcaaagacaggccaaatatttggtcacaaaacaagtcttagaacattcaaaaaattgaaataatatcaaacatcttctctgacaacaatggaatagaactggaaattaataacaagaggaattttggaaactatacaaacacatagaaattaaacaatatgctcctgaatgcctggtgggtcaatgaagacattaggaaagaaatttaaaaattttttagggagaggggtggagcaagatggctagatagaagacttcactaaccgtccccctgcaacaaagataccaatctaacaactatctacatttaaaaaaagacaaaatcaccttcactagaaacaaaagttatgtgagcattcacaaaacctggtttttaacttcatataactgaaagaaacactgagaagggtaggatgttgtcccgaattgccaatgccgccccagccccatcctccagcagcagccctgcagtgtggagaatcatgcacttgggagagggagaacacagcgattgtgacacattgcgttgaactcagtggtgccctgatatagagttatattggaagaatggagcaatgagtttggtggttggggtggggaaacagggaggaaaggaatgaaacaaacactcgagggtagaagatggtaccagtctgagaatcaggtgccagttcttttctactgtgtgtctagtcacattggtgtagacgtccaggcaggaggagaagcaagttgtaggatcagctacatctgggcttccaaaggtaatctcaggtgccacctctcctccatacttactaggaatcccaggcccttccctgaagtgacaccatcctgcatcctttgtaccctgctttccacttcttctcacagcctttccctccctccctccttcattctcctggccaggacccacactcaccccacctaacctctctcttttgatcagtcccatagtttagaaaagaacagaaatgccagctgtggtcaggtgttttaaaaatttattcagtgctctctgggcatgcatttcaggacaataacattgtttctggtctcaatgcactttcaccacatctgattttcaactatgtgagttaggacacctatatggtcaatcaatcaaccagggaaagaaactaaggtccagagccctaaggatgcttgcccaaatcaccctgattttggcagaacaggatcttccaagggccttaagagtcagagaagaccgcagccccttgtgttgtattctgctgcatgccggggaaactggatggaaacgattcagattcttcctgcatgaaaaggacaacctgtgtccttgggaatcctccagtggccccagttgttcctgctgggtgtgacatcgatgcccgaatccaaccctgtaaaatagggtgaaattcagatattgcaagtcatgaaaaattttctcctgatagcaaagttgaaggataacaaaactgaaggagggaacataccaaacagaggaggaaggaatatacaaaaaataacaacaacaacaacatcaaccaacaacaagaacaaaaaaaataccaagatatgggatgtatgaaatcaggcatcaacccatgaaaaggtgaaagggcaacaggaccagaaaggaagagggtcacctgggtgggtggacagcagaggggaagccatctccaagaagatgaccttgacaacagccaacataagtttaaaggtattgagaagacatttactcaactaaggaacagttggtgaattcatttaaggttcatggaaagtaagaaaatgaaaatactaggcaatgatcaaatcttgaaaacttcagcatatgtggaaagaaaaactaagagagtttaccatgtggctcaggtctgagtagcagtcacgtaagtcagtaattttaactctggctctcaatgcactcaaaatctccacctgcctacacgaggaggatgaaaatgtgtgtgctggggaaggtactatggacagaagggatattgaaaagtcaatacataatatctaaaatggaaacatttgaagtggcataaatgtatattatcaagagacataaagataaagaacaaaatatgaagtaaaaggcttccatgtggttgcttgccaggaagctggtggctaggaaggattgagagagagtagaggggagaccatgttttgtaacaggggaaatgaaagggaagcaggtagcacctggagcctgcctcatgcagagaacagggttccacgcagtggtccaggatctcagggatttactgtggctgaggccacctgtccccaggacaagcccttggcactgagtctactgaaatgtgaggagggagaagaggaggccttcagatatttgacctgagcagcctggcttactctagactctgtcttggctcctggccagagattaatgtagcaaattgtctctaaattcatccaagggagtggagttccttcccctactccttatccccttccacaccatcctttctggaagtgttattgtgaacatgttctcggatttgtttttatcagtggagaaacagaagacagaagagcactcacccagcagagccagagggaggcagttccaaagactccagtggccaccagagcccaccaggacccagggctggaggtgcacagtgagatcctcagcgcagagggagaaatctcctaagagtaggaaggaataacagaattaggaagcgtttccttacttcacagtgagtgcaaacatgatgggaaggcatagagaaaaagtaagaaattatagggaaacgtgcttatttagggggaggcgatactgcgggaggggtacaccagacccagcactgccgtggggtaggagaaacaggtataacgcttgactagagaatggatacttgaggatcagtatagttactagatgaagaggactacatacattttaaggacattgatgtacattatagtgtatcattggaagttaagggaaaagaaaagaaacttcataaataaaaacaggctgcatgtggtaaaatcaataatcagccctgggacttgtgttttcaaaacgctttatccaggtgtgacacctctgacatcctggattccccaccctctagcacccagttccctctcctgtaatgagaccagggtcaggaggagagatggacagatgggcccatgctgaaggcagtcagtcacctgtgcctgcagatgagaaaccgccgcctaacctttctgaacctcatgcggaaaaaatgtttgcaccactagcctccagcacagagattccatcccagctcagtatttagtatttagagatttagtatttagtatttagagattcctaaataccgaggactctgcccagtctggtttgaccatgctcctccttcctcacactgtggggccccagctttccctcccaattccacacccccagatgctggtaccatgctcaggttcatcgtggacaccactccatccgacatggcaacacttttgatccagccgctttgacaacctcgttcagtctcctctggagacagccacccagacctttgctgatgagctgggactgaggggaaaaggcctgcgatctctgatggggttggcaatggacaccaaagtcgtcttctaaagaccaagtacgctctaaccacggaaatcgtctctaaccactgactcctccagaaaaggaagaaagaagcctctctacactaagctgaaacactaaatacactaagtgttgattaagtagactaggtacactaagtggtaaacttggtaaacttagagcactaagtacactaagtacaataaatggtaaacttggtaaacttagagcactaagtgcactaagttcactaagtaataatattagtactaagtggtacactaagctgaaaccgcaaaccgcagccatggcagaggaacctcagcttaaatagtgtggagcggccactggtttccgcggctcgtagtcgcgcccgcgaggaaacgccagggaggcttcctgccccgcccagcggtggcccagggcacagggaaccacggctgcttctctccgaggtttgtggcctgagaaactctccgctgcgaatctgggctggcctctccgggaagccttgaaactcaactcccgggtgggccaggaaggctgcccgacttgggcagcgccggccggagccttcttcaaagccgagctgttcgccgccctcgaggcccaggcgagcctggaggagggaccgggtgcgctcagatggggcccttggtgactggcgaccccatgagcacccaccctccagcctggggcgggatggcccaatcgggcgctgtgggggtccgtttggaaaccgctctctgctttgaggatacgcggggagcttccctggaagctgtgaagaggggcagacacgaggcctctggccagccgcgcctcgggtccaggcctccctgtgtccacatctggtctcccggcttttcacaacagtgaccttgacagcgcccagagtccgctgcttccgtccagtccgctcttcccctacgtggccaagaggacgcagcactggcggcttcaggaggtggctgtgagcgcggggctggggccaagagcagaggaccagagaggagtctccaagccaccaccggccccgtcaccggctaccggctaggtcaggccccagattcgggtttgcccagcgggcgctcggcgtccacgctccctctccaccttcttgcctctctaaggaggacctggcccactaggaagcccggggcgttctgtgaactgggtggtcaaacacggtgtgtggggaaggggccaattgagattagacgtgaaaaaccgcgaacctggggaccgcagggttggggcccaggaggggcccgaagcttccatctaagacaggtgactaagtgaggggcacaggtgcaacagaaagaaagactgatttgcaattgacttgtaggtgtaatcggttttagtccctatttgaccaccagaggtctgcagctctatccttggtgagttctgaaggcccctggggagagctgagcccaagagactttttaattccacagaagaacttcgcctgaggcaggtctcctctgtgcccagggaaggaaggctggacgtgatggtttctgaaaaaagttacacagagaaaaggtcaagtccatttttgctatcctgtactgaacacagatcaattaactggtcccaggattgatagcaacaggcctataactggtctcctggttcctatccagcccttcccccataaaggcagaatcctgtcctcttggaacagtgaatccccagcagaggacctcagctcccaagctccattcagcctgggctccctggaacctgctaccctgcccaggagctgtcaacacctggagtgcagtgcaggaagaatgcaggggcgcttgatggggaggtgagtgagtgcagatggggttcctggaactccttgggcccttggggtagctcccactcaggctgtcctgcaggtcctcacaaggcccactactgagcaggaagaatgtccccaggagaggcaagaggtggggcaagggcgagtatggggtcccttgcatttgcggcaaaatggagagggagatgagaggcaaggagtactggccctcacatggaaacctatagcacactgcccaaagggaatgggaagggaaacacagccacgcacgtccacagaagacttggcagatgggagagggtagctttgaggactgaaatccctacttcacaggactctggatacttggacacttgcttcctcctgtgcttctgtacgaatctcaggactgtgggacactctctgcactcttattcttgtaattctcttctctccggatggcctcctttcccttggagtgcagcagtggccatcagattcttgggctgaaggtcactgggtgactgtgggattctggggccagttacttccctttcttagccaccccatgctttacagaactgaactccacagtcatactcatctctcccagtgaagctcaaaggaattattaataaaaaacacaaaaacataaatggaatgatgtttatggaaccaattgattaacgtggaaaagtatgggcttcccagttttctgcccttcgtgagaacttaatcctgaaacactgatctcatgtcaaccttctgccttaactgggaattcctgtggccagtctgttctaagggtatcccgtgagcccctagggatggagaacagaaggccacttttcctaaacacacacgtggttctgtcctggccagatcagtggacttccagtgtccttcctgagtcacaccgaggtgaattgcatagaccagaaacccacattttaaaaagaataaaataaaataagtggcctgtagtgtgggggctggggttggtgcgggcttccggcttggccgcgggtgtctgcatcgttcagccccggggcttttgtgtcgggtctggcctggctttctgtccgcaagtttttgccctgctccgcggcgctcctccggggcgggagccgcgaggcccgggcgagctcgggcgggaccggaggctgcgaaggctgccgggagcgggactcgcagctcctggatatgccagcgttcctggaagactcctgggtcctgacgaaagacaagttgatgagtgagttggtcgccattaaagtgaggctcccggcccggagcagcgcagagaccaggacgcgcagcctcgcctgcagcactcggccctacctctaccccgccgctacctctaccccgccgcggcgccgacagcgagggccccgcctcccccagctggctccagagccaagccacccacagcaggaaagccacgaagaaaacagttcaactcagaccaaaagataaagctgatctcgaggtaaccgcgctcactaatgaagatctcgtggacccgcttgcgaggtataaagagaaacctagtcctactggagaacaaccaggaagcgatgtgagaaaaaaaccttgaaaccgaaggaacgaggacgatctgtcgcccaggctggcgtgcagtggcgcgatctcggctctcggctcactgcggcctccgcctcccgggttcaagagattctcgtgcctcagactcctgagtggctagaaccacaggcatgcgccacctcgcctggctacattttttttttttttttttttttttttttttttttttttttttgtatttttggtagggacgggctttccccgtgttgtccaggctggtctccaactcctgagctcaagggatctgcccatctcggcggattaacaatttaatcttcagcagaaaatggaaggcagaattgaaataaaggttctaatagatactgtgacaatgaagaagactagagtaaagatcaagcttgagaagacagaaccactaaagggcagagcaaagactccagtaacactgaagaaaagaagacttgagatagtcagagctattctcacgctggaataactgaggctgaacgcacaagtggagcttcagaaggcggagctctgcaggcctggagtagggagtctaccagagaccggaggagaaggccaaggaagagggtggaaaccagaacattttccaatagacagtgcagtaatttcagagagtgctcccacagctgaaactctaatggcttcaggacacaaaaccttcgttgtcagtaggatgactggaaatttcaagcatgcagctcctattctgcaactcagtaaattttcaaacataccccaaactccaaagagaccactggggttgggggggaacagaataaagaagagtagaaagggatattcttaaggaaatgttgccctatgaagcatctacaccaacaggaattgctgcagaccagtcaaaggggctacaggcaggccattagaactcactgagttcaggatggcagaatctttttcatctaaatatgttcctaagtgtgttcccttggcagatgtcaagtcagaaaagacaaaaaaagaatgagccatttctgtatggacaaaaattttgctgtttgttgttgtagtaggttttgtttgtttgttttttggtctatcaagctatagaaaccaaacaaggaaatcttttctctaacgttcttcctgatgactctagaaacccaactgaatggaatccatctggcacattcaagttggcctcctatttttaataactgtattgaaaaacacttgtgtacccttgttgacttaaatagctaaaaaaaaaaaaacaggtgatttcacctcaataaatgtagtattccatgaaaagcaaacaaaatatatataaatgaacttcattagagtgtttttgaactctggactagcaggagatcacttcatgccatatgaaaatcttttatagctctgaaacttttttgtaggctttttaaaattttttcttctcattgtccaaacccatgcagggtttctttaaaatgtggacacctggtttcctttttgaaaaatgagatatatatatatatatatatatatacatatatatatacacacacacacacacatatatatacatatatacacatatatatacatatatacacacatatatatacatatatacacacatatacatatatacacatatatacatatatacacatatatacatatatacatatatacacatatacatatatacacatatatacatatatacatatatatacatatatacatatatacgtatatatacgtatatatacatatatatacatatatatacgtatatatatgaaacaagaagggaaaaacatggtaatatagtatgaagttacacatttaaatactttgaattcttacagaaaagagtggaagaattatcttctactgaataaaaactttacagacatggaagacaatgaaatttggtaagagaaaaagtaacatggttgtactttttgtaactgcaacgaaatttgatggtgtttatgaggaaaactacagcaataatctcttctgtaacttttattaatagtaatgttagactcagaaatggtggcctccatgttcttccgcccgctgttggtggccgccacccttcggaccacactgcgggctgctgctcaggttctgggaagttctggattgtttaataaccatggactccaagtacagcagcaacagcaaaggaatctctcactacatgaatacatgagtatggaattattgcaagaaactggtgtctctgttcccaaaggatatgtggcaaagtgaccagatgaagcttatgcaattgccaaaaaattaggttcaaaagatgttgtgatgaaggcacaggttttagctggtggtagaggaaaaggaacatttgaaagtggcctcaaaggaggagtgaagatggttttctctccagaagaagcaaaagctgttccttcacaaatgattaggaaacagttgtttaccaagcaaatgggagaaaagggcagaatatgcaatcaggtattggtctgtgagtgaaaatatcccaagagagagtgctactttgcaataacaatggaaaggtcatttcaaggtcttgtattaataggaagtttacatagtggggccaacattgaagatgttgctgctgagactcctgaagcaataattaaagtacctattgatattgtagaaggtatcaaagaggaataagctctccagcttgcacagaagatgggatttccatctaatattgtggcttcagcagcagaaaacatgatcaagctttacagcctttttctgaaatacgatgcaaccatgatagaaataaattcaatggtggaagattcagatggagctgcattgtgtaaggatgcaaagatcaattttgactctaattcagcctatcgccaaaagaaaatgtttgatctacaggactggacccaggaagatgaaaggaacaaagatgctgctaaggcagatctcaactacactggcctcgatggaagtataggctgcctagtaaatggtgctggtttggctatggccacaatggatataataaaacttcatggagagactccagctaatttccttgttggtggtggtgctacagtccatcaagtaacagaagcatttaagcctatcacttcagataaaaaggtactggctattctggtcaacatttgtggaggaatcatgcactgtgatattacagcaaagggtatagtcatggcagtaaaaagtttggaaattaaaatacctgttgtggtacagttacaaggtacacaagttgatgatgttaaggcactaaaagcagacagtggacttaaaatacttgcttgtgatgatttggtggaagctgctagagtgcttgtaaagctctctgaaatagtgaagcaaagcaagcgcatgtggatgtgaaatttcaattgccaatatgatctgaaaacccagtgatggctgaaggtgttaaatgtgctacaatcattaaggatactgtgttctgtgttattgttcttttaagtgtgtggagattgtagttgccatctaggcacacaaacatttaaaagcatttggtttgcatttaattctaccattcagaatggactgtttgtaagaagcatgtataatgcaaatatcttctttatttcgtcacagccagtcttttttgcttctacaaaatgcaacttgcaatatgacagtttattattgttggatacaaagttcttcattgataagagacctacaaataaaataaatatgaagataaagctttattcttcagtgttaacatacagtatatctaataactagcctcattagtagaccagtatattaaaacactgttttatgtaaaaagtgtttatcttcagcaccaaatacataataaatgtaacaatcactatttataaacagagctttcaaacactcctcagaaaatcaaaatacttctaagtattttgatgaagtaactttgtaattatgtgaacattgttttaatcattaggaaacgctgataactgcaagaattcatgattccatggtattaagaagcacctgtaggtttgtttcaaatagaggcatattaaccaagggaaaaaaatagtaatgttattattgtagccctatcatattcactttttaaacgactggcttttaaaagtatcatgaaagtcctacttcagtaaaacccatttaagtacagttgatgtttagcagggatcttttagtgcagcataaacatgctttagagaactgttggctggctgtacatgtttttaaaagctgttagctagctatgaggctacagctgaaaattacactttttatgagaaattgtaaacactggtcttatgtttcatctggattccttattgcatcatcttctgttaacaaaaacaaattttcccagtttttttgccttgtatttcccagcacaatttcatttaaaagtacaaaaagtgtttgctctcaaattgcatcataagcaagtgttaatactctgggcttttttatgtttgtttgtttgtttgttttttgagatggagtctcgctctattgcccaggctggagtgcagtggtgctatctcggctcactgcaagctcggcctcccgggttcacgccattctcctgactcagcctcccaagtagctgggactac

SEQ ID NO: 387 - DNA, 41506 bp, Homo sapiens
ctcgactcactgcaacatctgcctcccgggttcaagcgattctcctgcctcagcctcctgagtggctgggattagaagtgcgcaccaccatgcccgactaatttttgtatttttggtagagacagggtttttaccgtgttggtcaggctggtctcgaactcctgacatcgtgatccacctgcctcggcctcccaaagtgtgaggattacaggtgtgagccaccacgcccggctaaaactgttttatttaatacagttccatatgtcctgtagtctttctttatttttagtattgttttttgtttttgttatctgagtaaattactttaaaagacctgtgtcaattcagaaattatttcttctgcttgatttagtctattgttaatgctctagagtgtatatttttttatttcattccttgagttcttcacttctaacatttctgtttggctctttttatggtgtctgtctctttgttgaatttctcattcagatcatgaattgttttcctgatttctttttattgcctacctgtattgtcttgcatctcactgagtttccataaaatcatgattttgaataatttttcaggcatttcatagatattttttccttgaaaccttttattgaagaattgtgttcctttggaggtatcatgttttcttgctttttttgtttcttttgttcttacattgatatctacacatctggttaatagtcatttcttccagttttacagattttcatagaaaaatactttttgcttcagataactctacagttttgattgagtagggtactgaggctttgactgggtaggcacagtggtatagtgttcatgtaatttatttggctgtattcaacatcagtacagtctgcaaatttctcaattgcttaggctgtggttgttagtggaggctatggtaaggctttgctggggatgtcaggcaggatgttccttgtgaccctggggagcacgtgtgagtaccagtggtggtgccaggggccaggcatgctagtcttcgaacacctgggcagcatacatgggagctggtggtggcagatgtgggtgagtgtgggtttgtaccaatcacttttgactatttctagtttcaaacactatgcggcacaggaaaaatgtgcttagagtgttgtgttgtggatagattaaccacatgcattgaggtaagtatccagataaactacaggaataaaatggagatgtgaaaaattgtaggttaaaatttgtcaaaaaggattacctaaatgttaataacaccacaaaaatagcagaatttcattatgtaccacagcatttatgttgactgcaatataagaaatggcatttttctggccgggcacggtagctcctgcctgtaatcccagcactttggaaggctgaggcgggtggatcacctgaggtcaggagttcaagatcagcctggctaacatggtgaaacctggtctcaactaaaaatacaaaaaaattatctgggcgtggtggcgggcacctgtaatccagctacttcgggaggctgaggcaggagaatggcttgaacctgggaggtggaggttgcagtgagcagagatcacgccattgcactccagcttgggcaacaagagcgaaactccgtctaaaaaaaaaaaaaaaaggaaatggccttttcttgcctttaggaaacttaccattggttgtagagctgggtgggaacaatattcaatgatagtagtatgtgataaataaagaaaaagacttcctgcctcccagaataatatttatctacaatttaaataattatcatttaatttgagaaacatgatgaatttattgtttgttagagcaaacttcactcaaccaagaaactgaaattgttatgtggatcattataccaatatgattttgagttcctccaaatagaaataagtaggtaaaaaggattttataagccaggattagtttattagtctatgggtaacaaaagatgccaaaatatgtattatttcagtaagaaacattcatttcttggtcatcctacatgaatagcattggttaaggtgtgaagattgccatgctcctcagcgtcagtaaggaaccaatgttatggaggcttcatcggtttttagtgacgtcatctggcatatgcagtcaaaaaaagaataagatagataaccgggcacaaaagtatgtgcaggacatataaaatcattcagtgctacattttaattaattgtgtaaaaatgagcaaacttccattggtctataaatctacagagcagaggcctcagaaataatgccacacatctacaaccatctgatctttgacaaacctgacaaaagcaatggggaaaggattctctatttaataaatggtgttgggaaaactggctagccatatgcagaaaactgaaactggaccccttccttacaccttatagaaaaattaactcaagatggattaaagacttaaacataagacctaaaaccatacaaatcctagaagaaaacctaggcaataccattcaggacataggcatgggcaaagacttcatgactaaaacaccaaaagccatggcaacaaaagccaaaactgacaaatgggatctaattaaacaaaagcgtttctgcacagcaaaagaaactatcatcagagtgaacaggcaacctacagaatgagagaacatttttgcaatctatctacctgacaaagggctaaaatccagaatctacaaaaaacttaaacaaatttacaagaaaaaaacaaccccatcaaaaagtgagcgaaggatatgaacagacacttttttttttttttttgagaaagagttttgctctgttgcccacaccagagtgcagtggtgtgatcttggcttactgcaacctctgcctcccaggttcaagcaattcttcctgcctcagcctcccaagtagctgggattacaggcatgcaccaccatgcccggctagttttgtatttttagtagagatggagtttctccatgttggtcaggctggtctcgaactcccaaccttaggtgatccgcccacctcggcctcccaaagtactgggattataggcgtgagccactacgacaggccatgaacagacacttcttaaaagaagacatttatgcggccaacaaacatttgaaaaaaaacccatcatcactggttactagagaaatgcaaatcaaaaccacaatgagataccatctcactccagttagaatggcgatcattaaaaagtcaggaaacaacagatgctggagatgatgtggagaaataggaacacttttacactgtaggtgggagtataaattggttcgaccattgtggaagatagtgtggcgattcctcaagtatctagaaccagaaataccatttgacacagtaatcccattactgggtatatactcaaaggattgtaaatcattctactacaaagacacatgcacacatatgtttattgcagcactattcacaatagcaaagatttggaaccaacccaaatgcctatcaatgatagactggataaagaaaatgtggcacatatacatcatggaatactatgcagctacaaaaaaggatgagttcatgtcctttgcagggacatggatgaagctggaaaccatcattctcagcaaactaacacaggaacagaaaaccaaacactgcatgttctcacttataagtgggagttgaacaatgtgaacacatggacacagggaggggaacatcacacaccagggccttcgatgggtgggggactagggaagggatcgcattaggataaatacctaatttagatgacaggttaatgggtgcagcaaaccaccatggtacgtgtatacctgtgtaacaaacctgcacgttctgcacatgtatcccagaacttaaagtgtatatatatataaaatatttatatataatgcatttatatatatatttatatattatatataatgcattatatatattatttatatattatatataatgcatttatatatattatttatatattatatataatgcattatatataatatatatttatatattatatataatgcattatatatattatttatatattatatataatatatatttataatataatatatatatatttataatataatatatataaatatatatatatattatattgtattatattctggaatagctgggactacaggcctgcaccaccatgcccggcaaatttttgtagttttagtagagacagagtttcaccatgttggccaggctggtctctaactcctgacctcaagtgatctgagagcctcggcctcccaaagtgctgggattacaggcctgagccaccatgtctggcaaaatccttttatttagaaaaataagtttatttttcccattcagaatgacagctgctaattatatgagaggggtgcagggaagtgctgaaaagagaaaggcacggtccctgacaaagcctccactcctggggcctgggcccacagacttaggtgaggacaggaatttccgtttttgtgcccaaatgttgcattttccaagatcaccctggcctgctatgcccccatcctgtgcctatagcaggaagagacacaagcaactgaatgttaagagtagcaaattggtagaagaacacaccaacaggcaccagcacatgctggaaggccagcgaccaatggaccgatgcagagattggtcggggatgtcagaggacagcctggctgctgggtggcccaactccagggaaatccaccttcctactccatcttccttctggcctcttcatccacctcgctgagagctactaccactcgataaaaaaccttgcactcgttctccaagcccacgtgtgatccaatttttctgatacgttaaggcaagaacctgggatacagaaagccctctgtccttgcaataaggcagagggtcagagcagataaacacaagccacctgcaggcagcaaagaggaaactcctccaatactgttatatttttctaagtgtctattaccctgaatattctgactgcttttgtcactttctagtgccttcaggtttacttgattttcacattttgtgcaaggtttctaatgttgatctatgggtgaggacatgaagttttgttagaaagagtacagtgtgtgcatgtgtctttatagcagcatgatttataatcctttgggcacatacccagtaatgggatcgctgggtcaaatgtggcactatacaccatggaatactatgcagctacaaaaaaggatgagttcatgtcctttgcagggacatggatgaagctggaaaccatcattctcagcaaactatcacaaggacagaaaaccaaacaccgcatgttctcacttgtaggtgggaattgaacaatgagaacacttggacacagggcggggaacatcacacactgaggcctgtggtagggtgggcgcctgggggagggatagtattaggagaaatacctaatgtaaatgacgagttaatgggtgcaccaaaccaacacggcacatgtatacatatgtaacaaacctgcacattgtgcacatgtaccctagaacttaaagtataaaaaaaaagagtacagtgtaacacatgtccgcggggcccacaggagctgtaaacactcacccctagaggttgctgtggggttagagccccacagcctgcccgtctgcattctcccctagagctttgagcagcagggcactgaagcgagccattccccctgtcgcatgccctgcaaagggaacaagggaacttttctcatttcactaataactcattttgtcagcccaaatttgcagagctttataactcagtgtcttccccatcagattgcatttcaagatgctaggtgtcaagttgttctgggtcattattctacatgcttagagcttaggtataagataacttcaactaataattatagaattgcatggaaattctaagtactcaggtaaagcactgtatattcaaagctgtagaatgtataactgtaattcatattcttttaattcaaatattcttgctgtagtaaactgcactaagaataaaactgtagtgactgagtgcctagatggtacagaccatagaacatactgaaacattaccatccccaggttttattgttttgtaagctcctgttctggattctgtataattctctgaagccttttttttttttcaggtagttaatttgattgaaattaaattcttaatttttccctgctacatacagcagctgaaatctttagcctattttgggctgcttcacatctgtctcaaacatgtactttagagacttgactagagtttatacaatttggtatttattcctctatatctcttctttacgggtactctaccatcattttctagttgctatggcaggcacaaatcattcttttttttttgaaacggagtctcgctctgtcgcccaggctgacgtgcagtggcgagatctcggctcactgcaacctctgcctcctgggttcaagcgattctcctgcctcagcctcctgagtagctgggactacaggcgcccaccaccatgcccggctaatttttgtgtttttagtagagacggggtttcaccatattggcctagctggtctcgaaatcctgatcttgtgatctgcccacctcagcctcccaaagtgctgggattacaagcgtaagccactgcgtccggctcattcttgtttttcaaagcagcaagtacatatattgttaactgagtttttagtgttctacccagtaacaactgaggtctgccttcaagtgaaaagccacagaaacaggaaactcccccaatactgttgtctttttctaagtgtctattaccctgaatattctgattgcttgtcactttctagtgccttcaggtttgatttttacattttgtccaaggtttctaatgttggatctgtgggtgagggcatgcagttttattagaatatataccttcattaatggaaatagaacctcagttttgctcactctagacaatctttaactatatgttaaattgattgattttacgctttctttctctaccaaactgccggatttttttttcagtgtggttgtaatgttttgcactgccacataattcagaaagaaaataatggtggtgttggagtatggtggttaatacaaagatattattaagtttagataggccgggcgcagtggctcacgcctgtaatcccagcactttcggaggccgaggcgggcggatcttgaggtcaggagatcgggaccatcctggctaacacggtgaaaccctgactctactaaaaataccaaaaattagctgggcatggtggcaggtgcctgtagtgccagctactcgggagactgaggcaggagaatggcgtgaacccaggaggtggaggttgcagtgagccgaaatcgcgccactgcactccagcctgggcgacagagagagactccgtctcaaaaaaaaaaaaaaaaaaaaaaaaaaaaaaaaaaaaaaaaaaaaaaaagattagatatatgtttaggcatattatgagatttaacttatgtatcttattgatactgaataggatcaaggagctcagaacataattgttaccttgtgacaagtatagcatcaagaaggagtattggttgcaatgtccaaagaaaaaaaccaaagagatctcttttccaaagagctctcctctgcccgatgcttattccatcccatccctccaacacatcatataaacgttcttttacttttctctccctttgaatcttagaattggctcttcatcagggcaccttctctttagcccctacgaactctcattctgcttcttcgtattctttgtcctcccactggtttctgcttgaggcctgctcccattctttactcagtgtcctgcagaacagtcttcaagcaatccctgttttttttcacaacctcttttctctgtgcttctccccagattgtaccaaaattctagccagatatgcctaattaatggcccagcatagatctgaagtctcagaatagaagacgacataattgttactcagaggttcagaagtgatggggagggaacatcctagaactgatacacaggcagagagaaaatccacagttgacgtccattagccttttggagcacaggttgccttcttcagccttttactgagaagacggagtgtaactcagagcaattcataagcttcatattcttttcagctgagaggttcattactagggccaggagcatctgtttgaaaaaatccttcagtgtgcagatcttttctgttgtatatacaaattcaggtctttattgttgtgtaactgggtacttcatcctgagctgtgggacttggctttccaggaaatgaaaaggcattaatgtccctggagagtcacttgccaataattcaagctagtccagactgttcccagtgagtgaaagcctcaatcttcatagcattgggtgacaggaaagcagaggtaaaagggaaaatttatagcatcaacctcctcggtttccctggatggtgctgaggtagagaggtgtgtgcacacacatagttactgaaaatattcaccttggaatcccttctctgactaaagttaccacaaagatagagaccttaaaatttctgtggggaagcagggtgaagagcagagactatttgatgaggtagaccattaaaacaaaacaaaaaacttcagctcaaaacttgggaaagagttggaaataaaaatgccaatagacatagggatcctaccatgcccttcataaacatccgttgcaaaaataattctcctcactgaacaaggagaacaagtatttttttgtcatttatgaaaattaccatgcctttgttactttaatgaagagtcaggctaacctgggctcacaattcacttatcgataccattgttgagaaatgccacatgtacttctgactttatctgcatcactgtgcaaaatacgtttttactacttggcaaacaggaaaaatttacaatgaaattagagtactcagaaatacttaaaacaacttaagactaggcagctatgaaattaagaacaaagattttttttcccatttataaacacttattttaaaactttctacaagaaaaatctgtgatttttaacttagttcttgtatttcttcaaacgaagggagaaagataattttgaaaagaactattacatattgttaaaaattattgctttcagtcacagtgagagggaaccaaaaattaatagacaccataatgaggccgggcatggtggctcacacctataatcctagcactttgggaggtaaagtgggcagatcgcctgagcccagggcttcgggatccgcctgggcaacatagtgaaaccctgtctctaccaaaaatacaaaaaataaccagggcgtggtggtgcgtgactgtagtcccagctactcaggaggctgaggtggaaggatgaaccctggagatggaggttgcagtgagccgagatcgtgccattgcactccagcttgggtgacagagacaaaccctgtctcaaaacaaacaaacaaacaaacaaacaaacaaacaaaaaagcccaacaccataatggattaccccttacatgctagaaatgagtgaagctattcaaaaaactcgtttaacttttaaaaaactacatcagctaattttattataattattttttacaattaataaactgattcccacataattcagtttgtttgataaagactaatatgtagcaacactagaattacaataaaatcctaaatatatgtgtgtattatatatagaaggcagaattgaagtcattttgacagtagtatctgagatctaaaaaatgagaatttagtaaatccaatcctagtttccctgaaggcacaacctgttccatgagacattaacagagtttatgtttttcaataatttgtagaacaagtacttattagatcaagacacttagatagatgctttatacttcaggaatttattttttcacaatgatccaaagtattagatgaaggttttttgttttattttgcttttaattgacaaataataaatatacatatttatgtggtacagtgtgatgttttgatacatgtatacattgcgtaataaccgaaccagggtaattagcatatccatcacctcaaatatgtgtcatttctttgtgttgagaactttcaaaatcctctcttctagctatttcaaaatatatgcaataggttattgttaactctagtcaccctactatgcaataaaacattagcacttatttaatgtgaagtttttaatacaaaaattattttaagaaaataagcacaggctgggcgccgtggctcacgcctgtaatcccagcactttgggaggccgaggcgggtggatcacctgaggtcagaggttctagacgagcctaaccaacatggggaaaccccgtctctactgaaaatacaaatttagccaggggtggtggtgggcacctgtaatcccagctacttgggaggctgaggcaggagaattgcttgaatctgagaggtggaggttgcagtgaaccgagatcgtgccattgcactccagcctggggaacaagagcaaaacttcatctcaaaaaaaaaaaaaaagaaaaaagaaaagaaaaggaaataagcacagccatttaagtatgttattcacagttacactgctggtatatggagagacaggagttgaactgagatcctctagatacaaaacctctatacttaagagtataccatttatgatattttctctttaactcacaaataagggcatcgagggtaaactgacacagggctaaggactcattcattggtgaacaattatcacacgatgatatagaaaggctgttgaaaagcttttcttcatcttcttagtcagtgtcagaggcaattgggtgataaatatctggcagaagtaatacctaaatagcggtctcattttatgaggtataggtcagttttccttaggagtacggaaaatgatgaaaaaaattgctatcaaatgtcaataaaatattggggacaatatggcacaaggcaattattacattttactgatgagtgaaggacgttcaaatagaaagaagggagacagcaaggaaaagatggttaaaatgatgcaaatgagttcaggtgtatgagatgcacctggacaagaggtgctgtacagaaggggctgagtgtgtaagaaggttcaagagcttggtgagcacagagtcatggggactccacattttctaggatttaaatatggaaatacaggctgagaaaaagaacagtgagaaaacttatagatgagaaatccatggtttgtgatattgaagaatgagacagtgcaagcctcatagtctaggaaaactccaacacgatcaggacaaataatcacagagaggggcacaatgaaaggaacagaaggagtatggaaggaactatcctggaaagcactacatttaactccttcctctaaccctataacccagtagccgtatttaggttgataattttcatttttttcaatattacacattgcatcaggttggaagccagcacatacccccaggatccaagcagttttcttggacacgtctacctcccagtaatgtttccctgatgtgatactttgagagcccaggatgccagtacaataattgaaattcacaaatgtctggtatcttgtccctcgtgccccatatattatctgtggtttcggagagctcacttgtctcttatcttcagaaatgacagcacatgaaatgttgtttggagccactgtcacatcaactgtagaaaaattaacaggtcagctaagggatataatgtaactttatttgtgatatgagagaaatcttgataaagacttgagagaaaactgggaggaaccttgtttagaagttataaggaggggtaagttatgtgtgtcttggaaggagaatcataaatcttaaaacatgagcctaatagagaacataaaattctaaaagataaagataataataatgataagccgcagggtggcttatgataatgtgacttctccttaccccagtagcgtcggacatctgtcagctctgaaatgataaaaatgcacaatattgaatacaaacaaaggagtcagcactgaaattcattttctctccagattagggaaagagtaggtatgccctatggtagggcagtaaattgctgaatgatgagatgaaacagccacctagccatttcccattaaatataatcccatcagcagcagacaatatctatcctcccctatcccctctatccatatttggaaactgcaccctcttccctatttagcaccctaacaccacttgaattccataaccctgttgttgatctagctctcctcacctctaaacacttctagcattcctttcagatcaggagctcgaaacactctcctttgattttttggaaaagtttctggcttcttcaaggtcacgttctccgtcctaagaattaaaaaaaaaaaaaaaaacttccaaacctttgaccttgtgtccgtggaacacccctgacttcctatcatttcaacccattgaggcacttgaactctcttcttggggatcctgagaagggagagtgcaaactcttgaccctggaggcaaacaaaatgttctcatgtttgccttcccacttactttctgtgagaacgtgggaagatcttaacctctcagaagcacagtttcttccttctaaaatgaaataattaacctctccctgtctacattcttaaactcataggacataaaaaaaaaaaaaaggattttaaaacaaaacaaaacaaaactttggtgccttacaaaagaaaccctaacatttaatgggtggaaacatcatcgctatgtatgttgagttcccagggagatggttagaaagtgaggttgcagaacctggctcctgggtgtttgacacatatcaagagaggaatcctgtttggagaggcctaagaccttcaaagctattcccagcagggaggtactcagataacatctaaggtttcagatttccgggaaaaattacaaacacttggcaaatgagaaattatgtgcactaaactattactggcctgaatatcgtgtggttagaaagaacttgataccaccacgtaggtgtgcgaggtgtgcgattttagacacaagaatagcacctttttatgctcttgtaaagaatgcaactgaggtggatcaattctttgtaccatgaccacatattatccagaatattattttgaaatattattccggaaataaacatctgattttggaaatctaaatataaatgaagaggaactggtctttttccaggaggaaaatataaacatgtgggaattgtcccaatggacaattaggggtatataagagaaaaagaagatatggcccatccaaaataaatcaagaacctattaaatacagaaagagaactagatgtaggtaataaaatggtgatggcgcaggggtccaacactgcaacaccttctccctgaaaccactactgacccacactccgagtctccaccacccaaattttctaccatagaatctggtctattccttttcttttttttaattttatttaattttattgatttttctaagacagagtctcactttgtcgcccagactggagtgcagtggcatggtcttggctcactgcaacctctgcctcctggattcaagcaattctcctgcctcagcctcccgaatagctgggattacaggcacgggccaccacgcccccctaatttttgtatttttttgatagagacagggttttgccacgttggccaggctagtctcaaactcctgatcttcctgactcggcgtcccaaagtgctgggattataggcttgagccaccacacctggccaaatctggtctattcttaatagttatagaacattcgaatgctgatttatgaccagaaatttatgataaaacaatatcgaaatttttctgccctgggagatgttttattctaattaaacccaggacaattctaatggctataaatctctcctcactgcacaaaaggaccatctctgtcctcccacacatacctttttatgacgccatccacaccctaggaagaagagagaaaacatcaattaagaaagaaagagtctctcctcacttataaagcttcatcacatttcccccggttcctaatgtgctgagaatggagatggtgacagtgtgaaagacaaaaaagcaaagataagactcaaggcaatcatcccagaagactcatgtgagatttccaagttcccttaaaagtagaaatagctttcatccctgtggaagaggctcctggtttctgcagatgggacatgtttagaaggaaaagaagtgactgacaatttgtttttctccaaacgtatatggctctccatgaaatgatttaaataattagtgcttctttgatttattaaacagatgtacagcctaggcaacatagcatgaccgcatctctacaaaaaataaaataaaaaaaaattagccaagcatggtggcatgagcctgtagttccaactacttgggaagatgaggtgggagaatttgagcccagaagtttgactgaggctgcactgagctaggatcacactactgcactccagtctgggtttcagagtaagaccccacttctaaacaaaaagaaaatcacaaaaataaacaagaaaacatatatatataaacttattctccaggcattatgtcacattttgaagaatcaaagatgaatgaataatagtgctcaagatgtttacgcggcctttgctgagggtataagcaaacaagtgtactaaacaagtatagatatttttctttctttctttttttttaagaaggagtctcactttgttgcccaggagtgcagtggcgtgatctcgggtcactgcaacctccgcctcccgggttcaagccattctcctgcctcaacctcccgagtagctgggattactggcgcccaccataatgcccggctattttttgtatttttagtagaaatggggtttcaccatgttggtcaggctggtcttgaactcctgacctcaagtgatccacctgccttggcctcccaaagtgctgagattacaggcatgtgccacgacacccggcctacgtacttcttaaggttgctctcttttcattttagacattaactgtaactgacttcattcacttccttaagtttgacacacatatgtgcaactgatttccaattccctacttttacccaactttgtcacttaaatgcagtttaatacattcagtagtgaaggagcaacaaggaccaacaactaagaatttttattatgtaacaccaaccatactgtcttctctcttataccacattgtccataatattactaatatctactcagtcattgtcctaaaaactacatttactctgaactctagtctctaacaggacagtttggtctacattcttttttttttttttttttgatacggggtttcgctcgtttcccaggctgcagtgcaacggcgcgatctcagctcaccgcaacctccacctcctgggttcaagcgattctcctgcctcagcctcctgagtagctgggattacaggcgtgcgccaccacgcctggctaatttttgtatttttagtagagacagggtttctccatgttggtcgggctggtcttgaactcccaacctcaggcgatccgcctgcctcagcctccctaagtgctgggattacaggcgtgagccaccgcacccagctagtttacattcttaatggttttaggtaatctactcctctttatcaccacaaatactgttttgttttagcagatatgtaccaatgcaatgtctttggtctcctttatgccagacacaatttttccacatagattttttttcaagaacaaagccaatagctggatctacacatacaatcaaatagttttgctttttgtattagtacttttatgttgtatgtaacataaaccaaataaaactggattaagtggtgaaaaaaactttggaaagggtaattacaatttcagtcacagctgaattttgaaactcaaaccttgtcatcaagatctggtctatgggctgggcgcagtgactcctgcctgtgatcccagcactttgggaggctaaggtgagcagatcacttgaggtcaggagttcaagaccagcctggccaatctggtgaaatcccgtctcttcaaaacatacgcatgcctataatcccagctactcaggcggctgaggcacaagaattgtttgaacccaggaggcggaggttgcagttatccaagatcacaccactgcactccagcctgggcaacagagcgagacttcatctgaaaacaaaaaacaaaaatatgatcaatgtccttctccaaattctccctattcctctacattgagtttattctctgtacatgaaggaaatgtaactctcctgatataaaccccagcagaaaggagaacttctaagttttaacataaaaaacttttaggcttgcatggcatttgtctgtgttggatcagatgcccatctttttttttttttttttttttttttgagatggagtctcactctgtcacccaggctggagtgcagtggtgcgatctcagctcactgcaagctctgcctcctgggttcatgccattctcctgtttcagcctcccgagtagctgggactacaggctcccaccaccacacccagctaatttttttttcttttgtatttttagtagagatgggttttcaccgtgtaagccaggatggtctcgatccgcccgcctcggcctcccaaagtgctaggattacaggcatgagccactgcgcccagcccagatgcccatcttaaaagcactactgcactgtggctggaaacaacaggaattacatatattaacttaactaggagtaagttatatgcaaccctggccatgctaaagacacacacatatggaaaggataagtgaaacaacacatcagtgagaaaattgtagcagatttttaaacagccttaactttgaattaatctgggcaatctcacttacccaagcatagattcatcaggagacgacagaagccttactgccttgaggggattgaacataacttatattcgagattagaggcaaaccaaagatacatggacacacaggacaaagctaggatcctacacttaaaaattatattttagctttctttaaacacagcagagacattagcaaccacagggaagtaaataaatgaaggtacagaaacacttcttgctgggtagagactagaggatgggaattctcagaaacaacaaagtaacaaaaatgtatgttttggccagctgcagtggctcattcctgtaatcccaggactttgggaggctgaggcaagtggattgagaccagcctgggcaacatggtgaaatcccatctctacaaaaaatacaaaaattaggtgagcatggtagtgcggagctgtagtcccagctagtctggggtctgaggtgaggggattgcttgagttcaggatgtcgaggctatagtgagtcaagatcgcaccactacatactagcatgggcaacagagtgagactctgtctaaaatatatatatgttatttacaaaagaaatgtgtacacatacaaagaaacaagatagaataccacagctcagggggattaaaaaaaaaacacaaaaaaaccccacaaaacaataaatagaaaatatccccaagtgaccccagatgttggagctagaagataaagacttcaaagcaactattgcaaataggttaaaaaactaaggagaactatgcttaaagaattgaagtataaaaacaatgactcaaaaaatagatatgctcgagagatagaaatgataaggaaataaaaattctgaaaattttaagtaaaataacaataatgaaatatttgctaaaagtgctccacagcacacaaaaagatcattgaacctgaaaagctgcatcaataaaaattttctgatttaaagaacagagggaaaaaagacttaagaaataaaaagagcctcaaagacatgtcagatgtcataatgtagcaatgtacatgtaataggtcttccagaaggaaagaagagaggaaaaggttttaaaacctgttttaagatctattacatgtatgttgctacattttcaagtagaaaaaaataattggggaaaaattgttacattctataaaaattaatatttcatctatattaatatctaaatctatgttcaatgaaccccaagttaaataactaatatgagacccacatatcatagaaaaacttccaaaggctacaatcaaggcaaagaaaaaactaaagcagcaagagaaaaattaatcattacataaggaatgctttcaacatgattaatagctgacttctcatctgaaataatagatgagagaaaagactggaatgacttattgaaagcactaaaagaaactgtcaactccaaactccatataaagcaaaaattttcttcaaatatgaagaaaaaaatattctcagatgaagactgagagaatttgttgctggaagatggagaaaaaatgttttttcctttttttctttctttttttgagacagagtctgactctgttgcccaggctgcagtgcagtggtgccatctcgactcagtataacctctgcctcccaggttcaagcgagtctcctgcctcagtttctcaagtaggtgggattacaggcacgtgccaccatgtccagctaatttttgtatttttagtagagatggggtttctgcatgttggccagctggtcttgaactcctgatctcaggtgatccacctgccccagcctcccaaattgctgagattacaggtgtgagcccctgcaaaatatttcttcccataaatatttcttcccaaaaatagtttttaaaatttcttcagttgaaattaatttcctccaaagatttacccaaattcataataaacctaaacaaaatggaaatactataaaatgtgagttaagataaaagaatctatagtttatttcccaaagtattttcttaataacttcaaaagacattaagtttattacaaagtaattcaatactatattaataggttatgacatatatgcatgtgagatatatgacaaaatgataaccaaagatgaagaaaatgaagcaatattgaagggaagtttctgtattttactggaattaagttactattaatcagaaggtggctgtgataggacaagatgcatattgtaatcattagagcaagcactaggaagagtactaatgtcatacagctgaaaaagagaaaaactaaaaatctacattggaaaatatttatttaacacaaaggaagccagttaaggatgcagaaaataacaacatcaaaaaagacaggagaaatatagaaaacaaatagcaaaatggtaaatttaagtaaaactatatcaataattgcattaaatgttataatgaaaacccaaatgaaaagtcagagactgtcagacagactgggtaaagaagaagattcggttatcactacctataggagagcatatattagattcaaagcataaataaacccaaagtagaaataaaaatatatatactatgcaagcagtaaccataagacaactcaagtagatatattaatattagaccaaagatactttaaggcaagaactgctatgtgagaataacaggaatatttcataatgaaagaaaggttcaatatgtcaagaagaaataacaatattagtgtatcttcacctaacaacagggcttcaaaatactgaaaacaatacataaagaattaagaaaaggaaaactgacaactcaataacaactggtgaagatttcaataatttactctcagtaattaatagaaaaactagtataaaaaccataaaggatatagaagactaacactatcagttagcttgacctaatggacatctttagattatttcaccaaatgaatgcagaatacatattcttttcaaatgcatataaaacattttcctgctcatgtaatgttccataccataagataagtttcaatacattaacaaatgataaaataagttatctgattaccaaggaatgggatttgaaatccacagcagaagaaacattaaaaaaattcttcaatgctttaaaattaaacactacttttctgaataacccaagagtaaaccaaaaaatcacaaagaaaattagaaaatacattgagccaaatgaaaactcaaaaattaaaatgtatgaaatatagttaaagcaattcatttattaaacactatatcagaaaaaaaaagatttcacagcatctaagatttcaccttagaaaaattagaaaaggaacaacaaaaaactcaacgaaaaagatgaaataataaagatcagagcagaaacgatacagaaaggttaaaaaaagataaaatcaatgcagcaaaaagcctttttaatttcataaaagttaacaaaattgaccaaatataactaaaaggacaaaaaaagggagagaaaacaaatcaccaaaatcaggaataaaagaggagacataagtgtgtgtgctgtagatagaaatgaaaggaattgcagatggatgtcagcaaaatagtatcataggagtctctagcagttgtctcccctcaaaaacaatttaaacaaccatccaagaactaaaacacctcaccagaactaagaaatagggtgggagcatacagcatctgggtataacacagaaagaagaaaaagactcatggaagaatgtaggaaggacagttttacattttccatttcacccctcttacaactctaggcagcatagcgtgtgagaggtaccctccacaaggagaaagaggggaaaatgagcaccaaatgttacctcagaccctaacactgggctcaacctagtaaaacccagcctggcaggtctgaagacaccagactccagactggtatctatggataagcctccaggccgtatctcacagcctaggctctagatctgtgcagtggactcagtctacgagctatctaaatgcgaggttgccctcagtggtaggaccattctcagttgtgttggaacaactggatagccatatgcagaagactatctcacaccatggaggactttaagtaaagtaagtcaggaacagaaagacaaatactgtataacatcacttagtatgtagatgtaaaaaatagttgagctcataaaagtagagagtggaagaggggtttccaggagctggggtgtagggagagttgaggccgatattggtaaaaggacaccaacttcagaatgaaaagatgactatcttcaagagatctattgcagaatgtggcaattatagttaacaatgtattgtattcttgaaaattgggataagagcagttttcttttttttttgagatggagtctcgcactgttgcccaggctggagtgcagtggtgcagtcttggctcactgcaagctccgcctcccgggttcacactattctcctgcctcagcctcccaagtagctgggattacaggtgcccgccaccacgcctggctaattttttgtattattttttttcatttgtggggtacaatgcaaaatgaaaatatgcggccccttgttcaaaatttattaaacatttcaagatgatgacaacagagcattaaatcaaatgcaggtgagagaggggtagacacatcctaaggtgccctggggttccgaggaatacagcatgagaaacactgaacgtagagcctgagacaaggacctgggtccaggtgatttacctgaccccaggaagcaggaatgagggagcagggaggtaagacagggaggaggagaagccaatgtatgagtaagctgttggggttgtttctgggcattatgggatcatgatcccaccaaacctcctgggaatgccccagaatctctgcccgaaacactgagagctgaggcatttctccatcaactcccaaccccattggttgaaggatgcccctgggggtgctagctttcttgcatttctttttttttttttttcttctgttgtgttttttttgtttttgtttttgttttattatactttaagttttagagtacatgtgcacattgtgcaggttagttacatatgtatacatgtgccatgctggtgcgctgcacccactaactcgtcatctagcattaggtatatctcccagtgctatccctcccccctccccccaccccaccatagtccccagagtgtgatattccccttcctgtgtccatgtgatctcattgttcaattcccacctatgagtgagaatatgcggtgtttgattttttgttcttgcgatagtttactgagaatgatgatttccaatttcatccatgtccctacaaaggacatgaactcatcattttttatggctgcatagtattccatggtgtatacgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggacgtgaaggacttcttcaaggagaactacaaaccactactcaaggaaataaaagaggatacaaacaaatggaagaacattccatgctcatgggtaggaagaatcaatatcgtgaaaatggccatactgcccaaggtaatttacagattcaatgccatccccatcaagctaacaatgacttcacagaattggaaaaaactactttaaagttcatatggaaccaaaaaagagcccgcatcaccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgacgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccacaaaaaccctagaagaaaacctaggcagtaccattcaggacataggcatggacaaggacttcatgtctaaaacaccaaaagcaatggcaacaaaagacaaaattgacaaatgggatctaattaaactaaagagcttctgcacagcaaaagaaactaccatcaaagtgaacaggcaacctacaaaatgggagaaaattttcacaacccactcatctgacaaagggctaatatccggaatctacaatgaactcaaacaaatttacaagaaaaaaacaaacaaccccatcaaaaagtgggcgaaggacatgaacagacacttctcaaaagaagacatttatgcagccaaaaagcacatgaaaaaatgctcatcatcactggccatcagagaaatgcaaatcaaaaccacaatgagataccatctcacaccagttagaatggcaatcattaaaaagtctggaaacaacaggtgctggagaggatgtggagaaataggaacacttttacactgttggtgggactgtaaactagttcaaccattgtggaagtcagtgtggcgattcctcagggatctagaattttttgtatttttagtagagacggggtttcaccgtgttagccaggatggtctcaatcgcctgacctcatgactggcccgcctgggcctcctgacctcatgactggccctcctgggcctcccaaagtgctgggattacaggcgtgagccaccgcgcccagcctttactagtgaattctattgagcatataaagaagaaatgatagcagttatttaattcttttcagaaaattaaaaaaaaaggaaaaagtctcaattaattccatgaaggaaaaaaataaaaagcatcttgtattttgacgtgtatttgtttgccagtggctaagctgagcaatgaaaagctgcactggtaagtctcaacactagaatacagagaataggaacctatcaaacatgactagagctaattgatcatctccactacgtcaaatttttctactgctctggataaattaataaaaatgggattatctcttgctacttctacattcaattattcttataacttcagcaattgattcagaaaagcggtcctgcagagaacattgttaatattagaaaaagcacagcaacgcagagaaggaaatagccttcacttttctttaatctcagtgctcaggcttctttccactttttacctgaagcagctccatcactgacccctgcagccgatgctccagatctgagatgagctctctcagggactgggtctgctgcaccatctcagtttcagagttcgtaaggcttttcagaatgtcttcctcctccttctccaggttttgcagctcattgctctcctcccagtccaggatgtctctcagttgctcaaaatctgccaagacgttggttttgtcatactgtatttgagtcttcagagataagagaagagaaaggggcactcagtctaccaggcagaggctgttagccagaaaaggagctgtttcttttggggagttctcacaaggaggggacatagtagcaggagagtaggtcttaggaaagctgccttttcctatttcttttccttcatgacattttaaaacaatgaccttgaatgggtatattgaggttcatcctgcatcaaaatgggttacctggatgtagcttacctttcacacagctatgcaggacactcatgcctgcctgtattacttctcagcccaagctcaaactccctgccaaaagttgaacactgaggacagaatcatgagccattgccaaatgtcttccccaagtagagtcacggactcaaaaagtagcacaaaaatagaatgcaggattcactagccatcctcaccagagagatccttcatgtaaagagctccctactgtgttcactgtgacatattcactcctcagccaccacaccccatcagggaaaggatgaagaggactaatcaaatgacttctggacttatcaaatgtcagggaataaagaggaagaaagctccttcccctggtcctgcccagatttctagctaactccttcgggaaccacatcctcttgccttccaggaagctttctcttctctgatgtcagcttctaactcttcagcttcctgctgcttctgcctcagcatctccagagctgcctggagcttcacctgtgagaaaggaatcacaccatagtcaagctatgaggttttccagcacctagatagagtataaacatgaaataaatcaggttgatctcagaagaaacaaatttgcagaaactgtgagaatggcaatgagaatccatgacttggaagaaaacttacattggtgaatgtgctccctacatctcaggtaatagacctccccatctcctcaccatgagtagactgattctttttgtcctagaagaaaaaactaatcctgcagcaaggaaaaaacttacatctcaacccactcctgttactctcctgctgaaaggggtaatcagagcttttcttggacaccaaatctctacccatctaacccaaggtacaaaatatttactcccggccaggaatatatactctaggattattctcctgtaattgggtgaaatgcaaaaaaccatccttaaagcctcagaagttaagcatagcatgaaaaaaataatcccgggtctcaggtctatcatgacaaggcagttaatgtcaaaggcaaagtgaaaattttccatctggtcccattttctgccctctcttccttccatcccagtctcttacttggtactcccgggcaacctcctctgtgaggaacgtgtggtgaccacggtgctcctgagaccgctcacaaagccagcaaatgaccttcccgtcctcctgacagaagagtagaagtttctctccatggcgtgcacaatgatcaactttctgcccctctgggctcaacttgacctccctgagcttctccactatgttggctacatgccgattaggccgtatgttctcaggctggtaactgatccggcacacagggcagctactctctcctttgtctagcatggacttcttgtggtttgcagtgaggcatgcttggcagaagctgtggccgcagtccaggctcaggggttgtgtcaggagttccaggcagatggggcaggtcacctcctcctttacattaaccaggattccagaagccatagtagctattccactgctcctgcctgtcctggctgctgaggttcctcttgttcacagatccctgcatgattgggaaggttaaaatgggaccaagtaagaaaggtagaaatagaaaggatattgattgtgcacaattagaaaatgggcaagatgaaaataattaaggacaaaaaaaggggagaaataagaaaaggtgtttggttacctggtaataagggcttttcataatcaccttaaatactttactgccagttcatgtcatatgacaaattctgttcttatctgtgcattggttatcatttttctttactttcaatgaatagaaaacagactgaggtcttttctaccaagatctttgtgtgacccatcatctctcctggcttttctttcccacgccaaaacacatcctcagtattaaaatcaccaaacagcttatgcctcagggctttcacatttgctcttctctcagcatgaaatgtttctctgatgttagtacgattttattaaattctctccttacatgttatattatcaaaaatacctgctctgactaccttatgtgcagtgtaacaaatctcaccatgcactgtacgtttgcaatgattgctcttattatcagcagagtgaatgactgtttcatcaaatgtataaatagacataataagtgatttacaaaaattatttatcttcagtatggtgacctgagatgacctcgtattcagggtcctctttcactggcctctttgctactcttttggttaatcaatgacaaatggagataacagcatatatccaattaatacccagagcaattggggtgtggaagtagaggaatccacaacagctgggaggttctgaggagtctcatcctgaaagtttgccaaggacatttattggagcctaaaggtgtagacatggtgtagagggtgatgatagagaaatactcagtggaccacacatgttggatacttgaaaactagaagcacagaggcagtggatatcagtcttgagagagaagtctcaaaatattagatgagatgattctgttcccggaacaaacggagggtcggctgctgcttcttgcggcccaataacgagatgcagatttactgggaaagaagcgaatttttatttctgcgtacagggagaaggcctagaaaatatctccagaccaactcaaaattacaaagttttccagagcttatataccttctaagctatacgtctacgtataggtgtgcattattcatctaaaaacataagtgattaacttcttcaaatctataactaaggtctgagttttaagaccttcctctggtgcctcagtaaatttacctaatctagatgggtccgggtgctggggtgattacccttatcttgtctctcctgctaaatcattaaggtttgcggagttccttcagaccctcaataaacttgtttgtggaggcctgggagttccttcagacccccataaaacttgtttaatcctaaacaggtcctaatcgattccttcgttatcttgtcatgcttcaaggcccaggaaaggcctgggcaaaactctcagtgggcttctgttacattccagcctttgtataagggcactggctctatcagcttttaatatttttttttcttttttgagacggagtcttgctctgtcgcccaggctggagtgcaatggcacaatctcggctcaccacaacctctgcctcccaggttccagtgactcctctgccccagcctcccgagcagctgggaccacaggcacgcaccaccacacccggctaatttttgtatttttggtacagatggggtttcaccatattggccagtctggtctccaactcctgaccttgtgatccacctgcctcggcctcctaaagtgctgggattacaggcgtgagccaccgtgcccggcttcagcttttaatatttaacttaaccagacgggtgtggtggctcacgcttgtaatcctagtactttgggaggccaaggcaggcggatcacctgaggctgggagttcaagaccagcctggccaacatggtgaaattctgtctctactaaaaatacaaaatgagctgagcttggtgacaggtgcctgtaatcccagctacttgggtattctttccacatgcttctcctgctcttcgtatctcacctaagctctgcttttggggggcagatacggcccacggagagggaggagcaaggttaatgatttttaagaaaatccagtagttccctgagtctggacttggtgccctagtagaggcaaacagatgctgtcaccagggaagccctgatgaaatgactgggaaagttatttttcttaacgtttttctttattccctttatgtatagacaaagttgcttaagaagaagccagactgcccagcatggtccagatcttgacccctgaccagatccaagggggaaattagacccccgaaccagcgtatatactggaactgacaatccctaattgcctttagatcattaacatatcactagagtgttaagttaccccctcccccacacgacaccaaacaagaaaatctccaccattttgtgtgcctgggttgtattgagaggtgacagcatgctggcagtccttgcagccctcactcgctcttggcgcctcctctgcctgggctcccactttggcggcacttgaggagctcttcagcccaccgctgcactgtgggagcccctttctgggctggccaaggccggagctggctccctcagcttgcagggaggtgtggagggagaggggcgagcgggaaccggggctgcgcgccgcgcttgtgggccagctggagttccgggtgggcgtgggcttggtgggccccgcactcggagtggccggccggccccgctgccccgggcagtgagcggcttagcacctgggccagcagctgctgtgctcaatttctcgccgggccttagctgcctccccgcggggcagagctcaggacctgcagcccaccatgcctgagcctccccacgaccccttgggctcctgtgctgcgcgagcgtccctgacgagcaccgccccctgctccacggcgcccagtcccatcaccacccaagggctgaggagtgcaggtgcgtggcatggcacaggactggcaggcagctccacctgcggcccggtgcaggatccactgcgtgaagccagtggggttcctgagtctggtggggacttgcagaacctttatgtttagctaagggattgtaaatgcaccaatcagcaccctgtgtctagctcagggtttgtgaatgcaccaatcgacactctatatctagctactctggtggggacttggagaaactttatgtctagcgaagggattgtaaatacaccaatcggcactctgtatctagctcaaggtttgtaaacacaccaatcagcaccctgtgtctagctcggggtttgtgaatgcaccaatcgacactctgtatctagctactctggtggggatgtggagaatctttgtgtctacactctgtatctagctaatctagtggggactggagaacttttgtgtctagctcagggattgtaaatgcaccaatcagtgccctgtcaaaacagaccactcggctctctgtaaaatggaccaatcaggaggatgtgggtggggccagataagagaataaaagcaggctgcctgagccagcagtggcaacctgcgctggtccccttccacactatggacgctttgttattttcctctttgcaataaatcttaatactgctcactctttgggtccacactgcctttatgagctgtaacactcaccgcgaaggtctgcagcttccctcctgagccagcgagaccacgaacccaccagaaagaagaaactctgaacacatccgaacatcagaaggaagaaactccggacatgccgcctttaagaactgtaacactcactgcaagcgtccgcggcttcattcttgaagtcagtgagaccaagaacccaccaattccggacacagtatgaagacatgtgtttataaacagaggtggcacaactggagttccaccctataggctaacactcctttctctccccgtactcagttcttttaaagccaatgctttccactgttttgggggagggggctttagagaaggagctctcttactctccactcctagcaagaaataaaacctgcttgccttttttcccattatctttgtaaccaatatgaactagggaaagaactccatttacagtgacaatgacaggactacagaactggacagctgtcacaccatgaaggctgatgtcacagagccaggccaaggtgatgagaactgacctgtagagttatgcagaaacactacattagtaaactaataggcattaaatcattaggattccaaggcccctgtctttgcccttgttgttgggagaagacactgaaagagagaattctggctctctacagcaaagttcaattaaaaagtatagagtagggaggggatggggagagagtcagcatggaaaaataaccagccttcgggaaacaaagcccttcactttaaagctctcccttctttcaaatctgcctgcccgccaggcggctctgttcccctcagtcagctctggcagcaagaagtctgtgaactgtgtcttttccccacccccgcacagcttttcagataagttaaactcaccaaggtaaatacagttttgtcccaaagacttcctacttctgccctccacaaaatcactcaatacaccttcagacaccagtgcagaagtggtgattctggggagaagagtgaagacaggccagggaagacgtggttaggattcactcaccaatccacgggcctgatctgcacaaaggaattttcctagaggaaccgcaggaaattcttgctcacactcagggcaggaaagtgaaagataaactatgggccaatggcatttctccacgtagggcctggtgagtcccgccctctgaatgaatcagccgggccgtgtagctgtgctgttcacaggaggagccgtgggaactagaggcattcccactcaatctcccttttctcttgagtctcaggatcttgttatcatgccacttcttctgacatagtttcagattaacccagccaagtattaaaaattagaaaaggtgccctttttcgaaattcttccaatgtgctcctcttgctcctgatctcacagctgagttctgcttctgggtgacagatatggcccaaagagaaggaagaacaaagttaatgatttttagagaattgcagtagatttctggtctggacttaaaaatcttataggacctatgaacagaaaaggagctgcaggtaggagagatgtcatattattaagactccgaaacccagagaggacaggatgctagaaatttatctggagagggccgggcgcggtggctcacgcctgtaatgccagcactttgggaggctgaggcgggcggatcacaacgtcaggagatcgagaccatcctggctaacacggtgaaaacccatctctaataaaataaaataaaataaaataaaataaaaaattagccgggcatggtggcgggtgcctgtggtcccagctattccggaggctgaggcagcaaaatggcgtgaacccgggaggcggagcttgcagtgagcagagatcgcgccactgcactccagcctgggcgacagagtgagactccgtctcaaaaaaaaaaaaaaaaaaaaaaaaaaaaagaagtttatctggagagcgataaagaaataccacattatttctttcaactattcactttcaaagaactctccaacttcccgctgttgtcttttccaaagtatctattgcatccctgagcagggccaggccttcctctctcttctcttctggttactatgcaaaactggtccaaaaggctgaactgtggtccatgtaccatagcctcccttctaagctttcccttactggaacatctcaggaagtccacactggaactaggatcattggtagagaggagtatttagtttgaaaatgaaaatgcctcaggagaaggcaatggggagcactgcagtgggcagcctgttatcacttaattccatcatcagtaacctcataccccctccacactgtacccccgcagctttctgtttcatgaaatcaggtagggggcttttgcattttgttctttattgtctcagatttactagaatatggtgtatataaggagtaatatttaaatagatatgaagatatatagctattaatctaattttaattgaatatcttgatgtcacatttctgttctattcttgctgtaaagataactgctgtgtcacctagtttaattcaaatattcttctggcattagtaataattatgtggcagtaataattatagtaataattataataattagtattattaataattacaattattaatagttacaattataattaatattactaattgttatttagtaataattatgtggcattagtaataattatgtaatgattacatttgcagtggctcacacctgtaatcctcgcacttcgggagaccaaggcgggtggatcacttgaggtcaggaatttgagaccagcctgaccaacatggtgaaacctcatctctacgaaaaatacaaaaattagccaggtgtaatggcagatgcctgtaatcccagctactcaggagggtgaggaaggagaattgcgtgaacccgggaggtggaggttgaagtgagccgagatcatgccactgcactccagcctgggcaatagagtgagactctgtctcaaaaaaaaaaaaaaaaaaaaaaaaaaaaaaaaaaaaaaaaagtaattatgtaaatttttaaacaaattttaaacgattttttaaaatatcctctctgttttcttcctaagtattattcagactctaaccatatttactcttattttgctctttttcttgaagagaaaaatgttaaatatccatggacccaaaggtagagatatttcatttgattccttttcaagcaggaaagcaggatatataaggtttacaggctgggcgcggtggctcacgcctgtaatcccagcactttgggaggccaaggtgggtggatcatgaggtcaggagattgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagatcgcaccactgcagtccgcagtccggcctgggcgacagagcgagactccgtctcaaaaaaaaaaaaaaaaaaaagggtttacagagaaaacacagagctccaacaataatatattttttctacaatttagaacataggttagaatatggagcctgccaacatgctctactctggtgataaactgtgtgtggtgcattcagtttttctattggcccacgttttctggtatcttgtcaggacctaatattactactgttttctctcagctgcaattaatacttcatgagataaatcagaccaggatgaaagttcacttcagatgttcaaagccagacgagaataaaaggatggctatgagatctatggaagtgctgagaagggaagaaataatggacagagaacaggtctctggataaatgagttcattcactttgtccattgtggttgacactcggactccactctgtgcactccagaaaaaacacattcactcactgagcgctcactcccctacaaatgtcaacaagatattctattcaaacatggaatatacctaaaattacatctcttgcttatttatcttcaagaagaaataagaaaatttcacgcctgtcttagtcaaggttcatcatagcaatagaaccactaaactatgaatttatttggaaagaaacttgagaaatgtctcaggtgattctggagactggcaaatccaaagtctgcaaggtaggccaagaggctctggatccaagaaggagtcaacgttatagctcacgcctgaggtttgcctgctggtaatattccctcttctcggggagaagtcagttttttcttctattctggctttcagctgattgaataaggtcctcatagatataagtgagtaggaaagaatttatagccaggattagcttattattctgtgagcaacaaataataccaaaatatctattattgaaataataaacattgatttctcagtcatcctacatgtgtatcattgattaaagtatgaagatggccatgctccatagtgtcagtcagggatccatgttatggaagctccatgagttgcctttttttttctttttttttgggtgtgtgtgtgtatgtgttgtgtggtgtttgtttgtttgttttttgtagagacagggtcttactatgtcacccaggctgcagtgctatggtgcaatgacgcaatcttggctcaatgcaacctccacctcctgggctcaagccatcctcccatctcagtttcctgagtagctgggactacaggtgcacatcaccacacccagctatttttttttttttaatttttcttagagatgggatttcaccatgttgcccaggctggtgttgaagtcctggactcaagtgatccacccacctgggcctcccagagtgctgggattacaggcatgagacaccacaggcctccatcagtttttgatggcattatctggcacatgcagttaaacaagaatacaatagacaacagggtacagaagtatgtgcatgacgtataacatgtttcagtgctgctttttaattgattgtgtaaaaatgaccaaacttttcttagagaagcagggaaaagtggaaaaattatgaaggcatgagagtaactcaatgaatgattataattaaacagcatcatctgttaacttccatgttctcacctgcctcagtggctgggtaacatgacactgacacagttttacctctattactctctggaatccatcctcatctggtctgtctggattaggagcaggaagtgataattaattgatggactcttaagatttaatgacattttgagaacatttttttcaatgggctcacactaaagatccttttatttataaaaataatttttttaccattcacaatgtcagctgctaatactcatcttgtcagcccaaatttgtagagctttataactgagtatcttcctcgtcagactgcatttcaagaagctaggtcccaagtctctggatctttattttcctggcttaggtcttaaatataagataaattcgactaataattataggactgcattggaattctaagtattcaggcaagctgtataactgtaattcacattctttttattcaaatattcttgcttgagtaaaccacagtaagaataaggaagtagtgactgagtgccttgccagtacagcagatgctagaacataatgtagcattactttccccagggtttattgttatgtaagttcttgttcagcttcctttgttttctttcacttctgagaatttaactttcgtttctcactcagctcctgtggggaaactcatttgtggagaccagccctctggcttggtgagtgaatctggtttacaccggctcctgccctgccttcactcttctcccctgattcaagactcctctgctttggactgaaggtgagtggagcaatctgtgggagcatagaatgggaggctttgagaagaatagattgattgtgtctgggtgagtttaatttgtagttctgaagctgctctgcataaacaaaaagaggcagcttgtgaactgtctgctgagatggcagaggaagaaagcactgagtctgggagaggggtaacctttaaagaagagaggtttgcaaaagcaaaaagccttgcttgtttcctagagggaccattcatttcttcaatctaggtacctccatcaccttccttgttggaaataaagctcagaatcttaagggagacgagcactcaaacaaaggatttctcagcaaagcaattttatttctgtgcagaggggtgcttcttctttgccagtcgccatgagagcacactagaacaaaggaggaagaaagtttttattcctgacgcaaatcctacccctttgccctttccccattggctggagtcggccacacaatctaaactagactcagttggctaaacattttaactttctttagataaggtgggcacgtgagggagagaggggagatggggaaggggtgtgtgtgatgagctagataactaatcttcttccaaaataaggaaaggaatgtgagttggtactgataacgcctggtactgtgacatgtctaggcatgtagcaaaagcagaaaggaaagagaagagaagaaaagtgaagtggggaggggcactgtgaattaaagaataaaggattgatcaggctatttgaagagaaaccttatcataccccacattcctattctgtcattttgatttttccattttgccaacgtggatcagaattttcttttattcagaggcagcaaattccttcctcctttctcccgaagaagcctgtgcaatgaagctttgttttcacttttcataaagcaacctcatgatgaggttcagcagggatgagagcccttatctggatctgggtatgaggcgaaggagtcttaggtactcagtcttcagaagtaaggcccttttgaaggttatccttttacttgccttctggtaactttttggatgctgtccatagctttcctgataaattagcagccctctggttagtccgaggagagaggccgcaggacgggcagactgctgctcatctctgcagctccactttggtctcttgtctctgaaggtccagtcacagggaacttgttcttctgagtacccacagcttactcttcctttgtagcaggaccagccacagaaaaaactcctcagacaccgaggtaaagaaggaaggggtttattcggccaggggcataggcaagactcctgtctcaagagccgagctcctcgagtgagcaattcctgtcccttttaagggctcacaactctaagggggtccgcgtgagagggtcgtgatcgattgagcaagcagggggtacgtgactgggggctgcatacaccggtaattagatcggaacaaaacagagtagggattttcacagtgcttttctatacaatgtctggaatctatagataacaaaccaattaggtcaggggtccatctttaactaccaggtccagggtgtggccccgggctgtctgcttgtggatttcatttctgccttttagtttttactttttctttctttggaggcagaaattgggcataagacaatatgagaggtggtctcctccctcaacttctgtagcacccaatgaacctctggtatccactcctgttttagaagttgctattattctaggtacaccttttcatcatgagttacctcaactccctactcaattttcccttgcacagagctaaggcaaggagttggtaatttctcctgagtcttatctcgatcttatcgctgagcattttgtaccttgatgcctatgtcacccatattctgatgtgtccttttctttgtttcacttttcagaggtccaggtaactgtctccttatgtgtctgtaccgcacatcttgtcaaggtccatatctagtatttattcattgtcaagtctagtacaggacccaataaataaaactgtacttttaatttttgaaaaatatttttgactaaattcacaaaacaaaagcatacaggtatagtaaaaaaacaaaaacaaaaacaaaaaaactatctattcgatatataatcaacattaaataccggtaagagattatgctctggactagggaaaaggaagtaaacacgcagtcaaaaaaaggaagtaaaccagcagttttaatgtagcaaaaaggtagcagttactagaggataaatgtaaaaccaataaaacaaaagcaacaaactaaaagggctgcaataggatgtggtatctgtagtgctcttgtcaagggctttgcaactttaaatagatttcacattaggtctcactgtgagacaatgattttgagcagtcttcaataaaatgatggatttaagaactgatgaactaactgtgagagaaagagatgacactggggtagctttatgaaatctgtcctctgttacaaaatgacttatctgaaacatattgaccagagagttagaactcttggaaaaagggtcattacttggggaaaactaaaccctggacattttagtgggtcattgaaaaaggaactctgagtttagacaaataagaagtggtaacggtgtttctgagttctccaggtttctgcatgccaagaacaggacctattttctccattggtagttcctgacccaaggaacaggggaaatttaaaagatgttggctaggccaggcacctggtggcttgtgccaaagcctagccaaaaatcccagcactttgggaagccaagactggaggactgcttgagttgaggagtttgagaccagcctgggcaacgcagtgagaccttgtctcaaaaaaaaaaaaaaaagatattgatggctaaaccccttataatttttctccttattgtgtagccacactaatttaatttaatctttttttttttttttcttttgacggagtcttgctctgttgccaggctggagtgcagtggtgtgatctcagctcactgcaacctccgcctcctgggttcaagtgattctcctgcctcagcctccagagtagcggggactacaagcaactgctgtcacacctggctaatgtttgtatatatatatattttttagtagatacggggtctcaccatagtggccaggctggcctcaaactcctgacctcaggtaatctgcccgcctcggccccccaaactgctgggattacaggcttgagccacagcgcctggccatcttttttttttttttttttttgatttaaattgcacagataaagaaagcttctgtgcaggtaatcagagtattctgaaacaaggaagctacggacctagttagccttcaccgtgtcatagaaacttctacattcgcaccaccttcaaaggggagcatgcattttgtttatgtgtctgtctgtctacctgtcttaggtcggaagggtttcaatggggctacatttcttcaatgttagaataaagaatgaataggccgggcgcggtggctcacgccagtaatcccagcactttgggaggccgaggcgggcagatcatgaggtccggagatcgagaccatcctggctaacacagtgaaaccccgtctctactaaaaagacaccaaaaaatcacccgggtgtggtggcgggcgcctgtagtcccagctacttggaggctgaggcaggagaatggcgtgaacccgagaggcggagctggcaaggagccgagatcgcaccactgcactccagcctgggtgacagagtgagactccgtctcaaaaaaaaaaaaaaaaaaaaaagaatgaataaatcaagaaaaataagcacttgtattagttttctagagctgtcatagaaaaagtaccaaaagtggttggcttaaatagcagaaatatattgccttacaattctggaggctagttatccaagataaaatgtgttgacagggctggttccttctgaaggctatgaaggaggcctctggtccatgcctctcttctagcttctaatagtttcctggaaacctttagcattccttggcttataggtgcatcaccctgatctctgctttcttcttcaccctggcatattccttgtgtataaatgtccctttttgataaggacacagtcatgttggataagggtctaccctaatgagcacatggtaactaaatagtatttaaatatactagtttcaaataagagcacattcacacattaggatttcaacatcatttggggagaaacaggacagactttatctctctgctacatattctcaatgtacttggcctcctttatggattgagacttttctcccatgaccaacagatgtttctttgaaatgtatattgagtctatatcatgtgtgtgatcctataactattttagcctcttttcctcttcccaaaatatatacatctttaggttcctatcaccatccttgccatatgtccaggccaaggtgaaatttcaacatttaaaaccacagcatgccccagaactacatagctggtctggatctctccatttctatacccccaatagcactgggtatcagtatagctcttgtagcctttacctttgttgtctgtataaatctgtgctgcagtggagagaactctgaaggaggaccttggggacaatacattcactcttactctacctattagattagaatgagtgatctttgtaagtcacttgattctattgacacacctgaagaaagggagtattcttatttctcaagggttttgtatgaagaataaagaagtcaaaatgatttctaaattgtaactgcttataaaattgttcatgataaaattattttcctattatggtgttggtggtggtggtgtgtgggtgtgtgtgtatgtctttggggatggagtgtgaggtcatgggaggacttgctatgggtagatgtgttaggatgtaaacacttcttcactggaaaccataattgtggtcccaaaggtcagctattgggaaactgctaattgatggaaagaaaagatgaaaatctgattaaaaggtctaatcatctatggagggataaggaagttgtggctttatatattcgttaaatgttttattcctgtatgtgattcacttttcta

SEQ ID NO: 388 - DNA, 206330 bp, Homo sapiens
gccacagttttaagccatcagatcttgtgagaactcactcactatcacgagaacagcatggggaaaccacccccatgatccaatcatggtgttaggtgattaggggttaggttagatccctcccctaacatgtggggattacaattcgagatgagatttgggtagggacacagagccaaaccatttcagtgatgaattggctagtaaaatagtggtttatctataccagcagctctcaaactttgtggtctcaagactccattacacttttaagaatgtttgagccccctgaagagctttggtttatgtgggttatctatgtgaatatttatcatattagaaatgaaaagggagaaaagtttaagacacagaaatacacaagcacacattccattagttgtcagagtgatgacatcacatcatgtagctgtcagagtgatgacatcaccacatcagcaaacccaaaattaagaacaaaatgggaaataatgtcttagtattaagaaatagttttgaccttgtgaacccttggcatcttagggaaacccttgatctataaaatagaataagattccaccaaaaaaatgttgtataaagcattcactgacactgaaaaatcccaatttttaaaaaagcagaccacagaacagtatgaacaggattatacgatttaaaacaaatttaaaaagcaatggaaagacacactaatattttacaagtatatatctctagatggtgaaaatactagttttttttctgcattgagatttttctttatttttatttttttgagacagagtcttgctttgtcgattaggctagtgtgatggttaatactgtgtgtcaacttgattggattgaaggatacaaagtattgatcctgggtatgtctgtgagggtgttgccaaagtagattaacatttgagtgagtggactgggaaggcagacccaccctcaatctgggtaggcagcatctgatcagctgccagcatggctacaatataagcaggcagaaaaatgtgaaaagagagattgccctaaccttccaacctacatctttctcccatgctggatgcttcctgccctttaacatcagactccaagttcttcagttttggaactctgactggctctccttgctcctcagcctacagatggcctattgtgggaccttgtgatcatatgagttaatacttaatagactccccatatatatctatatcctattagttctgtccctctagggaaccctaactaatacagctggtatccaactcctgggctcaagtgatcctgtcacctcagcctcccaaagtactgggattacaggtgtgagccactgtgcctggctgagatttttcttttgtaattagaataaaacgcatttaccaaacatatacttaatgcctatttacagtcacctgtattttccttcccagacctgaaaatttcagcttagtagctttaggaaatgtatcactaaaaaatattaatacaaggtattagttttgcacagctctaaatgaggcctacttgtagattgtccttgcctcttaaagtgcggtctgcagaccacagcatcagtatcacctgggagcacgctagaaccatggattcttcagcctcaatcaagacctacagaatcaggacctgcattaagacccagatgatttgtgtgcacaacagaatttgagaaaccatgggggtacgttagaatgacctgggaattttagaaacagtgtggaagagagcacatgttttttgtcttttttttttttggaaacggggtctcgctctgtcacccaggctggagtgcagtggcacaatctcagctcactgcaaacactgtctcccaggttcaagcgattctcctgcctcagcctctctagtagctcggactagaggcctgtgccaccatgccccgctaattttttgtttgtgtttttaatagagacggggtttcaccatgttggccaggctggtctccaactcctgacctcaagtgatccacccaccttggcctcctaaagtgctgggactgtaggtgtgagccaccacgcctggctattttttgtcttttctaatgctctcaggtgattctaatgtgcatctagggctgagaaactgctgctctaatgcaggggcctggcttgaatctaaaaaagaacaagattgttaccccaatctctacctactttaaaaaatatcctcccactgcaacatgtagtgacctccctgccagttcccgggtcctagaatttcacaggaacagcagaaccagatggagaaaacagctggtaatatagtttgttcaggctactataacaaaatgccgtcaactgggtaatttataaacagtagaaatatgctcacagttctggaggctaggaagtctaagatcagggtgtcagcataactggattccagtgacagctcttttctgggttgcagactgcttccttctcgctgtgtcctcacatggtggaagaaggcaaacgagcgcccacaagcctcttttataagggcactaactctgttaatgagggctctgcaatcatgatctaatcacctcctaaaggccccacctgttaatactaccacggtagggattaggtttcaaccctaacagcacagagcttgtacctatgttgtccaattttacaaaaaaattctacttttcacatcaccttctgatatggttcggctgtgtccccgtccaaatctcaccatgaattgtaataatccccatatgtcaagggcagggccaggtagagataattgaatcacgggggtggtctctctcatactgttctcctggtaatgaataagtctcatgagatctgatggttttataaatgggagatcccccgcacaagttcttttgcctactgctatgtaagatgtgactttgctcctcattcaccttctgccatgattgtgagttctccttagccatgtgaagctgtgagtccattaaaactctttcctttataaattacccagtcttgggtatgtctttattagcagcgtgagaacagactaacacaccttcattgtggatgaggtagttactgatcacctcaattaccactgctgtcattcagcaaactttcaagtgcctggtatatgccaagtactgggccacaattccaagactctctatactggaccttgctgcttatctgagcttttccccactctttcgtctggaggttctgggcccttcccaacctccccagcagcataggctttattatggccccttccacattccccaggggcccagaccaaacctctcttccttcttgagaccatcttccattaacccctgtgttcttcctgtatctcaaccaggcaccattttgagagatgtcagtttagctcttgatgaattggaaattttccacatgtggggttttcccctccatcagtttacatttcctcaggaacttatgcagcgtgcttataacacctgcctggaacacagtaaacttctagtcaataaatgtgacctgttatttcaagggatagatgatatattcacccctagtacccagcctgcaacaggtagccagagaactagtgggcctgattcagttgcaaagtaacaagactaaagacagcacaagtgtggaaatatggctattttctttataaaacttgagtcactctaacaacttgaatttaagataatttacttcaaataaatacagaatgcagactatgacttaatcataataaatcattctctatgtttaaaatgtcccacaaaatgttgattgttttctttttttgtttttttgagttggagtctcagtctgtctcccaggctagagtgcagtggcgtgatcttggctcactgcaagctctccctcctgggttcacaccattctcctgcctcagcctccagagtagctgggactacaggtgcccgccaccacacccggctaattttttgtatttttagtagagacggggtttcactgtgttaccaggatggtcttgatctcctgacctcatgatctgcctgcctaggcctcccaaagtgctgggattacaggtgtgagccaccacacccagctgattgttttcttttttacgtattttttttgtttgagtcaggatcttgctctgttgctcaggctggaatgcagcagtgcaatcatggctcactgcagcctccatctcctaggctcaagcaatcctcccacctcagcctccaacatagctggaattataggcttgtgtcaccatgtccaccaattagaaaaattttttgtagggagacggtctcactatgttgcccaggctggtctcaaactcctgggctcaagccatcctcagggtgagtctataaagtgaaagcaaatttattaacaaaaaaaaggaataaaagaatggctactccatagacagaggagttctcagggttgccaattgcccatttttatggtcattttttgatgatgtgctaaacgaggggtggattagtcatgtctcgcctttctagaccatgtagggtaacttcctgacattgccatggcatttgtaaactgtcatggcgttggtgggagtgtaacagtgaggacgaccagaggtcactctcatcgccatcttggtttttgtgggcttctttactgcaacctgttttatcagcaaggtgtctatgacctgtgtcttgtgccaaccttctatcttatcctgtgacttagaatgcctagccatctgggaacatagcccagtaggtttcagcctcattttacccaggtcctattcacaatggagttgttctggttcaaacgcttctgacaagaccaaagcaaaatccaggtgattcacactggtggtatgtatgcatatatgtgtgtatttctaagtacagtgtgtagaagtaacacactggtggttttagaagaaatataaagatgttctattccttgtttctggagagttgctcattttgaagaggaattgaagtgcaaaccagggtcctggggccttttgtcacaaaaacctctgaagttccaatggagggtggtgttccctgggagggagggtgcagagcattgtcctcccagccccattgaggacacctttaggacagtgcctctgcctggaagatgagcagctttaggcagtcaccatcgtcgtctagaaaccacatttgaaaactggtgggaggacaaggcccagctccatcctgccgcgataaactcccagcagcaagatcccaagcaggatagatggtgatgggagcaaaacgtcctgttctctcatctttccaaaacaagccttgccattttcaggagcgtgtaaaggaaataaaacacctacccgccctaagcaggcaacataagctgtgtaccttcaagtttctccaaagcacaagcgcctctgaacatacagtgtttttatccctgaactattccaactccagtccggagtggttttacgcagtcgacactagagggcaggccattaaaacgttcccgttcaaacgagttgctctgcaaatgcaagagctgacacagcacctgaaggtccgctccgtatctgaaaagtagctttcccccacggagaatgcaagcgtgcgttcggtatggggcaagagcgtgggaagcctgctactgctttcctttcggggcatatttacagtgaaagcccgtgaactcgcctgctcttcccttagatttactttacttgggaattcctagaagtggaaaaataaatcacaatggccagtgcgggtccccagaggtttagccccggctaatggataacaggaagggactaaatcagcctcctctcaccagcggcaagtttacaagagaaccactcagcatgaaaacgccaaagcaagctgtacttaatccctcaagaagtcctaaaaactgtaattttattaagttagagacagggtcttcctctgccaaccaggatggagtgcagtggtgcgatcatacttcactcctgggctcaagctgtcctcctgccccagcctccagagtcgctgggagtacaggtgcatgacgccaggtccagctaattaaaaaaaattttttttttcatttttttaagacacggggtcttgctatgttgcccaggctaatcttgaattcctgtcctcaagcaatcatcctgttttggcctcccaaagtgctgggattacaggtgtgagccagccaccttgtctggcctaaaactgtaattttataaactctttgtggcaaacccctccaaacaaaaaggctcgggtgagtgtaaggatggctttgctccaagttcagagtttggcttctccgccgtgctccctgcccccacccacccccccacccccatctgactgccttgtctgttatcatgtgtagattttctatggattttattgtgtcatcatgataaagccaatgttaatgtatttttcaggcaaatgctgcattttcctcctcaaagactaggcttctcactctggaattgggcagcacctagaagcagccccatggcctcactggagagagctctggccatgaaaccctgctggccagcgtttatagagggcttcccagttcttcattggaggtctaaacaggatttccctagagaaggagggcttcgtggaataaatgacaaagggagttggggtggcctgccaggtcactgggctccagctcctcattgttcagcccacaggcttcccagggcgcctgtccaagccagccggaaacagacgaaactgcaaaatcactccattcctgcccacacaaacacggggaaatgaatgatcactttgcacaagaaacctccaagagacactttgaggatccccttgaggaaaggacaactgggacctgtggcaggaagaaggctgaaagaaaagtccaggtttattactccctgggagaaggaagaggaagaacaaaggaaatgcacttctttaagtacttcatgatgcaaaatatttttaaattcctgagttcacatttaaaaactgtatatttttaaattataggagcaatgatgttagtggtaaccagcccaacaacagaaataaagagaaatttaataagcttcccctaaagtctaccttctacacattgaagaaacttcctccaagtttttgagttttatagacaaagcatccttttacttctgagctgtcatttttttttcctttgttggcttatagtttgcaacaagcaaagagggccaatgtagacaataagaaaactcaagaagcagggattggccatctccaatcatcactgataaatttccttaaaatcaaaataacgttgtttcaaatatctgagatatgaggcaaaacgtttcttgaacaagtctgacactatgttgtcaggatctaagtgtgctatatgaaccttaaaatttgttttcatttgatctttgaaaaaagtatttaatcagttctaacgacggaagtcttcttctgcagtgataattcacaatgaaagacatttaagctgacgtttctctaatgggtttttaagattccagctccaagggactgtgagaaattattttcttatataaaaggttgtgaatattatcaacatttatctaagcccataagtcataaatcccaccaggcattaaattttcaagggagcttttaaaacatagattaccctgtctcccactccagaactgctaggggtaaggtctggggaatctgtatttcacatggtccccaagtgattgtaaccagcagatgacctcatgggcagggatttcctacatacgaggctctggcctctgtgtcttgtcagtcagcatttttaagtacaaaggaacctttcccttcccaactacaaaatcttacctttctgtttcccctcctagaaaactggatcagaacaatgcttctcaaagtgtagtccccaaacaagccgcaaacagcatcacctacgatcttatcagaatacaaattctccagccccaccccagacctactaagttagaaattatgggcacggagcaaatgcattcatgtgttttaacaagtcctcccagtgattctgacacctgctaaagtttgagaaccactggattcgaaaatttcacaatttcaagaaagaagtaatgaagaaagacacaccatgtaaggtagaaccaagtttattaatgacagcctttattacaatcactctcaagtgtaaaaaataaagggtgattaattaatatttaaaactcactcggacttgctgtttggcctttcagtggatgtgccaaagggcagggatcttgcctgattctgaatcaattggccagatggagttcactggagaatgaggcaatcaacaaaaaagacaaatgatgccaactggagagagctcgtgtcttctccatgttggaaggacattacaaaatggcaactgtggtgggggcagagatgaagtaagacaaccttacagtcggagtaagatgtgaatacctctacctatacagagacaaaaacacacacatgcagagccatacacacacccaaacagtgaacacagttttgaaaataatttcctttttgtcctttctctgagcagactgacacattcatcggccaccaccatgcaccatggggctgaaatggaaaacctcgcttaatttccacaaagtattctagctggctgcccagttatgtgctggcaaatctgtccgcaccgaaaaatgtgcctgtggttttcccagagttccacagactgatatctgctccccaggagggcaacatccggtggacaccagctggattaaaatctagagggcaaaactcgtccctcccacctaaagtgggggcaggagcggcagcaccaggaagtggtttcccactttgtgttacagagtacttgccccagttcaacgcattcccctccaaagtatttgtgctttgataccatcctgatggttagtctgcaataagagaactgaaggagctatggccatgcactattttctttttttaataaaagcaaactaaaactggaggaagaaaaagaaaccattagaagcttttgactgggtcaatgttgtttccaaattgggtttaattccattcaaagagaaagaaggggagggtgcagaaaaggccactcagatcgactctggaagagatcatcaagaccagggaagcatttggatggtacagctggtctcttcccagccagactgggaggacatgccacaacctcccaaggctgtgaacctaggaaataagtgctgaccaaataacatatttcaatgtttgtagaaaagctggcaggaaagggagatgatggattcagattcacaggtcatgcagattaagacttaatcaaaaattaatgcttgagctgagtaagaaaacactaaaatttaagtggaactgtatcatagctttcacctttggaagacgaaaaacaacaaacatacaaaacaaaatgacccagaatattccagagtttccaaaaatccaactgctaattttggcagggtgagaagaaggggatatttaactgatacctcttcattaacctcattttctccttgaatttcactgataaacaaagctcaggtctacttagaaaaacgatcagtcctgctaaaatacagcctcatgacgtcttccaatgcccttgctcggtgcacatgaaatacacaacttctcttataaggagactttccaggatagaccaagtgtgctcgcccaagtgacttgctgaataccatcacaaaatctgaacccaaagatgagttgttttcttcttcagatgagagttgcaagtgtttcctaaaatgtacatggagggatgcccacaaaccactgccctcccaggtgaggggctgagtctttgaggagatgcactccttcaggccatggaacagaaagaaggtggtccgtccaaggtgtggtgaagagcaaagctgcctctcccagccctccaattacggaagatgaggacaagaatgtattttctgcacattcaagtacatctgggtcccctaccctccctttttttcttttttggtaagcatctaactgtccataaattcatggctacagtagagattcacggcgcaacgactttcatactggttatttttttttttaattctgtcagtgagcagcatttcccagttttacactcccctaatggcagctccattaggcgagactgcaggctgcatctgtgattaggtccatgcagctcgaagatcagttcggcacgcgggagggtcccgaaagctgggtctgtccagtgtcttgcagcagcggttgcagggggtctaccagctcgccctgacagcttcgatatcgctaaccaaattctgggccaggcatatcccaaatatctgagaaaggaagaaaatgtgagtgaaacagtgacacttgtaacttgtttccctggccactgtgtcccatttttttaaatcattgatttttgaaatttaagatgtaattcatatgtggtaaaaagcatccttgaaatgtgtataattcaggggcttttagtatattcacaaagctatgcaactatcaccactatctaatcacagaacatttcattaccccaaaaagaaaccctgtacctgtgagcagtcattcccatcccaccatccctacagacctagcaaccactaatctacttcctgcctctgtggatttgcctcttctggacatttcatatcaagggaatcatataatatggggcttttgtggctgtctttttcatgtagcaaaatattttcaaggttcatatacatgtgctattaatttattccttttgatggttgaatgatattccatggcatggatatgccccattttgtttatctactcctcagttgatgtgtatttgcattgctctcacattttggcaattatgaataattctgctatgaacatgagcatacaagtttttgggtaaacactttctcaattcttttgggtactcctctaggagtagaattgctgactcatatggtagcactatatttaacttttgagaaactgctaaattgtttcccaaagaggttgcaacattttcatttccattagcaacatatgagggtttcgttttctccacatccttgccgatacttgttattgtctgtcttttttattctaaccgctttaacgagtatgaaatatgtggctttgaattgcatttccttaatgactactgacgttggcatcttttcatgtgcttattagccattttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctttattagcaattttaatctttagagaaatgtctgttcagatcctctgcccgtatttttgtttgtttgtttgttttttaataatttaagggactgggttttgctctgttgcccaggctggagtacagtggcgtgatcatagctcagtgcaggctcctgcctctgcttcccaagcagctgggattacagggacaagtcaccatgcctggctgcccatttttaagttgtttgtctttttattgttgactttttaaagttctttatttttctagatactaggagttatcttttcactgtcttgatggtatcattttcagcacagttttaaattttgaagtccaatttatttacatttgtttcattgcttatgcttttgatgtcatatctaagaagacactgcttaatccaaagtcacaaatatttatgcctatgttttcttctggagttctatagcattagctcttatatttaggtctttgctttattttgagttaatttttacatatggtgtgagttagtctaaattcattattttgcatatctagttttcccagtaccatttgttgaaatgactgctctttccctattgaatggttttggttcccttgtcaaaaatcaactgaccatatacgtacgagcttatttcatcttcttttttgagataggatcttgctctgtcacccaggctggagtgcaatggcatgatctcagctcactgcaacctcccaggctcaagtgatcctccctcctcagccccccaagtagctgggaccacaggcatgcgccatcatgcccagctaacttttgtatattttgtagagacagggttttgtcatgttgcccaggctgttttgaaactcctgagctcaagtgatccacctgactcagcctcccaaagttctggaattacaggcatgagccactgcacccggccttatttcttctttttaatcatatatatttttttcttatttttttgagacaaggtcttgctctgtcacccaggttagagtgcagttgcataatcacgactcactgcagcttcaaccttctgggctcaagcaatcctcccacttcagcctgctgagtagctaggaccacaggcatgtgccattacatttggctaatttttttatttttactttttgtagagacaaggacttgctatgttgctcaggctggtcttgaactcctgggctcaagccatcctcctgccttggtctctcaaagtgctgggattacatccatgagctaccacacctggcctggttttatttcttgatttttcaattttattccacttctctatatggctaatcttactcaagtacacactatgttgattactatatagctttgtactaagttttgaactgggtagtgtgaattctccaactttgttttacttttgcaaatttgttttggctattatgggtcccttgcttttccatatgaattttaggatcagcttgtccatttttgctaaaaaggtggttacaattttgatagggattacactgaatctgtagatcaacttgatgagtgttgttaccttaataatatgaagttttgcaattgtgaacacaggatatctttatatttacttaggtcttctttaatttgtttcaactatgtgctctttggaaagtatcacaccaacaacatgaagagtccagctcttaagactggccaggaggaaaagtgggtgctcccttccttcactagcactttggcaaggtagtttagggagagaaaggggtatgacatctctgtgaaacttcccaaaaccttaacgtcaccactgagatctacttctaactatgcatgtttgactcagttgccacaatgcagtatttttgagcccatgtaaacgatggaatgccagtaggcaaccactatctaattaatgtctccatcttagaaaaagacaaggtttcctaaagtatttcatgatagtagcatctaaactcagagctttaataaaacacaaatcaggccaggcacggtggatcactcctgtaatcccagcactttgggaggccgagatgggcggatcacgaggtcaggagatcgagaccatcctagctaacacggtgaaaccccgtctctattaaaaatacaaaaaaattagccgggcgtagtggcgggcacctgtagtcccagctactcgggaggctgaggcaggagaatggcatgaacccaagaggcggagctttcagtgagccaagatcatgccactgcactctagcctgggcgacagagcaagactccatctcaaaaaaaaattaataaataaaataaataaataaatgaataaaataaaacacaaaccaaatcgtttaggtctgttcctcagccctccaatgtgtcttaaaaactatgacaatcaaggtttttaagcaaagctccgatcctggcaagggctctcccagggcattatttccctgtgatatccataaaggacccttatcttacctgcagcaatgcaatgcctatgaaaataccagcaacgatggttaaattgtcctgcaaccacttctcaaactggggcacacagcctttcgtgtagattacaatctgctggtcaacttccttcacaagagaagaggagagcacattgtcacagatagagcaccaggcacaggccaaagctcctccaacacccttcgtgctaagcaacaacatgagattccacttactggtttttgcctggcatcatagccacactgagtgttgatgacatcttcctggtgaagaaaggaaagagaaaagtgaaatttactcattagacagaaagcccacctagaaatgagcagaagacttctgttacgcattagtaataaaatgtgtatctgggcacaaagactgcagcactatgttaaacactttatatacatgatcccatgtcattattgcgacaatcttcagaagtaggtattaaaatatgccctattttacaaataaggaaaactaaggcttggggaatatcagaaaagacagcaagtctatcacacaggaggctcaagattcaaagtggtgccaacctcaagaagcttatgggatttagggaactggagacacagataaaaaacataaagggcacagtgaatcttcatgtatgctcttttggatggactgctactttttaatctatgtacttccatgttacttaaattgtttttcaatgagcttttaataattaaaaaacaaaacaatgccccgaccacataatcacacagacaacctgacgtctcacagggtctgatcagaaacatggttccactttttcgggttgtttattttccttctctgcggggtgtggggcagattttattagcttagagcgcaaggaatgagctagctctgcccagaggatctgtaggtgaaaggggaagcattaatgcctctgagaatacagaattctcccaagggagtgttaatgtgggacaggaactggcgacaggaggcgcactgtgcggcacccgctggccagtgcaaggccaccaggatgagcccctcaagctctgagtgggcactctgctgccatgtggctctcctcagaagggagaggaggtttgagctggtgggaagggcagctggcggggcagcacagtccttagtgactttgtctcctctttcagaccaagagaaacagctgaggtggtcccctggaggaagcccacagggaagttctgcttttccactccaagaccatagctccttttaagagccccacagcctccaccataagaaggagcatccccactgagctcatcagcacccactcggctctgcttctgaggggtaagggcgagccttggggagtacatctggagactgcagggccagagaacagttgaggagtcccagaagggttctgcagctaggagcacacagagatgcgtggagtaacctctcatgtttgtcattctaacactagagagttaccttttttttttttttttaagaattgtggtctcactctgtcaccaggatggagggcagtggcatgatcatggctcactgcagcctcaaactcctgggctcaagtgatcctgtttcagcctccagagtagatgggaccacgggtgtgtgccaccacacatggctaattttttaatttttttgtagagatggggtctcactatgttgctcaggctggtctttaactcctgggctcaagggatcctcccacctcagcctgccaaagtgctgggattacaggtgtgaactactatgcctggcttaagaattgcattttaagtcattctatataccaggcacgatttgacacaaaatataatcaaacctgtggcaaaagtgagtgacttacaaatagattttatattttattcttttttataataaaatgcaaactgcatgactatagtcatgatgacattcaggagtctgggcagctgtggtcttcctacacagcagtccaggcctatcttgtctcaaactctcctcctactcctaatagttcccctagaactaagccaaaaagaaaagggttactaaccccaaaccaatgcagagagctctcatatgagcctgcccttctcatgaagaaaggctaacagatgatacaggcaagttgcctgggtctcatattccactccattgcctgctagcagtgcaagcttgggaaagtcacttacacctcatgtgccttgatttcttcccctgaaaagggagggtaatggtggtatctgccagtaggaatgtgcccaacttaaatgagccaacacacataaaggcttagaataggaaccagcacacactgctaaattaatgccagcaattattactcctactaggaagatttgagcaccataaccccctacaggagctacaaatacgagtaaccaggtaagaagagggttcaaccaaaaaatcactctgctcgtcccatgcacactctcggcatgatgtacagagtaggccaatagttcgctggcattcacttactgcgggatctttagtgcagcaggagaatggaacgccacatcgctctcgacttgcattggaatctgtgcaattgaagtaaatatttaggttccaatcatcagctccaaaagccccacagcactgccactagagcaaacaggaaagaattagaacatcccaacttggaggcaagcagtcacctacactcacacccgccgaacgacaccagcttctgccagctctgaccttcttttctgtcctagactttatttttaagccaaactgaacctaaatggcccatataaaatcttccaaattaattagggctgaaggtttgtagggatgtgttggcacgtgatttaaacaactgatgagacctgtggtgttaggtggaagaagggcagagcagctgtacagcagggctcagttagaacaagatctgtttggcttgggcacgtcattctagaaggagaaacaagaacattctagaagggtaaataagacactaacgacagtggtagtgactgaaggaggcaactggggttatgggtgggctaactatagcttactttttcaaagttttgatctctacattctaatagtttttttaaagatctgttttgttttatggagcgcagggagaccccctgaaactattgctatggaataaaagatgaaatgctcctgattactggaaatacaaaattgcatgcaggattgtgtaaagacaatgccaggttggactgccagaatgagccaacagtgcgtgatgtgcttccccctgcagagagcctatgaatggacgtgcagtcagggaggtttcacatcaccaagattcctatcccagaaaagcagatgttcatagctctgggaatagaatgcgacctttgtggagagcctataaacagacacatgaggggcacctgtccatatgtataagacagggctataaatgccctcatcttgccacggctcttctagacctctttagggttaaggcatactcccttctgagaatttctggtctaactggttgtgtagcttcacgtcctgtttctatggattgtttgtaactggcttttgctgcaactgttactgctgactaatatcttgctaatcataggttgtggaaagactgtgtttctgttttaaggctctgttagaaattactgaagcacacactatattgtaaattcttatccctgtatactgtacttttgcatacagatgttatgttaaagaattacttcatccccatgtgaccatctcacctcataatcaaatgacctaaatccctcactaacctacccccaccctcactaaacttaataataaattctggtatatccagtgcattgttggcactgcgtgaccagaaggcggtgacccccctggacccagctttcactatcttgtgtgtgtctattatttctcgacctgccgatccgcctgggaacagagagatccctgttgcattgcaggctgctggccagatcccgcaataatggaggtataactgacatacaataaattgcacattttaaagtatacaatttgataaattttgacatctgtatacatcacaaaaatgtcaccacaatcaatggatatatagttgatatatccattaccaccaaaaattttagaggttaacttttcatcatatttgtttctactctgagtttgtttaaaaacaagtgcatgtgttttacattttcaactttaaaaagtcagtcttccaattaaaatatattaaaacaagcggttaaattcagtggttcttaaatggggccggagtcaaaggctactacacaagccccttcctcacttccctgggatgcactttctctacttctctgagttaaataaatatcaagtctcaaccatttgaagaccttccggaccaacagctacttctaaacattacattccatgatgcaaaaagaaaatcacatgaaactgtagtatttccgtttaaagcacacagcatcccaagacaacatggtccttccagggcttgggtcatgcatttcgaggtgtgtccacaaagctccatcaatgtgtcatgcaaactagtcaggaataatgccaggaaagggattattagggagcctgcacccattaggacctaataaaacagtgaagtcggctgaggacatgaatcagggcttaatttcccacttaaggggcagcttactccaggacgaaatgttgctgccactgaacaaaaccacataaccctgctcagtcctgagtgcctaaggaaggggatggcctccctcataaagagtgtcaacatggctgctgcctcccttcatcacaggcagacaactatccaaccccaagaaggctaccgttcactgggcttctgcttgccctccggtcctgccatatacatgaatgccacagacaccgctgtccaagtccaagctcagcctacccgacttttcagtgcaggtatataaagacctgcaagtttgtaggaccctaacaccttagcctaatataaaaacatgtatgtctcattagtgtcataatatccctgtgagttagacagtagctagtattatttccattttgctattggggaaataggtcaaggtcctgtgagcccagggtcccttatcagattttggcactagacctgtgtcttttggtcccttgcattctgagtgaaacgggacatctgctgctttgctggcactgaaagagccatttcacaggcatgctcagagacgggagggagtggcctggactccaatgctcagggataggagagagtggcccggattccactgcacagattcttcacttgttagaagccactaggacttaggagtttctaagcttttgcttttaactgcatgtgcaataataatatttggataggcacattttaggaactttgtggcaaattattctgttgataagtagattattatgagctgtgaaatatcaaggattaccaaaaaagggggcaagggataagaaagaatccatatttaataaccaaagaaaactttaaacccggagcaaaacaatgttcctcaaatgcaaataggaaaggacagccatgattataacgttttgctcaagcattttcttctttgttcctctaacttaacagaagttgaaacaagtgaaaataggaaatttccatttagaatacaaatcctgtaagtcacagagcaagtcggaaaataataaacaaacaaacaaacacccatgcagaatagtcaggtagtttccagctggcagatgcagaaaccaggagggatgaaattcactggggtcatcgttcagagaactttcaacttgaaaacaaaccactttaaacttacatattcctgggtgaagtctatgaggttttgcaaatcaatgtcatcccgatatgctctgatgttgttgtttataaagaaatacagctggtctttgatccagtctttgaaaacaaatgctagaactccggcagtgagctccaggaagaaaataattcccaggaacacagaaaactaagataaaagacacatacacagagaacagttataagggctattttgatcatatatagctaaatggttcctctctaaacaggtttgtaattacattggattgttacacatctccaaagcagataatcttcagtttctgctgattcattaatagaatattacactccaagaaaggacttttaaaaatcattttataatcacattttagggtctctagtgttccatttgataattaaccaacaaagcccataagcaaacatggataataaggatttctcattagacccacattaaggcctaattaatttctcatgattaatgtactgccagatgcttgtaacaatgacctgcccctatctctagtaagcttctgtaacttgaaagatagattattccaatattttaagatcgcctgtcacttgttactgtggccttgattctctatgcaatatattccttttatggattcagacaccattttaattctcttttgcacctgctatacagggtaaaataacagatgtgttcatcttagatgaaggggtcaaagaggaagtagtggggtgggcagtgaccgcgaaatgaaagttatttcccatcataaaaacaaaatgaaacccctgagttgagggctttcctgggaatgctagctgtgcttgccttcctctaggaagcatgggccccagcaacattttaagtgacatcaaaatgcagccaaggggagacttccgcttaatgtagacaacaggggttttaaaagaggggctcaagaccatgaggcaacgtggtaactgcccgtaactctggagaaattccccttccatctagaagactcagaagagtctcagcttagtcatatcgacttactgctcacgcccactgttttttccacctcctaccatcctgtattcttaaccttctcaaactttgttgttaaaatagattatgagaaatgagctgtgaaggaccagagggtacagtgcgggtaaatttctggtgacaacagcagagagggtgacatgggccacaactgctgggcagaggtcctgaaggccacatgcagaagaacagtgagcagctgaggaggcagggggtgctcaggtggtctgcggttctatcttcagcaagcagacaaggagctgccagccaagagaaaaatgtattggggaggggtgcaaaggaaacagcagttactcattaaaagaacaaaagacaaacaatgtttattcattcagcaaacatctactgaatgacccacaatgagtcaggccctgaggtaggtgggctttgcagaaacaaggatgagtaagaacaaggggtatccttgccttcgaagatgtcccagtcttatgtgattagggaggctaggcagggagtgggtatctgcagacattagatgtctgtagatctggcagtatttgtctagggtgccaagtactgctctgtgagggtgggcacgggaggaggagtggaaggtggaaataagtgtttggcaaagtttttggactcccaggttaaggccccaattctagaccctccagctcagcccttcaggtttccctagagttcctgattatatatccttcaggaattcgccagaaatggaatttaaacagttcttaattatcatcagtgatgccaataatttcaatttaaactttccccaatctagaaaaatgaacagaaaaaatatcacaccacttctgctcaatgcctaccctacagtgtaaataacgccctgccctgtattaggccccaccttaagcatgtaaatatgaattatgaattatcacagtacagaaatgacaaaattatagctagcatgcatgagcatacacaggaaacaccaagtcagggaaagattttaattcagtttttgttctcacctccataaaagttaagtgcattttccagttcccctggtaaattttctcttcatgttacatattatacataccaaaaattgagtccaaattcaattcatataaaatatttggcagatacctacatgccccaagccctgttgagctaatttcctctatttccaaaggtgcagacactgactcacaggcttcaccctagagcctcggtcaaccaagaaggtctatttccattttgcagtatcttagttcctagattttccctcagcaagtctcctaggggaatcagatctttagagctatttggagtcctgtggacgtttacttactacttatctcataccttctgttcgaagattattccaggcaagtttttattgtttgtcctaaatggagagaggccatttaagatattttccaagtcttaaaagccaagaaacaacacaattctcttcatttccaacatgagactttataaattaaggtgctgatttagagaaatgtgtagttttctgcctgttcagttaacactggactcttcaactgtaagaaatgataaactatattaaaggggccaccactataaatgaaactatattaaagtaaatcacaattaaggggactgagcaggtgcagtggctcatgcctgtaatcccagcattctgggaggctgagcaaggtggatcacttgaggtccggagttcaagaccagcctggccaacatggtgaaaccccatctttacttaaaaaaaaaaaatacaattcagaggatcccagccaggtatggtggctcacgcctgtaatcccagcactttgggaggctgaggcgggtggatcacctgaggtcgggagtttgagaccagcctggccaacatggtgaaaccccatctctactaaaaatgaaaaaattagccaggcacggtggtaggctcctgtaatcccagctacccgggaggctgaggcaggagaatcgcttgaatccaggaggcagaggttgcagtgagccgagatcacaccattgcactccagcctgggcaacaagagtgaaactccatctaaaaaaaaaaaaaaaaggatcccacattttggggcatggaggccgaaactgatgaaatagtggcaacagatgagtatgaccaggacccaatcaggctacaggaaagctggcaaggtgagctgagcactggagcactgagatgcctcaagccaagaagactggcaggttggcaggtggcaatcagggacagagctctcctgggggctccccaggtttctgactaggtgaagaatgaagcatttggttgtgtgtgtatgagagagggagggagagagagagagacactgtgtgtgtgtgtgtggcaaaggaaggatctggcagataaggcagatggagtcttaggaaactagctacagccactgtggtcccatgtatccacaagagagaaccagctgcttgtgaacttatctgtaagaccaggtacccctcggttctccttgttagaataagtcatgctaattttcaggttaaatagcctccaaaaacttctccgagacagagctgctcagaaatgggctgccctgggtggggcacaccgtgtaccctcttctcagggatgtttaagaaaagacgctggaggatgatgtggcagaaatgctggggaagagaatcacacattacatgactattgggctacttcttggatatgctttttttttttttttttttttttaatgagaatgtccctggatgatgatgtgtcaacaaaagttgggaataactgtggtaacaggaaatattacactacaactgttctctagaaatctccaccatccccatccttcctcagcaaatgaaggtgggtgctttggatcctttctctgttcttagaaaggggaatggatgcttcgtatagagagctatgattcagacgcccatcagagtgccaagctccatgctgacaggcacatttggctacattcaacaaccctatataagatacataaacggcacatgccattttcttctcctttgaaacgagtctccaacgcaaaggctttcacttttcattctctattttaactttaaataccagtgaaccccctggtgaaacctctcctctacaaacattcactcagacagtgatcacgccaaccgcaccacatctaaaaattacaaaggagaactttgtaccagctaaggacaaagaagctttaccttttactgtttctccatatttagcaaaacctactgcttaacagatttaatctggacaggccacagtcactgtgcttttgcctggtttctccaaaccaacagcctgcacagctccccacttactatgtgcattaaaacggtgggaaggaatcacttagaagaaaatatatatatatacctaccttagtcctaaagatatcttagggaatggaatccaagtctgtgatatatatgcacaaaacctccatggatggcatggtggggtggtgggggtggtgttgtacttattaaggaggcacaactgggaatcagggctagagagctctctcaaaagaaaataatgacctgggccctactttggccagtgcctttggtacagctcactgtcttgcctgtagatagggtgacctcctgatggaaggtaaagttttggctctcaatctgagagtagagagtggaatacttacaaacttgagaaggaaagtgttttcccgtagcgctccaatgcaccctgcaaatcccaaaatgaacatcactcctcccaccacaaggaagagccaaactgggtcaaagccgccgagatcggtgatggaagagatgttggacagaactccctgggagcagaaaagaacacacaacaaggcacggggatgtggggtcagttttccaacatgtaaagattattgcatttgtcctttcccctcccaaagaaaaccttcagagggcatctgattatcaggtatgtgattaatacttaagagaggaaagaaagagagagagaaagagaaagagaaagaaagagtgagaaagaaagagaaagagagagaaagagaaaagagagaaacaaaagggaggaagggaggaagcgaggaagggagggagggggggatggagggaaggagggagggaaactgctttctttccaacatctaaacgtgttcatatttttgggaaaactatatgtagagaaaaaaaaaaaaaaaagaaaagaagagcccaagaaactgtcattagaccctgtaaggagaagacgtggtgttacctttggtttcagtgtctgcaaatataagaggtcttcagtaaaaacaaacaaacaaaaaaagacagatgtataaaaaacacacacaccccctgacccccagagaggggggaggtcatcttctgtaagacccaattcacgcagaagttagacaaatgcctattgcaaagcccttggcatttctcaggaaataggatcgagctagaagctgaaaactaacacagcacccggtccggctacaaacacctacaagttttttttttccaagaaaatatcgtacctcaggatctactcttgagctccatgggagacctttattaggctgagatcccaaaagccttgtgtggtttgctctggtggctgttctgtggcttgctgttggggtatttcttacccccttcgagttgaaatttaaatgatttacaaatcaaaggttacttcctcactttcaactcttattcttcttccacaagaacaccaaacggacctcgagtaatttcacttttccacaaaaaatgacatttctttactgaaatcccctcttcccttatgtgtgataccatattaaataccacccagaacctatgttacaagattattttgaaactgtggatgtgcatgggccttaaacagccaatatcaccaatattttaattttattgaagttgtttggtactctcaaatcaaaatacctccagagaatcacagtatagtttgctgtaaagccttaataataaaaaaaaattgttttcaaagcactcccaataacctgtaagaacaggaagcaatcatctgattttatacttgaggaaaatggaactcagagcagtttggtgatgggctgaaggtgacagacgccatcgcttctttgaaaccagtacacaatgtctatttcagtaccaagcaggggccacacacttgcttcccagtacttcccagtcagcactaaccaacatctgaacttaggagttttaagttttaatccatttaaaggttgtaggtaggaacatttggagaagcgtatttcgtttgttctatttttctgtctgtttcttcctttaggggggtgtcaacttacgaacaataataggatattaagaacagaatgtatatggggaaataaagaactcttataatgtaaaacttaaacctaattttaaaaagtctaaggtttaatgtcacagacaaatggttgaaaggctattaaagcagttaggattgaggttgtattcattaacttctgaggtgacatcaaagaaggcaaccacacccttcacaagtctgcatagaccaaaggtttgatccaattttgtttcttgggtttccaagcagtgaactatgaatatttactccgggggaaaaggttgaaggaaaacagaaatactcaaaccaaattctccacctatacaaatgatgctgagaaaaaacttgccagagaagtcggacaaaatccaagcaacaggctgggtggagtggctcacacctgtaatcccaacactttgggaggctgaagtgggaggatcgcttgaggccaggagtttgagaccagcctgggcagtatagcgagaccctttctctacaaaaataaacttaaaataaaaaatccaagcaacagtgctaaaggcccagggttgttaggaaaccagcctctcctctgacaatgcctttaaccacagatgttagtacctgaagctttcaggttatggaccttctcagccaccggaagagagagaagactttggggatacatgaagacattcttaaaagactttaagcttaattatgggagaagaagacacagctaacttggcaccagaaagaagaggtagcagtagcagaattgacagagagaaatgtcagttccatcataaagaggcatttctaatactgagagacaggactagctggatttcccaggccgaataagaattcctaagcctagctgggaaaggtgaccgcacccacttttaaacatggggcttgtaactactcagctcacacccaaccaatcaggtagtaaataggctcactaaaatacaaattaggctaaagcaggaggtaaagaaattgtcaaatcatatatcgcctgagagcacagggggagggacaatgatcgagatataaactcaggcattcaagcagggagtgggcaacccctttgggtcccctcccgttgtatgggagctctgttttcactctattaaatcttgcaaactgcacactctctggtctgtgtttgttctggttcgaactgagctttcactcgccgtccaccactgctgattgccgtcgttgtagaagccaccactgacttccacccctccggatccggcagggtatccgctgtgctcctgatccagcgaggtgcccactgccactcctaatcgggctagaggctcgccattgttcctgcacggtctaagtgcccagggttcatcctaatcgagctggatagagctataacactcaccgcatgcatggcccaagattccattccttggaatccgtgaggccaagaaccccaggtcagagaacaagaggcttgccgccaccttggaagcggcccgccaccatcttgggagctctaagaacaaggacccccggtaacaataccaccaagtctgttcaatgaaccaaagaaggctgccctgagaaatacgggattccccaacagggttgctgatgctgtgaacctttgtcaacagcattctaggaaagattcccaaagtggatgggaaattaggccttaatgacctttaggattcctttcaactttgagaccgttctatgatttcatccatttttaatgggctttttagttgcggctcacaagtctgaacaaagatcagattgctcccaaacccttgcccatgatccatggttgtacataaagagctcagtgggtaacaaagacgatgatctgagcaactcagcaaagcaagcaacaagctagcaaacatacctatgcccgaaatagcaaaataatccctcccccaaagacaaagaagtatgatcccaactgtcaggagattcctagatcatctgcactctctgggtttaatttggaggataaaaattggcttctcagacaaactcattttaatacttactctctccagccttcagaggcagttttaattgagagccttcaactgtttccacggaaacaacaatcattggggggctgagctggactgcagattctacttatttaatcctaaattctggcaaagatagagctgcaaacagatactacagcgtgctggggggaactaatctcccacaaagcataggaaagactaccaagaactttatttttaatggattcagaatatacccacgtagttatcagttgaaaactaactcaaatcttttttttcctgggtgaaaagaatatatcctttatctacttatttaaaattattttaaaattttaaaaaactgaaatggacataaaattgtatgtattggcccggcttgatggctcacgcctgtaatcccagcactttgggaggccgaggcgggcagatcacgaggtcaggaaatcgagaccatcctggctaacatggtgaaaccccccgtctctactaaaaatgcaaaaaattagccgggcgtggcagcacgcgcctgtagttccagcaactcgggaggctgaggcagaagaatggcgtgaacccgggaggcggagcttgcagtgagccgatatcgcaccactgcactccagcctgggtgacaaagcgagactctgcctcagaaaaaaaaaaaattgtatgtattgtacatgtccatgttttgaggtgcgtgtatatataaatagtggaatgactaaatctggctagttagcatgtgcattacctcacatagttatcatttttgtggtgagaacactttacatccactcggcatttttcaagaatatattattagccatcatcactacctcaaatcttgaaacacaagaagtgaatgtggaagtcaatgcccaatggccagtatttttccccttgggattagggaaaattagggattacttacctagcaggagaaaaaaaacagacttattctttcatctgtgcacaatttcccaacattcactgaagagcagcagttttattgcttttgactacacagagggattgggaggccaaggcggacagatcatgaggtcaagaaatcgagaccatcctggccaacacagtgaaacccagtctcaactaaaaatacacaaatgagctgcacgtggtggtacctgcctgtaatcccagctactcgagaggctgaggcaggagaatcgcttgaacccaggaggcagaggttgcagtgagctgagattgagccactgcactccagcctggtgacagagcaagactctgtctaaaaaaaaaaaaaaaggtgggggggaacataatcctgacaacagtgatttggattacaaaaatgatagggagttgactgttcagtcttctgttgtcctaaagatggggtctctttctggactttttaatttcattcagctcaatttgacagatgagtaagaagtgctagtatatgcctgctgaagagtaattataattaaaccttgtagttgacaagaagctgtaagaaaaaaaatctaagattacagttaagtctgccaagcaatttaaaacaggcaccagattcacagtaaatccttaggaatgtgcaagaacaccaccagcagacacctagtcttctgggaacctgaggcccccgcctcttctgggaacagcaccacctcctccttgtaaggatgccttcgcccctcctttcactccatgacccctcagagctgccaagatctcatacaatcctgctggcctggtgagggctgagaagcctggattcccttcctaaagtgccaggatttagaacaggcacctttctctagtggctgagactctaaaatgccaaactccagagccttgtgaagcatgtcatatttcctaccaagtggagaaagtcagacagcagtgagaagcagaaaaccgcgctcaagaagaaacaaagaacaagagtagggagggaaaatccagacagcattataaatccccagtccagtggttcctgaggcctgccctagagctctatgtgtcactccaggagccttagatacactcccttgattgcttatgctggttctctttgggtcttcatttgcatctgcgaagtcctgcacaacacaaaagctttgaatacactatgcttcagtcctccatgcacgtaaacgcacacacagacatgcacatagacacacagacacacgcacgtggtcgaagctgggaaaaaatgtgggtatagggagcaaagggatgtgccaggttttaaatggtcattttccccagctggctgatatttcaagtcaacgtagtaattaagccggtgtaaacagtctcattcatgttaactcactatgaattcagcatcatcaatgaaatgagcagttctgtggaactcttatggaacttttaggtgatttgtctatgttactgacaaataatgcataacatggtttaacctccaattctgcatgtaaacttgaatgttcagcccttgagtttaaataccaacttttaaaacctcaaacacggaaaaaaatcaatacattgggaggccgaggtagggggattgcctgaagccagaagttgagaccagcctgggcaataaaacaagaccccatctctagaaaaaatttaaacataagtcaggtacactggtgtgtgcctgtagtcctagctacttgggaggctgaggcagaaagatcacttgagcccacgagttggaggctgcagtgagccatgatcacatcactgcactccagcctgggcaacagagtgaaatcacatctcaaaaagtaataaaacataaataagtaaataaatacaaaatgttatttgactactctcttctgtacctgtttatgccagaagtgcacacacagagcttggcatctatattccataggaagttctcatccttctcctacctgaatcctacaagcatagcaagccctgggggctaaagatgtcaagggtactagacttcgcagataacatcagaaaatatcccatgaagctgaacctaactggaacaaggataaatgagtgagaagcagagtaacgggccacacacagttatttccatccgttttagttgacatatgaaagtgagattctgaacagtagtagcagaaacagaaagattcagaatgagagagagccagagaccaagactgcaggtgatgagaaaaatatattcaagatgatcgattcagaatgctatgtgggaagaattcctctacatatatcttattaatacattaaaattttattagtaagaactgatataaatgaatatattcataagaattcttcgtatgcagactatatgctatgtcaatattcttcttaggatccttaatcttctcttctcctgcctctgaggtctacagctgttgttgcagcaggcagcagaggcaaaaaacaaattgaccataacataaagtgctgctataaagacaaaatgaatagcagtcaatttaaaaagttgaaagaaaaaaatatattcaacaaattggccattctgcaaattagcttttggacaactaactctggcatatccacttgaagcctttaagagatgattctgcaataggagatttccattatccactaggtaccagacagcatctctcataacttagcaaagagaccagtatatgtctaagaagaaataagacacattagtggtccatgtctgaggcaataggattgtaacagaagtttagagagccaacaagcaacaatgtatccatttgcacccatcgtggtacaagggagactctgatattccagccacttagactagcctgctctagagtggggcagagagagcattccagaatcaacctcctcctgaacaaaccatcctgaactgtacttaagccaatgaggctcacctccaatatcccctgggatccaagtaaatccaaaactcagaaagtggggtagcctggacaatgggggagacagacaaacagacagacactaatacagactagcttgtcttgaatcccaatgctaagccaaattgaggcttaggcagatgaagtaacctgcctaagatcgcacttactacctgtgtcatcttaggcagattacctcatctgcctaagcctcaatttctgtatctgtgaaaatggtactctatgtcctaaggttattatgaggatgatggaaacaatccaagtaaatccaaacacgatgtgaagtgcttcgaatataataagaattaaataaaagtatattgccataatcactgttatcactattatattaataatataattattagaacaagaagaagacaccagacactgtagaggcacccaggaggagtgtctaacccaactgcactggagaagaaactgttttgctctgggtacttgccctgcctgaccccctctaaggaaagccatggccacagttgatgatcatgcctaacagaggtgacagtcactaacttgttaataagatcttcttttggggggaattggaaataatctaagacatggagagaaaaggcagaagagggaggccatgaggaagctgaagccaggagtaggcagaagccatgagtggtggaagcttagggtactgagaagtggtgcagcagagaagaaagcagggaggagtcagtgactgcggtaagacagcagtggtgctgccacgatggtggcacatggaaccaggagcaaggatacctctgttgctggggtgctgactggcacactggttgtcagtcaccactctggagtgaccttccagtggctgaactatgttctatccccgttagatctggctgttcagtggtttgatgaacacagtatgtctcagtaagaatgtgaaaaaccagccaaccggccaggcgcagtggctcatgcctgtaatcccagcactctgggaggccgaggcgggtggatcaagaggtcaggagatcgagaccatcctggctaacgtggtgaaatcctgtctctactaaaaatacaaaaaattagccaggtgtggtggtgggagtagtcccagctactcgggaggctgaggcaggagaatggcatgaacccgggaggcggaccttgcccacgccagtgagctgagactgcgaaactgcactacagcccgggagacagagagagcctccgtctcaaaaaaaaaaaaaaaaaaaaggacaaaccagctaaccttccctctcctcattagtgccttattcattcagctgtctctggaatttaagcagcttcttccccatgcttctgcaataaaggaatatgttctgagtaactatttcttcttgaaagaggtttctatgcacatgcagaaacgaaaaggcaaacaaaactccagaagggttccacaccaataaacttcaggagtgtctgtgtttttttttttcatcaccagcacagaggagcctctgtgtgccacctggcaagcttcttctcgcaacccacacagaaaagaaatacaaaaatagcattaataaaccccaaggtctgggactcttctgcttttgcatatacaagcacattccttccaactgctggataagaaagagagagagacaggcctatgaaatgtgtacccaaagctgggccagatggacccctttgagatttatgagactagctcttgattcaccaacccctccataaaccagatcctactgacaacagttttcctagagtaagagatagagaaggatttccctagtgagaaagggtaacgaggaatgacatttcaaagaaaatacagctactcagcgaggggtgatcctggagagttagaaatgtggttctaaacagtatgcacagtaagaacaaatagagaccacagggccacagaggaacctgcccctataaaaacttgtcaaagatgctccgccactctgtaaaactccaaacatccatctatctaaggaactgctgcagaggccagagtgacgactaggaatgagaagaaagcctgtcaggccctgaacagtccagggagatgtaagggagcaagagcagcttagttcatgcctggcaaagagatacaaggataaaagacgactagctgcttcaaaggtgcatggctccttcccattttttcttgtcaaaaaaggtcattagtgaaactcaagtaatcctttttttgcagattaaaaagtggccatgacctgcctttgaggagaagaggagaaggaggggtagtcatcttttaggtctccatacaatcctgcaatcaagtagctgctggggaggccagcggtaccaagttccatcaggtggcactgctcacaggcagggaaactaccatctctacacactctggtgagagccactgccccatcagcgtggaaacagccacatgcaaaagcgcagcctttcagaaatcacccatgttctcagccattcccagatattttcatttacattcagaagacgggagacatacctagaaacattccagcctaggtgtaaagtttaagctgaaagatttaatagaggttctggtatggactaaatgttcgtgactcccccaaattcacattctgataccctaagcccccgtgtggtagtattttgaggtggggcctttgggaggtaattaggtttggaagatgtcatgagggtgggacccccatgatgggattagtgtctttataagaaaaggaagaggctgggcacagtggctcacacctgtaatcccagcactttgggagactgaggcgggcagatcatgaggtcaggagtttgagaccagcctggccaacacagtgaaaccccgtctctactaaaaatacaaaaatcagccaggcgtgcgccttgtagtcccagctactcggaaggctgagcaggagaactgcttgaatccaggaggcggaggttgcagtgagccgagatcgtgccactgcactccagcttgggtgacacagagagactccatctcaaaaaaaaaaaaaaaaaaagaaaaggaagagaccagggccctccctctctcactctgccatgccagcacacagcaaaaaggcggctgcaaaccgagggccctcgccaggaactgaatctgtcaccaccttgatcttggacttcccagcctggcgaactgtgagagagaaatgtttgttatttaagccacccagtctatagtattttgttacagcagcctgagctaaaacaggctctgatcatggtgcccctaaactcaagtgaaaaaaggtgaagtctggactagcggcaggtgaccctctattctgggacctcaaaaatatgagactcgttcatttattgagcaaatactttcatgaggatcacctgtgagttgccaggtattatgtcagtcaagggttatttctagcaaaacatccagtgacaccctcaggagctgagtctagaggggagacggttaagaacagagtgcatggagcagaggcacaagcagtgggtgttatgggggtgcatggggaggggcagaaggtcccatcagtaagagtgcagacaaagcgacaggatctggcccagtggggcctctatgtgacaagcggtgagaagagatgaagaggctggttgggcgaggctgggtttgtatctgagggcatttggagcagaggaagctccaggccatttctgaatttagaagcccgctcaggtggcagtcacgtgctgtggaagcagctagcaggctctggggtgatccgggtgagatctgctgaaggcctgaataaaagcagcaccaaaagaactacacttctcagcagtgactccagccaggcactgggctacctggactacttcaccctcaccagaaaccagccaggcaggcactcttacccatgtgaggagacagacacagagaggaactaacatgcccaggtagcccaggtcaggaagtgacagagcagggttctgagcctgggccgcctgacccaagagcagggttcacaccactccctgtgatctattgctggaagttggggtagcagctggcaggaggattcttatttccaacgtaacatcatacatatgtttctaaaattttaagaaaaatatacacaatatgttataacattcttgcctctgatttcactgatcactatctgaaaaccaaagtgagtaggagacaagacctcccaaccacaccccacctccaccaccgccgacaaaggacatctttcttttgtgcgcctcggtgaaatctggcagggacaaaaggggtcagaggaggactgagaggcaaggtttctctggagaaagcagttgctgtgctgtgacaccactgcccagggcctgggggtggagtgtggatagcctctttctcaccctaaaccttaggaggagttccaagggcacctcccgggagctctgaagtggttctctgcacttgacccgcacagccattagggcccgactctgcctaggaaggggctgtgggctgcctcctgcccttgcaacctagagagagaagggccggctggctgctctggtatcagaagtaggtgaggacaggcaatgggctgttctgggggcactgacctcgctcccagatgagtatgtcctggagaaaacacggggacagcacggaagaggtggcctgaggtcatcctggacgctgtcagatagggctgcctgcaggcgtgtgaagaagtgacctcagagggcagagctcagaggtgcactggctgaggaaggtggccagggatgagcagggctgccaggtggtcacctggaattgagatggctaccaagctcaaggaaatcactaggcacagggactcagcaggggagcttcacaaagaccaggatattctcctctttaacttccaccaggcccagagagcacagcccaccccagcttctgcccgggcaggcggtgggcagaggcatctgggcagggccaggggccagaaggaggatgcagagggcaagggcccatgttcccttccctcctcaggggccaaggctgatgggctcggcagggagaacattttaatgcaaagttaggtttgcagttttattatccagccctgtctaatcactgggcctggatctgtgcctcaaagtgagagaaggactgtgatatctgagagtgaacaacaaagtcattgaatttttgacccaactaaattttcatccctaagaaaccccactgaatacagtttaaaggggaatacatagagaaacattaaattttcttcccatatacttcatgtgtgtgtgaaacattactgattagagcacatcagatcacatagcttccaggtactgaccatgagctgtttggtttccagctctttttttttttttttttttttgagatggagtctcactctgctgcccaggctggagtgcagtggcgtgatctgggctcactgcaagctccgcctcctgggttcataccattctcctgcctcagcctcccaagtagctgggactacaggcgcctgccaccatgcctggctgattttttgtatttttagtagagatggggtttcaccgtgttagccagcatggtttcgatctcctgacctcgtgatctgctcgcctcggcctcccaaagtgctgggattacaggtgtgagccaccgcgcccggccggtttccagctctttagatacaacagagaacttgagggaatcattgggataattgaggaaaagaatcacaatctactttcagtcaataaaaccaagtcttcatagaagtattttcagcatctcagtaatgtctccttaaagaagtttcaatgttaagaaatctatttttttctgctcaagtcatctgagtaaccattttcctctattgcctccctcaggcaacagaaactggcctgtactgctatgacattcctgaatcaatgaatctcactgaattttccttcctcggcaaatagggaaaggttttccaaggtgagtctcctgtataattgtgacaggaagaactggagtgttctgcattgagacctaaaatcacagacagtgggctgggaaaaaccctccaggaaaaagaaacatcatctacagcaaagccaaggagaaaagcaatatgggggctagagctcctctaattcccccttctccctactgggatcagcactgggcaccagttctttccttccaatcacccctagagaacccagcgtagtgagtgcaatggaggatgacaggggactggccagaggactgggagggagagggccagacttccagtttgacatctctgtgccttggtttccccacctatgaaatagaatgtcattctcttaaagttaacttgaggggatccagaagtcagggaagtgcaaatgcaactcctttataaaaagtggtatttttttcctgtgtagcattttacaacgtgtaaagctctttttgcatgttctcattggcttagtcacaaacagcttctgggcatccattgtgtaggaggcattgtggtaggaactgagaataaagggcaaagacaggctcctgtcctcaaggagtttccaggccagacaagccaggagtaggtatccactctgcttagtgggctaggtgctgtattagggaggcaggggcagaatgggaacattcaattcacactaaggaccagggaaaggcattttccctcctctgaaaagctgagtcctccctcgccccaatacctttatttctaattgtgagtgatcactctccctcttgctcccacttaagaactaagtaataagcataagagttgagcaaaacggaaaaggaatggcatccctaatttttccatgaaatgagataatcatatatagatttccacttttacgagagaagtaattttcttcttttctgatatagacaatatatatattttgtttctaaccccgtattattctcaaatcagacttcagaaaccacacgtatttacctccttttattctgtaagaatcgctaatatagtatgcttactggagatgtgaggcaagtactgacttctataactccatgacatagccagtgttttaaagaatgctgtcattgctcatttgctcattcattctttcataagcaatacctcttgaatacttgctatgtgccatctaacattctaggtactagagtgtggtaataaataaaaagtccaggcaataaacttgttagcgtctaagtgatgagtcgcatgagaaggaaaaacacaaggaaggggaagaaagggctaggtcaaaggtgacatttgagaagaaaccaggaagtagaagatagcactcatgtggttttctggggaagagcatgccagtcaggggcaagtgcaaaggccctggggttgtgggggtatgtttgggatgcgggaggaatagcaagttgataagtaggaccataggacacagtgaggaagcacacagtatgaaagcaaatgtcacacaggccatgggcaccatatatggctttgagtgagaagataagctcactggagggctagaagcagagaagtaaaaggatctgtcttacatttccaaaggatcactccagctgctgcacagagacagccctagggtgagggtcagggtgcaagagcagaggcagggagataattggaggcttctgcacaaatgcaggcaagatgtggtggccacttagaacagggtataacagcggaggtggtggaagaaatcggattttcaatatagtttcaaagtagagctgacagtatttgctgatgggctgaatatggtatgaggagaaaagaaagcagagtgtcaggaatgagcaagtagaagagtggagttgtttctttaccgcaattgggaagagcaggttgggagggcatgagaatcacttgtgttgttttgaatgtgttaagtttcagaagcctaccaggcatttcagtgtggatgctggctatgcaagtctagaattcagatgaggttggaagcaaaaatattcatttggaagtcatcagtgacagatggcatgtaaagccccaagtctagatgagatttcttaagacgagtcaaagctcagactgagccttgggcactccaaaatttagaggtcagggaaatgaggtggaactagcaaacacatgtgagaaggcaccacctgtgaggtatggaaaccaggagagtgtgatatcctggaagccaagtgaggaaaacgtttctcgaattgaggagtgatgtattatgccttagtccttgctttgctgataaaggttcccaagtacctggatgagaaaatgatgtgcttcaggacccagcatgggttcaataagaaagtgctaggttcagttaagtgcctaggccagttaaccagtgaaaaagtgaaagataccatctatctacaaagacaagatgcagaaatatagtctgatgtaatgacaagtagatggatgagaaactccttgactgatgacacccaagggcacacataagtgaatgagtgtcaaccccaaaggaaatttctagtgacatgtcattgggctctgtccttggcctgctcaacagcatgtcactggcttttatcaatgataactaaacttgactgcagtcacaacaatctagtaggcctgttaaaatagagcatcgcagtgtctatcctggacctactgaatcagaattttcccaggtggcatggtggggcaaaaggacagtctgccttagcagaaggaatagagggaggaggttgatcaaaatgtatagctgaaatcaagctgggcggaatggggaagatgctagatagaggctctggagtgatctcagcaggtggacaggtgggctgaaatatcactgtgtcattgtggaatcctgcaactgcctatgaaaatcagccataggtgaggtggatggggtaaccagttgggtctgcaacctacttgggactctcagtgagctgcagacaccgtgatctacagtggatcccaagctagattgatgaggggagaaaggacgcaatccagccacactctctacagcccctaaagcttcctctccatggtgcagaaaagacaccagagcggggccagatgagcaccaacaaaatggacaaggggctccagcccacatcctgtgaggaccacctagagagaagcagatgtttagcctggaaactcagaaggaaccaggccctcaccctgacatacctcccgggctaacatgtggaaagacttattctgtgggatccaacagggtagatccagaatcaatgagtgaaaactagtgggacatgattctaattcggtggaatgaaggtctttccaacaggaagggcaacctaaagagacagaaatgctgagcactttgctgtgggaaccattaaacatatatacacccctaagtagcatttattgcagtgtattattttaggtatatgcacacacccttcctacaactggataaactccatgaagactgaaactaggtcacttcatccacatttccctagaattcagcacaagccctgcccatgctatgtgctcaataaatgttatctgaatgaatgagttgactgtcactggatgttgtcaagggtgttgtggaggtgattcatgtcacataattgttaatgttccttccaaacagcagatcctatgatctctgaacaattgcacataaatcagcttcccttggagacactcatcctttgcatttttacagttgatttaaaactcagacaaaatgaattctttaaattattatgtctaatgttgaactgcaatattagccctaggtttaaaactcagactgatattaagtatggggtaatcatttttgctttcaatgcttctgtacttcacatgaatatgctgaaagtcctatctgctaagaaaatgtgtttcttccagtggaaatctcatccttccagctatgatccagtttggggatttaccctccaggcctcttacaagtaaatgtcgccacatctgggtctaggggatgtactgattcatgggctgatggtgtcagctcagcaggtgcagtgttcaccacactgtctaccaggctggggttcaccttgaaaacttactccagcagaggcctggccgaactcagaaattaacccaaagggctttgagagagcagtctctgcagttaccaaggagatcaacacacttcacatcctcctcaagagaccacaaaacaaacccaattctctggtccatggattggagcctgaaactctcctaaaatttgaggctgcctttcaaaactacctttgtgctcttgccccatattaagagtggacagcctatggtcatgtgtccaggggagggagccatgtctccagtgggcatctgccttagagcagacactgtgctgagggaggtctcatttaatcttcacaacaattctataaggtgagaacagtatacctattgccaaacaaggaaatggcatctcagagaagttaactcagttggccaacatcacacagatgagatgtgtgtattccacacatgtcaaatactggaggagccagtatttgaactcaggtctgtttacccctgtcttagtcggctgtataacactgatcataaactgggtgacttaaacaacaaacatctacttctcatagttctggatgctgggaagtccatgatcaaggcgccaagatttggtgtccagtgagggctttcttcctggctatgtccttacctggcagacagagaaataatctctcttgtctcttctgttatcagaagggcattaataaccctattcatgatggctctgccctcatgacctaattacctccccgccaaagcttcacctccaaatatcattacattggggatgagggcctcagcatatgaatttggcagggtggggagacacaaatattcagtccatagcaaagccacaaagctgtgctcttttcccacccagcaaccagagtgatcttaaaaaaaaagtcatattagacttttcaaaatgctccagtggcttccccttgtacctagaatatatccaaacttcttgcaggactctgcccagtctggcctctacctggcaacacaacccacctcttcttgtccttgctttctcccttctaggcctactggccttcttgttgttccctggagtcaccaaagtccctgcctcagggccactgcacttgctcttccctcttcctagaatgttcttcccccataccctgcagatccttcttccttcatccaggtctctgctcccatgccacctccttagagaggctgttggcaactacttcatctaaaagagactccttttcccaccactctctaacttgatgtttcctgccagaacttaccagtatctggacaaacatacttgggcagtaactgcttctcattggtgacccaccagaatgcaagctccatgaggcatggactctgcatccctcattgtcgtattccccacactcaggccccagacacatggccagcactcaccaaactgggctggtgcacggctaacacccgcttcaccctctgctgcctctatttgttccctgcttatggagttctgctacatggagctgggtgaccttggccaggttaacttcggatctcaagagaaatcttgatggtggcccttacaaaaaaggaactgctatttcatccctccctaaagaccgcatcaaccccttgctctgatatttgtatgacactgccagttttagaagtttgtgattttatcagagaagagacatttgaggcaactgatgaaacaaaaagataattatatttcataaagagaaaattaaaaaacttcaaaattaccaactgctgtttattgctagaacagataattagttcatttaatgccttccagcattttttcaaagcagatagaaatggactcttattaaaggagttataaaaagctgtgttatctggcatctaaccaacttcccagattccacaaatttccaagttcacaataggcttgaggcaaaagttaaccataatccaagacaagatcaaccgatattcaatgtaaaagtttctagagatgaaattatctctgttttgggaacttaatttgtctcccctcatacataatcactgccctgcctcaaaactccaggtagcctcagttactcttgttgctaaaaagtagtttgttttccataaaacattttacattctgtagaagaattttgtaaataaatacaggatggttcatttgcaaaactcaggatttgctttgagttttgttttatatggtctgtctgaacattgttttagttgtggaaatgcctactggcctctgaggggcttttgttgactggaccttcccagtttttctctcctttcttaatgcatttaccacttcaaaggaactctcagcttcaggccagggtcaggctagagggtgaaacacctacgggatcaaagaatggtcttctgggaaattttaagctagattttagtttatggcagcttttaaccattctatacatccccttgtccttacgtgggagataataaagcttttgtgtatagccagatacaaggatagatgaaatgctgcaggtgatttcacttgcaaagaaggaaggaaaaaagctgggaggagggggcgggtgtttatattcactgttgaattccactggtggcctcagtagggggagctgtagagaaaaattagaaggtgcgatgggaaggagaggtgtggacacagggggtgtctgcatgagtgcgttgcttagagcagaaactgcccagaacattgtatcttcactgtcacatagattactctgtatttccagattttccttttattatactgtatttgatcataaactgaatatttcttaatacttgccaccagcagccaaacattcccattatttacattaatgatgagtgtatttgatactcaaacatgaagttatatcccacttccttcaatccacatgctaatagttgtttaccacataacacactaaaaaaaatcgtttttatcttgagttatcttccaaagagttgaagaaaaaaagcagaagagaaaaaaaggctacaggtggtttagtgatatttataatcattactggaattcttgtgcctgagtgagaaaatatcccataggaacatcgatctttggctaactgatcaaattccaaggtatattctctgttgagcacgtgtattgttacttcagtaattattttgatgcagtcatcaatttaggcacaattcctaaagtgtctttgagagtatgacattaatcttccaccaacactttttcttgttaaagagccatgtttatactctgtggttgtcaaagagaaagggggataatacataatatgatgtgcagcctctaacaaccacgatgtgtgcattgtcatgatattcaacttactttttcattccatgcccacagtccaattccaagaaatgttattcccaaaaactgaaaaagaaagaaagcagtgtaaatataagggaaaatgccgctaatataaagaagaaacttttcaatcaattcttttgtcactttacctggctgggaaatagcttttcctaaagtgtgagcacttatctttaccaggaaaataaataccataatccccctacttaaaatttttacagcattaagaagggctggagacacacagttggttagaagtcattcagattatgaagagtaataattaggtagaatcctgagtacactgaaattatcaataacatttaatatgctgccttttagggtaggggaggaaacggattccccatggatctgaggcctgtggtcactagaaaatggataagcagaggcattaacttagaggaactgggatcttctcttcagtattgagccattacaaatgggccaggtcagcgaggggcatgtagagccttggatgtccctctttgatcatgccttccaaaggtaacaagaatcttatcaatgtaacccaaagaaaattcctaagttctgttttcagaaacttcgattgtgtaaattttagttcagaggacctcccaccacccttcttggttttgactcagttccacaacttcatgcatacacagagtatacaacacatgggactgagttacgcattcagccctaaggcagaggcacatctcatacatacccacaaatctcaccgttctgtcaattagctgtgttgaggactgggggaatgccaggagaggaacaggtgataaccaggagggctttccattttactgtttttcttttttttttttttttttttgagatggggttttactctctcacacaggctggagtgcagtggctcaatcacagttcactgcagcctcaactacccaggcttaaccgagcctcctgcctcagccttccaagtagctgggaccataggcgcatgccaccatgcctggctaatttttcaattatttgtagagacaaggcctcactatattgcccaggctagtctcacactactgggctcaagcaatcctcccgcctcggcctctcaaaatgctgagattataggtgtgagccaccactcccggactagggctttccattttaattaattctcactgtattccatctgctataagatacatatattttccccacatttgaacacatctgaaattgggatgtatcttaaaatccatggtatctcataattttttcccccttgatatagaaaacaatggagtgttttgtaactggggcgacacagacttgatgacacattgtacagagctgtccacccactaaaaatccaatgatcaggactgtgtgtaattggccatgagtaaagatatgcttcatctttattatcaatagcaactctcaatttcctttccaaacactgaaaagagacaagaagtttcagtgtgatggcagcacaccgtttattttactaacatcttgattaagttaatgtgaggaaagtggtccactgagaggggtatgcagagaaaaaaatgagtgagagtggttattttttacagttccagggaaatccgagacctgcccactgggcaagggcttcactgttctcagcagggagttcctgatactttgtaagcaatcactaataaatccaaacgggacttggacagatggcaggagcagaaagaaaaggggactgacaaaagacaattagctgctccgaaaacatagtggtgtttttaaaaagcagaccttcccgaagctctcgacactcatctgacattgaagcaagacaacacacaatacattctgagccctatacagaaaatcatgtccttgatttggcaagaactgaagacccctttcttcctaccccttgctcttataggggactccttggaaagtgttcagaaagatttctcgttttactatcccaactgaaaaaccgtgctcagccctggtcagagagctatttcattttacatttcagatccaaaacaagtgaatctccaaaagactcaaaggtacttaggactctgtagcacaaaagtaaaacaattcagcatgttactctcatatttataggtgctgggcaaaagagaacgaccactgacaagtgagtgtacaggctcccatgagacctaggaagcacagaagcacagagttaaggctttgacttcaacccattgacatcaaacacaacccagtgaaatggctgactttccaatgctgaagctcctcatggacaaatgtttggttattttccctgacgcagtattcactgtccctcctgctgctgatggtgtggacatgttcctgccgaaggcctctgcttgatcgctaagatttgtttttattactttccaggcatcatgcttagtgctttgtgtgcaatgtctctttaaagcttcacaacaattttactctgaaataggcgctcttattatcccctttttaggaaagaggaaaatgaggtttagagagtttaaataacttgctcagaggcacatagcttctaagcagaggagcagagacttgaacaagagaaatacatgttcttagcagtcctgataaattcccctttgctcccatgatataaaaagttgaggcattcaggctggaattacatggtacatgatcagcatatcatatattcctcccccagcaagcaaaggggtgtggaaaaggtaaagagagataaaaaccttgccttcacataagaactggctgtggaacagaaattccccactttggtgtccacaatggagttaagcaaaagaacagagaaattcaatggtgggtccacattctcctttttaaataaagttttcgtctctcctcttggcactttgagacaacttttttcattcacgagccatataaatagcttggaaaccaatggttttccataaagaggagagagaaaaaaagtagggatttaaagaagactcacagacaatttcctttataatcttgctcccatatttcctgctttgactgtgactttccaaacaagggtttaagaactgggaaagaacacaatttgaagttaagggaaacactcaatacctaagcaagcaagtggtgcaagcctgggcctcaacttgatacataccttcagtgctacatcactagcaaatgtcctcccaattattctcagaccatatgttttgttttaaaatcaagttgttccagttcccaataattaaacagagaagagccaaaaaacagagacaggcatgcaatacttgaggcacattcagtttccccttcccacctcccaaagaaaagacaaccataaaccacgaaactgacctcattctgaaacccagggaggcccacttgcaggaaatagctgagaagtcttaaagtcaaccctttactcttttgaaatggaaaaaaatatatctgaggcatcttatctgaggcatcttcccacatggcaatatatgcaaatgtacagtacaaatgtttgtcaacccaaattttgatgttttaaaataaataacaataattttgccggcatttgttgaatgctaagtatggctaaactacagccacgtgttgcttaataaagggaatacgttctgagaaatgtgtagtcatgcaaacatcatagtgtacttacacaagcctagatggtacagcctatgacgcacctaggctatatggtatagcctattgctcctaggctacaaacctatactgcatgtcactgtactgaatactgtaggcaactgtaatacaatggtaagtatctggcatccaaacgtatctaaacatagaaaaggcatagtaaaaacacaatataataatcttatgggaccaccattgtatatgcagttggctgttaactgaaacatcattatatggcacatgactactgtttcaaactgagctgcactggtaagtgtaaagtgcaggctgaattttgaaaacttaatatgaataaaaggaatgtaaaatatctcattaatatttattatcgattacatcttgacgtgataacattttggatatactgggtcaaatatttaaattaatttcatttcactttttaaagatagctatggaaaacgtaaactacataggtggtttgcattatatttttatagaataatgttggtacaaagtatcccataacaatatcccaggcactagatattgttttaatccccattttatagataaggaaactgaggcttagaaattttaaggccaggtgcaggggttcacacctgtaatcccagcactttgggaggccaaggtgggcggatcatgaggtcaagagatcgagaccatcctggccaacatggtaaaaccccgtctctactaaaaatacaaaaattagctggacgtggtggtgcacacctgtagtcccagctacttgggaggctgaggcaggagaatcgcttgaacctgggaggcggaggttgcagtgagctgagatcgcgccactgcactacagcctggcgacagagcaagactccgtctcaaacaaaaaagaaaaaaaaaagaaattttaagtattcctcccaagatcataaaggtgcctgagctacattgctcagaaaatctgaatccttagcccaagaccaaaactattatactttcctaatatgcacagaatgtttgtccacagagcaagctcagggacggagaactgtaatgaaactcatgccctaagtctctaaattactcttttaatttctaggcatcaaaggtatgttttcccacctaggaatgagaacagccctcaggcaggctgatggaagccttcaggcatagcagaaggacagccggcagagctgacccttgggaacagctggagaagaaaatggccccagcatgtgatgagggcgattagttacctctggagggacacatctgccccacttttctctgaattctacaaaaggaagatcctttcctccctatctggtggttttcttccttgctgaacctccaacattttgaaattggtacagtgccttattctaactggtataaaaatggatacttcaagaggccattcatccattcatttataatctgcaacaaatattcttgagttcctattttgtactagacactacttttctcttgggataaatgaaggtaagaaaacagaaacagttcctgcctccaatgagcatacagtccagtaagagagagagagagtcctcaaataaagagtaaaacgtaaaatcattcctaatggtgctacaaaggagaaacaaataaggccaaagaaactataacagggggatttgacctggaggggcatctgaaggtttccctgagtgagaaatgcgtacatgtagtccaaaggatgagaaggagttaatgagcaaagaaaggaggaagagtgtttcaggcagagcagaatgtacaaagtcccagtagagagagaagcatgacaagtaaacaggtctaaaaggcaattgctgtggctggtgcacagagaatgggggaagtggggaaggtacagcaggtttgcaattagagacacgagcatggaccagcccatgcaggccttgtagcccaccttaaggaatccagtcattctcctacaagtgccaggaagccatttaaaggccagctatgtgtggtgagcaggggtggggtaggcaggcaggtctttgcagatctgggctttggaaaaatgaggatctgggccgcagaaaagattagagtctgagtgcatctacagtgatcaaaaggaggtgactttggtaatacaggcaagatgtgatcatgtcctgggctgaaatacggtgaaacggtcggaattgagagctactgagaagtaaaactgacattttcagtgggggtgggaggaaggggaaggaaaaggaagtgttaaggataatgcctacatttctggcatcttctacagagactatggctcttcaaaattccaaagacttacatcccctctgacagaagttattctcaggtgccaatttcataactagcttgatctagtggcacttctgaaggacagttttcttttctgtgtattttggctgctatctgaattctctttgaaataaatttcggtttgtatacttttaaaaaataaattatttaaaaatatacatatatttccaacacccctgctacttttattcataaaaagcaaatagatagatagatagatagatagatagatagatagatagatagatagtatatatcaagttcctagacaattcttaaattgacactttcaatcctctttgcttaaaaacatagcaattacattgatggcatctgcccaggatcctgtgaacagactcaaaataacagcacacaaggtaaatatgatagaggaaaataaagatcaagtcaatcttcttacctaaattggagtcacaaaaatatcatcctaaataacaatgaatggaaaaaaacccaacattctgatgaagtctttaagaaaatgttaatccctgcctgaataaacaggagaaatgcatttaaaaatttagcatagaagggaggcaaggggagaagtgccattaggaaagttgtattttcctgaagctgcagcacctgtactctgtattatatattttctgacactttagtctgaacaacactcgttttagcagggtccacacaaatgtgctaaatacttataataacaaaataaatgtctttatagaggagggacttatttcaggaataaaaaaacctctggggataattctggccatgtcaaaggagtaactgtgggctggtggaaaattcaatatgcagaaagtcaatcccagttttcccattgggtccccgtgtcccagtttgtacattcaaactgtccggagtcctcatggtaagatggcgtgactgataaagctcaaactgtaaacaggacatgtcccatccagccagggtcaccatctctcatgtcacttcatcctgatggcctcctttcagtgtggcccgagtgcactctgcctgctgaaccctgactccagtgctacgtagtttcatgatcttgggaaagggtcttcattcatttggcaaatatttattgagcacctaccatgagcaaggaggtcatctaggggctttggataaactgggaaacaaaacaaagtgactggtcttgtggggtttacattctagttgaagtgtgcaggaagagaaaggcaatataaagaaacataagtgagtagatgcagggaattttttaaaatgggaagtgctgtggaaagagatcagtgtcacgggcttgtcatgtggcagaagacagaggaggcactgcaatatgaaagcagagcaaataacagaggtcttcactaagaaagtgacatataagcaaaaacacaaaagaggtgaaggagtgaatggcaggtgtcgggggaacagcattccagggaaagtctggaggcacagccaccaagtggctgcaagacacagcacagaggatgataggagccaggttgtgttgggctttgcaggctgtggtgaggactctggtttctcctgagacaaagaatcactggagggtttcttgacttcttagagctctggtgtccttacctgtcacatgcagataagaagggcacctcagaactgcacaaagcaattgtgtgtgttgatgtgaccacgtgagcactgagtgcttggcaagtattgtcattaatatcagttcctgcccccctcctgacacatttctcaacctgcccctccaaccctgccatctacaactggtcaaaatgaaatgcagcttcacgtcctgcctcctccaaatacaagaaaatatactagttcacagtgatcagaggctctctctctctctctctctctccctctcctgaacttctgtatcacttgctgcatgtgcccttatttgacatttacacacacacacacccaaacacagaggattatggaggagtgatgtgacctgggattagataacagagatcagtgatggggcctgtcctaaccagagagcatgtgctcacaggaagtggcagcatccggcctcccatttatcttctctcctcaatttcagcttgagggtcattccaggaaaaaatgtatacagtatcccatgcatttaaaacaaactaacacactctagtcagatactcatatggtacttaatttcacatcttttccattgcttttcttagcaacctagttcatgaattctggatgactagccccagaacttttaaatccactaattttgattaatttaatttctgcattaaagaagtttctctccatcagggcttctagatgcatctttcctctccgtaaccttattgctcctggtttttgcatgatatcctgtgtgaatgggtttggtttcattgtgcctatttttttacagaatcctttcagaagaacgtgggatacaaatgataaccaatattaatcgagttagctcctccatctacatccccctttctgaaaactggccctgccccaacaggggctcctgtacgcatatttgtggaggatgggccttctcccactctctggacagatgagtcactagggtcagacatatgactcaggaagagctgttccactgaataccaggctgggccagagtctcccatttcccaagagtctggtattggacaaagtgatttttctcagcctagtctccctcatgctagaatagactgggggatattatgtagatatagaaagtagaaaagagacccagagtagcttatgttcctgactgcttccagcttcttatcccgggacctgtggttgcactccttatgctgggttccatgcaatcccctgggctcctattttaagtaagcgcctctcatcttagctaaagctactttgggggcattctgttacatgcagccaaaagcattctgctatggtttgagcacggtttgtctgccctcaccaaaatgaatgttgaaatttgatccccaatgtggtggtgtcagaaggtggggcttagtgggaggtgtttgggtcatgggggcagagctctcatgaatggcttgcagctgttctagaggtaactgaacacttgtattaacagtagtgagttcttgctctcctgagactggattagttctctgggaatgaattatttcccacaagagttggttggcattaagtgagattccttctcctgtttgatccctctttgcacgtgtctgtctcccctttgtgcatctcaccatgttatgatgcagcatggaagcccttgccagaaaccagggccatgcccttgaacttcccagcctgcagaaccatgagctaagtaaatgtctcttctttataaatcacccagtctcgggtattctattgtagcaacaccacaaaacagattaagactggtcctaagacataaataagagaccagatcaattgctttcatgctttaatcctgtgacaagcttacagtaagctacaagatatgcaaaacaggcatgagactgatggtgctcagagactaatcatgctctggcagagggaaatttctttccaaataattgaatggagataccagttgttctgaactactgggcaagatgttgttacttgctgtgtaaggaatatataattcagccacacatccacttgcaggaaagagctgtctgctgcttgcttgttgaactatggaagcagaatgatatggctaaaatccacagaatggttcctgaaaaacaccacatagcagagcctgggaaaggggtgaggcaggggaggaggtctatttggaggtatccaagcatttttggaactgtgttctctgttttcccagaggatgaaagggctctttgcctttgaacttgcactacaccaggagaaggccaggcaccccttgaagaaatgtctacaatccagggacagtcttgtttgcaaactcttttgttagggtttggaacttgacattttggcaaggactagtcatctgagatggggaggggagagaagggagggctgtgcaagcaatcaaactgatactcttcttggaaattacccaagcaatgcaggcacgtaaaagggaaagtgagggatgagccatcctcttttggatggaaacatggaggctgcaagtttacagcccactaatctttgcttgtctcagtaaaagaaaggcttgcactattccatctgtaactccctgattagataaatccaaggctgaaaaacataccagagaaatgttctgaaggctgagaaagactgaggaataactcaagcacttcaaatcagaggcatgagaagtaagttatctatagacaaacatcagcctttgtaggaataaactgcggtttgcattagacagctgagttataagctctctctaatggtagcttcgaaagtttaatactgtcagatgcacactgtttttatgttgaaacatcttgacttttttttttttttttttaacttttcctaggctcaagtgatcctcccccctttagcctccaaaagtgctgggattacaggcgtgagccacaccacacccagtctatcctgacatttaaaaacaaggtatgataaaggttaatgcaaataaaaaccaaaatagaattattctttaaggtaaaagtaggattatatcattcaacttatttaatgaatatcttcagtatataccagccaccatgctaggtgccagggatagaagggtgaaaaagaaaatgaatgatatcttttcttaaagagctaatggtctggtgggagtgggtgggagatacataaataaaatgacaactcaattacagaaatggagcattcccagagatgcacatgggttgccacagaaactatgagatcactgcaggggtcagaggaagcttcctaggaagtgacacttgaactgtattttaaagagacggcgatagaaagactatctcctgtagaggcaacagcttatccaaaaggatcaaagcctgaaacagcatctcccttcaggaacctgcaagtggttccagggctggagcagagagagccagacaaggcactaggcaggctatggtcccgcaccagtggtagcaccagggaacttgtcagaaatgcaaattctgaggcagctcgagacctactacatcagaaactctgggggcagggcccagcaagttctgtcttcttaacaagccctgcaggtaattgtgacatgtgttgaagtttgagaacctctgggctagaagggttaaggcctgatcagcatagctgtatgtgttatgggtaccaagggaccagcaagccatgggaagccaaccaaggattttaagcaaaacaagttatcagatttgcatttcagaaacatctttccagcacagtacaaagaatgaattgaagagagatgagactgcaggtagcaagacaaattgggaggctactaatttggtgagaatgacatcagctgaaaaaggaagaggcagccgcagcaagatggagacagcagatgaaaaggcagagactctatggactcagtggcaggaagcagcagggtacaaggttaaaattatgggcctttaggtccaggtgcaatggctcagtctgtagtcccagcactttgggaggccaatgtgggaggattgcttgagtccaggagtttgagaccagcctgggcaacacagtgaatataaaaaataaatatgaaaataaaattaaaaagattagccgggcatggtggtatgtgtctgtggtcacagctacttgggaggctgagtgggaggatcgcttgagcccaggagttcaaggttacattgaggtatgatcacgtcactgcattctagcctgagtgagacagtgagtctgttagaaaggaaaggaaaggaaaaacaagaggaaaggcaaggaaaaaaatgaatggatgaaggggaatgtcctgggaggtgaagaaaagagtgcagtctaagaaaacgtcccagtttttagcttaaacaacttggcaggcttttggtgtcatttacaaagttaggaatactagaagtggagaatatttggagagaaatatcagttttagatttcagttttaggcgttattaccaagacagatgtcagacactgatgtggaaagattctgactcttgcacaaggaaatctgggggctggacagcagttggctctagagtcaaacttagcttagcattcaggttccaccattactggctgtgtgacctcagacaagtaatttaacttgtcagtcctctacttcttcctctacaaaacacagagacaagtggaatctatctcgtggggtcattgggaagactaaatgagataacgcatgtgctcaaataacgtgcttaaagtgtgtggcacatgaaaaggtgcctggcatatgcctggctcaataaataactgactgtggttatcattaaggctacatatagtctggaggaaagaggatcaaggcattgtcttagagagcatgaagatgtatggggcagtgtacagaggggaccaaaaggggagattcagaagaattagataaaagggcagcaggaaaccaagaaagaggtgccaccaaagcccatagagcaattacacattaagtaggggaaggggccagctctactaagcaaaggggtggcaacagtggagactgtttgtgttccgttaagtgaaaattaaaacatagagcaacaagaaagcattaaaaaagtaacttccctcaactcaaatgagtccagcatgaccaccagacactgggcattgtgtggctaggtaagatgagttgggaggcacggaaactgccaaaaaggaactcaggactggcctgggggcacctctgtaatatctggaaatatccgttaccttacgtaggagacaaaagggaggcagtgttacacaatgtgttccaaagaccatcagacggggagtcaggagcccccaggtgtagtggcgagctgcagagtaactgtgtgtgaccttggtcaagtcactgaatgatagtctcctcaagtgtaaatgggtaataacacctgctgcaatgtcacaagactgtgactgtcaaacacagggaagacatttggaaaagaatatgttgcatagatacaggataaattaaaataccaccttttatccatttcttaaaataacagagatataacgctgcagttatggctgtgtcatctggtacctgcactgcctttagaaggcagcacagattagccattcatggaatcggtacttatctggtgcctatttccagaagagtttgtgtggggagacaattctcacatctacacttttttggggggcagggtgggggggatagagtctcgctctgtcgcccaggctggagtgcagtggcgcaatctcggctcactgcaacctccacctccccggttcaagcgattctcctgcctcagcctcctgagtagctgggattacaggtgcgtgccaccacgcctggctaatttttgtatttttagtagagacagggtttcaccatgttggtcaggcgggtcttgaactcctgacttcgtgatccacctgcctcggcttcccaaagcactgagattacaggtgtgagccaccttatcagcaaggcactgacattacaagtgagtccttcgttactatcttttcaagaaaatttgaacagcagatagccttgaaagattcagtgtttctttacagagcaagggtcagggagacttactgcccattataaaagatcggagttccctaagttcagggttcctctcctagaatacaactcactatgtatcacctggccctctctgcaccaccctgtaagaattagggctcagggaaagtgtacaaaaatattgatcctctggttcctggcattgctgtgattaataaagtcctatgtgtctgccccagcagtgtgatgccttctgccaggatttgtgacactgtggcaggataacttgtttgctggcatgcagggtgaaatctcagacccttcacagtccttgacactcagtgttattgttccacagaagagtttggtgtcttagattgttctccagccccctggcttgcttcagcttgccctgtgggatgtcagcaccatcagagctgaggaggctgctgagatattaatagctatttttaaaacacttatcacaaatgctctctctatgcctatatatctgtgtgtgtttttgaattttattttgtttttgtgggttctgttttttttgtttgtttcactgatgaaatctttcttttctaagaaacacaggacatttatacatttaaagagaggaaaagtgactgttattaaacagatgtctgtgctacagtcaatatatcattctttcattttaaagtgttctaatttaactgtaaatattaaaagttcctaagaaataactccatgtttcaggtacattttagtaaacatcttgcctttgaaataattgaaatgccaggagaatgtaacttcaaagcttcagacattgtacagaatgagctgaatggtgtttcctacacttacacgctcccgtggcctatgtgcccaacccccacattaggcaaatccactacagaaaactatactcagagtacactgacttcttgttagaattcagaaagcttctttaaaatgaaacctgattgataacattagcaacaaagtcatccaagaagtcatctctgagaacctcaagtccacgctgaaacaggaagtgaattttctcctggtgggccttttgaaataaacgctccatcttaaaaatgccaggacccttcttaatagctatcatagaagttatacctccgatcaaatcaaccatttacaaaaagaatgatgacaggtgccttcacttcaagctctgttttcatatttccatacccatgtttaaaatccccttaatagttgcactgaactgacgtcatctttctgatgctttataaattcaatcaaaacctaaaacatcttgagagatgaatgcaggatgcatggggcataatcaggagatcccaatccattgattatcatgtgaaagaaggcacagaggcaattagtcctttgttgtggatgacaaataacctccacataaaatgttctatacactgaggcatctttgatccatcttactggctcagtgactcacaaaggaggaaggaggggggatgtctgaaaacaaaagggcagcctgacgacaccatttagttatttattctgtatgttcagctcagtttttcctctttccaacttttcatgatactataaaaagaaatggaatggattcctttcaaccaagaacatcagcactgcatactaagaagtaaagtactggcttaacacagagcccacagaagccaccgaatatcatcctctctccttagttaggtattttttacaaggaaaatgggttttgacaaatcattcttttatatgttcttttatataagactttaatgcacagactcttggaaattaatttacatataagacaaactattcacagcttcaggagagaaggctgggttctcaacaagcactgccttggaaactatccatgtgtgtgcactctggaattttccttttctgttagaattgtttggaagagtctcctgatgaacaacagcatgagggatgtgaataagcgtcccttatttcctctggtttaaagacatccataactttttgttctctgaataaaagtggcatgacattaaagtgagttgaagatataaaagcatgtgctagagatcagcaagcttctaaaatgatttactaattcagatgaatattaaaaaatcaacatggaaataaaaattatggtttttttttgagacagagtctccgtctgttgcccaggctggagtgcagaggcgcgtgctcggctcactgcaacctctgcctcccgggttcaagtgattcttttgcctcagcctcttgaatagctgggattacaggtgtgcaccaccacacctggctaatttttgtattttttagtagagacaaggtttcgccatgttggccaggctggtcaacatgaactcttggcctcaagtgatccacctgcctcggcctcccaaagtgctgggattacaggcataagccaccgtgcccagcttttatctttaaaaattaagaggactgctaatttcctgaagttaaaacagaaagtataaagggaccatacaaattataaatagtgacacagccaaatgagcctgacctctgatgacaaaccttggttcaaatctgggccccagcatttaatggatgtggcctgggcaagctgacactctcaattttctctcccataaatacagactattgcctagcattcacatagcattgatatgaggatcaatgagttaaggtatgtgttttatgtatagtaggcactcaataaacacactattattgccattaaaagtgtaattaaaaagtctcttacctaagcacaatataaggtcacttttcagataacaaaaagaaactatcacatcatctgtgcattattcagttaatctagcagatttgtatcagaaccgaaatagcatatactatggggaaaaaagattgcaaagaggacctaaaatccttttttccttttgcaagaaacttcttttcatttttgatacaagatttcatttaaagctgtttaaccagagagggtcgccatgggaaagtaaaccgctgacagaatatattaggttcacattaatttacagtggtagcataatgcttatgaaaaataagctggctggaagcccacagtttgcccttgagcctcagtcagcagggaagttttgtgcaatatgattagtaaatgaggagaccctaggtgattaattagtgctccatgtcaatcctatcagacaggctttcagccagtaacgtaaataagccacctgattttaaacttcctcctcttaaaactgacgtccatgtgagcatgactttgtcaaacacttaaatattgaaggaagatttcctccaaatctcctttaagataaatcctgcttcctttgacacacactttagctctggtaaatggcagactagatgggaaagaatctaaataaggaagcttgtctgagaattctgagtactgaattaacaaaactcatttcataagtccctattaactgttcaatgctcaaaagagaaaaatctgactatgaatagatttactgcctacacctgtgtaccagtcagtaacttttcccagactttactatgcagttatgtttttaaaaatctttttactgtgtgtcattaaattgttaatgatctgttttttatctataatttcctagatatttctgatatgtattttatcaaggtattgtcccaagagagatgtttctatggccaggtctgttagtttacgtagctgcacagtcacttctctggtatctattactatttcagtcaagcttcttaaattagatttaaaagggaaagaaacagctttcctaaattaaatcagttcctttaaatgaggttgacccttgagtaggtaatttgtgtaaacataaaatgggtcctgctcttcctaaaatcttatcactaggttctcaaaactgggctccaaatgtgagatgtggtgtacagcaggtcttcgagaaatgtcattttgttcaatgtcgtttccttcagtaacattgatgagaggccggggccattgtgcagagtttgcacatttgccccacgtctgcatgggttttctttgggtactctggtttcctcccacatcccaaagatgtgtgcattaggtgaaccgaactgaagtgtccacacggtccctgtctgagtgagtgtggatgtgtgatggaatggtgtcctgtctagggtgggtccctgccttgtgccctgatatgccaggacagactccagccactctcaaccctgaactaaaatcatggaatcattgagtaaataattattttgtttttattaatcctttctcttgttttcgagacagagtcttgctctgtcccccaggctggagtgcagtggtgagatctcggctcactgcaacctccacctcctgagttctgtatatatagctcacatttatttcaatgtttaatattaaaagtgttttgaatctttacttagtttgctgatgtttttgtgaccagaaatatgtcctagcaacttcaacttttgtctgtatcaagtagcctatggtaaaattagatttcttatacatacatgtcattttgcttaaagtcacagtttccaaatagatgatcttaagtgaggacttactgtatctgtataattaagatataagtattccattcttgtctgtatactattttctcattgtagatgaaaggctctatatgaataaaatactgcatataaatatactcacatatagaatctacagatcaccgtgtacatacacagaaacatcaaaggtgtcctaggctataaagtgcaggtctcataggctaaaatcattaactgttacatgctgcaaaggtccaaggtttaaagatatcaggctgggtctcatcagaaaggaggctgatttttgctcaaacaccgttagaactgaaaggaacctctgaggcccaacaaagtcaagtcaggaaacaggaaaattgagaatctccatttagaagccagaataccaatctcaacctaatgtcattctttttcacatacacaagaaatccaaggcaggccaggtgaaaacatctgaactagatagtagtcatggcgagaggcaacccgctcccaagggtaaacacacaaactctaattctacggctttcaaatgtcagcacaaaggtaaggaagcatccaagacaccaggcaatttcctaacaaatacctctgagggcttcagtgggcaggacatcttgctatgttcacaggttgataaatgatggcacaatggagttcatgccctgatggtacttatcatctcaccatagagataagttatgaatcaataatgaacctaaatgccaatttgcagtaaatgccataaatgagactgagaaaaaataagttcagagaaggccaccagatgccaagatgagggaagatttcatgagggggtacaggtctcaaggggggtggaggatagaattctaagaaatggagatggaaggccttctagaccactgttttttaaacaggttgcaacttgcttgatatcacagtttaatggccattttcttcctcaatgaaatggaatagaatgctatagcatgtggcaagataaagtactatttcatgaagctttttagcctcatgtaaattgtattggttgttctgcttcatgaaaaatgaagagtgaggttttgtatttggctggaaaataagaactcagttatgaggtgattccaaggcagcatctaaaacatagcatcaaagaatctggattttgtactgttttttgcctttttaaagctttattgacatcgactgtgcttagtatctcacacacatgatctcacttaattgtaaccaccactctttgagttgggtattattacctccattatagaggaggcaagtgagaatcagacaggttatataaccagcccataaaatgaagccaggtcttttgaatccaaagctcataatgttaaaaaggacacaaaagaaaattatgaaatgatcagagctgggctttaggaatattaatcttgcaccttcaaagagttacactgaatagacattagacaactatatcattagagaggtttcttttgatcactcaatttagatataaaatcaatttaaatacactccaaattctaggcaaaaatcacacccaaaccaagagttaaaactgctcttaacgaccctaaaaatatttcagtgaaggttcttatttctcaatagctatattaatatccccttacttcattctgcagccatgaagctaatgacttatcatttgaaaaatgctttgaagaaaatatgaaaataggtggaaatgcagaactctgcctaaagcagaaatgctaacataaaagaagtaacccactgcttttctcagactgactcgccccagccctctgttctcacccctacgtgctctgtctgatcctacctacctccgggaacaactgtgaggactaacggtgtaatctatgaagtgcacagggctccctggaaaagcatggctgttaaaagcccggatgtcatcactagaggcagctgagagaacatgccaacagtcgactgctaatataaaaatgtaaaaaagaaataacagtagacgggataatgttgtgtctaatttaaagaggaaaaaagaattcagaagtagctatttctgatgaatatgaaatatctgggtattgagcaatgaaagacaaatattcttcctctcttttctgttgaaagcatccctcacaacaagaatcaaaaaagctcctccacatacccagaataacccaattgcccaacaggcagagagaccagaagggtaaagtgttcctctgtccggcatatgagctggatagagaaatgtacactaaataccctgcaaatcagaaaagccagctgtgcacaggattatgctcttcttcatacactctgaacgatctattcaatggttatggactaatatatgaactctctttaaaagaaaaaagtcatagatcctcaaggttgacataagttattatttattaaaatattccttaaatatgcagaaatagaagactggtataaaaccccaagcaaatttatatatcaactaaaaagaatactatcaaaccaacagaactgaaactagccaaaataattaaatgtaacagatgatttttttttttttttttgctgtcactaaaacactgatgtaggcatccagtctagttctatatttaatctgctttggtattttaactttcacaaatgtttacatagagaatacctgtttacataattatattgaacaaaacagcaaaaaatctagaggacagactgggatgattagacctcatacttaacccaaagtcagccatacttaacccaggtgtcacaataactctacaaagctctcttactaacttgaacagagttagtatcagagcattattgaaatttgcattaaataggtgtctcattcaatcaggtagaaatgaaaaacaggaactttttttattgtacatttaccagctatgctcactactataaactattctgcaaggtgtatgtacaagggctagctagacctgcccaccactctgctggaaatggggggagggtactgactgctcccattttagtatgaccatactgcaaacagcttttcatttatctcattcagtcttcacaaaaggggagaggtactgttattattcacatttaacaggtgaggaaacagttaagtgactcacccaaggtcacacagattgacagtggtagagccaggatgcaaaacaaggaagccttactccaaactccaagctctgtaccacaaatgcttcttgaccaccgtaaatccctgtgtggcacgctgtgataccacatggccccatccacccactgaaaacacacacacagatgcaggtctgcccttacatccaagcattcatttataatgtggttgaccacatgatcccaaagatgctaacacttctaaccgcctactacatatctccatttggttactactcattcaactaaagcatgtgccctcgaaaatcaatgaaattagagacttttctttccagctggaagggtgtagcaagcctgatttgaaaatgattacaactgcttctacagggtaaaaaactgcccgaagtgggcattgagtttaaacattatatcctcgtcattaataaaaacaagagctaacatttattgcatccttacaatggaactggcacagttacgaacttgtgtcatttcaataaagtttcaggacaaccactgaagtaaacaccatatcgtcactttccaactgtggaaactgagcttacgagacattaagtagcctggactagagttgctacctacctagtgactgggaaaaccccaattcaaacccaggcatctgactccagaatcccgaccactccaaatgcaggatgagaagatctattggcaatacagtttctcctcactgcgtctcagaacttggggattcagtttcatttagacttctgcagccagtttaatctctaacctactcatcttgtttggttggttaagagatgttatacagccacaaaataacacaagatctgtaataattcagaatcttttggctttgagaccaaaaactgctgtaatcctaaaaagaatcaccaattaaaaactaagattttgagtatgttcaagtaaaagaatctacactgccatagaagcacaaaacccagctttggtcagaaagctagaccacagtttctgcagccttgacttcagactctgagttccttgatgtaggtgttgtatcttggacatggcacctggcaggaaaaagatggtgaaatgactgagcatcaggcatgggcctactctgctgttgttcaccaggccatcacctgactgggtaggcagaagggcctgcacacacattgccaggagctaacaaggtcactgggaccagagcaaatgagagacagtgagcacatcctgaaatggccagagatgctcagggatgaaatgtcccctagacactgagaaagtgataatggtgaacttttgttgctcatcagcctgtgccaggagctataggtgccttctgtacatgactaactgtcatcacactgtgaaggagacaatgatatccccatcatacaaatgaggaaacaggctcagaggcaacacagctctagaaagcagcttgattaaggccagggctccctgaagccacagtggaaaagccacagccgtttccactttcctagaggcacactccaccccacctgcacttcggccatgaaagttgaaacaaagtgatgggatgtgcattggacttgggaataagggaatgggagctaaactgagacacagatatttagaatcaacaaagattttagaggttgtctagtctagttttttcatttgcagagtaaactagagcagttattagattcacttaagattacacaacatatacacacatattatacacacacacacacacacacacatatttagaaacaggatcttactccattgtccagactggaatgcagtggcaagaccatagctcactgctgccacaaactcctgagctcaagccatcctcctgcttcatcctcctgagtagctgggactaggggcatgtgccaccatacccggctaaatgttaaaatttttttaaaagacggtctcactatgtcgcccaggctggagtatagtggcatgaccatacctcactgctgcctcaaactcctggtattatataatctttctgcctcagccttctgagtagctgggattacaggcacacttctctatttttatttattcttttttaaattatactttaagttccggagtacatgtgcagaacttgcagtttcattacataggtatacacatgccatggtggtttgctgcacccatcaacctgtcacctacattaggtatttctcctaatgctatccctcccctaccccctaccccacgacaggccccagtatgtgatgttcccttccctgtgtccgtgtgttctccttgttcaactcccacttatgagtgagaacatgcagtgtttggttttctgttcttgtgatagtttgctgagaaagaggatttccagcttcatccatgtccctgcaaaggacatgaactcatccttttttatggctgcatagcattccatagtgtatatgtgccacattttcttcatccagtctatcactgatggacatttgggttggttccaagtctttgctattgtgaatagtgctgcaataaacatacatacatgtgtctttatagaatgatttataatcctttgggtatatacccagtaatggcactgttgggtcaaatggtatttctagttctagatccttgaggaatcgccacactgtcttccacagtagttgaactaatttacactcccaccaacagtgtaaaagcattcctgtttctccacatcctctccagcatctgttgtttcctgactttttaatgatcgccattctaactggtgtgagatggtatctcattgtggttttgatttgtggtctaatgaccaataatgatgagctttttttcatatgtttgttggctgcataaatgtcttcttttgagaagtgtctgttcatatcctttgcccacgttttgatggggttgtttttttcttgtaaatttgtttatgttctttgtagattctggatgttagccctttgtcagatggacagattgcaaaaattttctcccaccttgtaggttgcctgttcactctgatgatagtttctttcgctgtgcagaagctctttagtttaattagatcccatttgtctattttggcttttgttgccattgcttttagtgttttagtcaggaagtctttgcccatgcctatgtcctgaatggtactgcccaggttttcttctaggatttttatggttccatatgaagtttaaagtagttttttccaattctgtgaagaaagtcattggtagcttgatggggatagcattgaatctataattaccttgggcagtatggccattttgacaatattgattcatcctatccatcagcatggaatgtctttgcatttgtttgtgtcctctcttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtatagcaatgcttgtgatttttgtacattgattttgtattctgagactttgctgaagttgcttatcaacttaaggagattttgggctgagacgatggggttttctaaatatctgtcatctgaaaacagggacaatttgacttcctctcttcctaattgaataacctttatttttatttctttctcttgcctgagtgccctggccagaacttccaatactatgttgaataggagtggtgagagagggcatccctgtcttgtgccagttttcaaagggaatgcttccagtgtttcctcattcagtatgatattggctgtgggtttgtcataaatagctcttattattttgagatatgttccattgatacctagtttattgagtttttagcatgaaggagtgttgaattttgtcaaaggccttttctgcatctattgagataatcatgcggtttttgtcactggttctgtttatgtgatggattatgtttattgatttgtgtatgttgaaccagccttgcatcccagggatgaagctgacttcatcgtggtggataagctttttcatgtgctgctggattctgtttgccagtattttattgaggatttctgcatcaatgttcatcagagatattggcctgaaattttccttttttgtggtgtctctgccaggttttggtaacaggatgatgctagcctcataaaatgagttagggaggattccctctttttctatagtttggaatagtttcagaaggaatggtatcatctcctgtttgtacctctggtagaattcggctgtgaatccatctggtcctggacattttgttggtaggctattaattactgcctcaatttcagaacttgttattggtctattcagggattcaacttcttcctggtttagacttgtggggggtgttatgtgtccaggatttatccattattacaggttttctcatttatttgcatagaggtgtttatagtattctctgatggtagtctgtacttctgcgggattggtggtgatatcccctatatcttttttttttttttttttttttcttgagacagagttttgctctgtcgcccaggctggggtgcagtggcgcgatcttggctcactgcaagctctgcctcccgggttcacactattctcctgcctcagcctcccaagtagctgggactacaggcacccgccaccaagcctggctaattttttgtatttttagtagagacagggtttcaccatgttagccaggatggtctcgatcgcctgacctcgtgatccgcccgcctcggcctcccaaagtgctgggattacaggtgtgagccacagcacccggccccctatatcattttttattgcatctatttgattcttctctcttttcttctttattagtctggctagtggtctatccattttgttgatcttaaaaaaaaaaaaaaaaaaaaaaaccagctcctggattcattgatttttttgaagagtttttcgtgtctctatctccttcagttctgctctgatcttagttatttcttgtcttctgctagcttttgaatttgtttgctgtgcttctctagttcttttaattttgttgttaggatgtcaattttagatctttcctgctttctcttgtgggcatttagtgctataaatttccctctgcacactgctttaaatgtgtcccagagagtctggtatgttgtgtctttgttctcattggtttcaaagaacatctttatttctgctttaatttcgttatgtaccctgtagtcattcaggaccaggttgttcagtttccatgtagttgtgtggttttcagtgagtttcttaagcctgagttctaatttgactgcactgtggtctgacagactgtttgttgtgattttcattctttagcatttgctgaggagtgttttacttccaattatgtggtcaattttagaataagtgtgatgagttgctgagaagaatgtatattctgttgatttagggtggagagttctgtagatgtctattaggtccgcttggtccagagctgagttcaagtcctgaatatccttgttaattttctgtctcattgatctgtctaatattgacagtggggtgttaaagtctccaactattattgtgtgggagtctaatcctctttgtaggtctctaagaacttgctttatgaatctgggtgctcctgtattggatgcatatatatttaggatagttagctcttcttgctgcatcgatccctttatcactatgtaatgcccttcttttctcttttgatctttgttggtttaaagtcttttttatcagaggttaggattgcaactcctgttttttgtttgtttgtttggttttggctttccatttgcttggtaaatattcctccatccctttattttgagcctatgtgtgtctttgcatgtgagttggatctcctgaatagagcacactgatgggtcttgactctttatccaatttgccagtctgtgtcttttaattggggcatttagcatgtttacatttaaggttaatattgttatgtgtgaatttgatcctgtcattatgatgctagctggttattttgcctggtagttgatgcagtttctttataacatcaatggtctttacaatttggtatgtttttgcagtggctggtaccggctgttcctgtccatgtttagtgcttccttcaggagctcctgtaaggcacgcctggtggtgacaaaatctctcagcatttgcttgtctgtaaaggattttatttctccttcgcttatgaagcttagtttggctggatatgaaattctgggttgaaaattcttttctttaagaatgttgagtattggcccccactctcttctggcttgtagggtttctgcagagagatccactgttagtctgatgggcttccctttgtgggtaacctgacctttctctatggctgcccttaacattttttccttcatttcaaccttggtgaatctgaagattatgtgtcttgggattgctcttctcaaggagtatctttgtggtgttctctgtatttcctgaatttgaatgttggtctgtcttgctaatttggggaagttctcctggataatatcctggagagtgttttccaacttggttccattctccttgtcactttcaggtacaccaatcaaacacagatttggtcttttcacatagtcccatatttgttggaggctttgctcgttcctttttattcttttttctctaatcttgtcttctttctttatttcattaagttgatcttcaatcattgctatcctttcttttgcttgattgattcggctgttgatacttgtatatgcttcacgaagttcttgtgctgttttttcagtgccatcaggtcatgtatgttcttctttaaactggttattctagttagcaattcgtctaaccttttttcaaggttcttagcttccttgcattgggttagagcatgctcgtttagctcaagtctgttattacccaccttctgaagcctacttctgtcaattcgtcaaactcattctccatccagttttgttcccttgctggtgaggagttgtaatcccttggaggagaagaggtgttcttgtttttggtattttcagcctttttcagctggtttctccccatctttgtggatttatccatctttggtctttaatgttggtgaccttcagatggggtctttaagcagatgtgctattcctttctgtttgttagttttccttttggcagtcaggcccttctgctgccggtctgctggagtttgctagagatccactctcagccctgtttgcctgggtatcaccagcggaagcaaagattcctgcctgatctttcctcaggaagctttgtcccagaggagcacctgccagatgccagccagagctctcctgtatgaggtgtccgtcggcccctactgggaggtgtctcccagatacacaggggtcagggacccacttgaggaggcaggctgaccctcagcagagctcaaacactgtgctgggaggtccgctgctctcttcagagctgtcaggcagggacatttaagtctgctgaagctgcgcccatagccacccctttccccgggtgctctgtcccagggagatggaggttttatctataagtccctgactggggctgctacctttttgtcagagatcctctgcccagagaaaagaaatctggcggtctggccccagcagcctttctgagctgcagtgggctctgcccagttcgaacttcccagtgcctttgtttaaactgtgaatgtaaaaccacctactcaagcctcagcaatggcggacgcccctcccccgaccaagctctagtgccccaggtggagctcagactgctgccgtgctggcagcgaggatttcaagccagtggatcttagtttgctgggctctgtgggggtgggacccgccgagccagaccacttggatccctggcttcagcacccctttccaggagagtgaatggttgtctcgttggcgttccaggtgctactggggtatggaaaaaaagaactcctgcagctagttcggcgtctgcccaaatggccacccagatttgtgcttgaaacccagggccctggtggggtgggcaccggagggaatctcctggtttgtgggttgcgaagactgtggaacaagcgcagtatctatgccggagttcctcaggctcagtccctcacggcttcctttggctagaggacgaaattccgcgaccccttgcgcttcccgggtgaggtgacgccccaccctgcttcggcttgccctctgtgggctgcacccgctgtccaaccagtcccagtgagatgaaccgggcacctcagttggagatgcagaaatcacccgccttctgagtcgatctcgctgggagctacagaccggagctgttcctattcggccatcttgccagccagaagccacttttctatttttaactagaattactgaaccctgacaatgtgccagaaacagccctagtacctttaaatatgctaattttcataacaccctcattaggcaagtgccccattttacagatgaggactctaaggtgtaatgagcttaggtaattcactgaagatctttctgctggcaaatcccatgctctcaacatgtgcctcaccgccctcccagagagctacttcaagagctgatgctcaggcctccagtatttgctgtctgcattaggaggtggcaagggcctggcacagaggtctgcgacaagccaagctaggccatggcttccatccacacccctctgcacctaaatgcattgatcctacaatgaagagctggcaaggtcatcctggttttgctccattttctctgtggcattgtcatttgaggtgctgctcatggtaggtggtggggttcaccttcttccatgctgagctaggctggacacattccagccgacagcaggacaaagagggtgatgtgaccacctatgaggggctcagccccatgctctgtgatcacggcctggggactttggcacctgaggtgctggatggtgtcactactgggcacagttttccctgcatcagcagcaataggggaatacgtgcacacaggaaggctcaggttccccaaactcatatagcatctggactaaaaggaaggatttgtacagggctctagaggttaactgtcagttatgtagttgctccactttagaacaatgactttggacactttagggcatagccaaagagcaaagcagttactttgtggctgttctgcctgctcctcactcttggccatcagtaagtctggcttaggatggagaaatccaagggtctcctctggctgagggaggcaggtccagaaagccacacaccagcagtaccagttcactacatcagctccttagtccacaaaaaggtccacaggatggacagggacagaggccaacagccaccccgccaccagagcagggccattcctctgacatctaagagtcacatccatatgactactgcaacctgtggctcaaagtcagctgaaaaatggttatacacattaagttagagccattttgtgaaaactaattcagttttcttcccgttgcttggtacatacacactattcagtgaaatattagcttttattcaaggcatgacataggaattccttcaaaattaatattttatgctatactttgtatcagtttatactgaaatatttatcaacatgtcctgtgactgcctgtgcaggaatttattcaaatttattccattttgctgtttgttgtatactgattttcactgataaatttcctttgactgtaggtactgtagaagaattcactcaaatttatttgatattacagtttgcttctgcattacctttattcatcaaaatatcatacaggtatgtgcttttcaaaaaaagctctgccgtgtctgatatgaaaacgtcccctatctataaatgcctgtattacctactacttatttacccacaagtttcctctgttatctgtaacagttgggggtgggaggctggggaatgctactgcttgtccagatgttatgatctccttctggatctctgtaccctgtatttgcataaacaaaatgcttctccccctcacccccaccaaaaaaaaaaaaaaccaaaaaaccttttatgttactttcaatgcttgtatgtttgaagtagtcaaatctttttcctcaaataattatttgtaaaaattagaatatcatttacaaatctctgtttcttatttgcatctaaaagcagaataaggaggtccaggagccatgagcttctcccaggtttcagcctggaccaaatcctaaactccttatcttttctcagaggcagcaggttcaccaaaacacaaatgtcaggaccaaggcgcatccacatgcttctatccactctattgcccttactcccctcttccccaaaccacaattttgacatggcagacttggaataaaatcaagaagctcctctagaatgagaaaggaataaacagcttactgggacattcatgcctcaacattgcattccctttagattttttttttcctggtgatcttttgtatcttgcaatactctagggggaagaaaaggagaactgtgggcaaaaacttatgtaatttattgcaacataattttaatttacatgctgtggtaggcaaccttcgatatggccttcaatgattcccatccctggtcctcacacctttgtgtagtcccctcctataatattataccggggttggttgtgtgaccaacagaatacaacagaagtgcaggaacatcctttctaagatcagcgtagaaaagattgtggctgtgtcttggttgctctctagtgcgtgttctctctctctctcatcaacatggctctgtgggaagccatgctgtgggcagctccatgaggcggcccatatggcaagaactgaagtctcctgccaacactcacgtgagtttgaaagtagaccctgcagccccagacaaagctccaggtgactagagcctcaactcacagcttgactgcaactccatgagagaactacccagctaagccactcccagactaatgactctcaaactatgggagataaaagtttgttttaagctgctaaattctggggtaacttgttatatagcaatagataactcatacacatagattttcaaattctttcttgagctttcttcagtgatccaagtttctactataaacatgaattacttttgcaaatacaaatcaaagacggcatatgtgtgtatgacctcttgggaagaagatgggatgggctaaggtggtgacttccctcttcctttttttttttgagatggagtctcactgttgtagcccaggctggagtgcagtggcgcgatctcggctcactgcaacctccgcctcccaggttcaagctattctcctgtctcagtctcctgagtggctgggattacaggcacgtgccaccatgcccagctaatttttgtacttttagtagagatggggtttcgccatgttggccaggctggtcttgaactcctgacctcaggtgatctgcctgcttcagcctcccaaagtcctgggattacagacgtgagccaccgtgcccagccccctctttcttatatctcttaattcccggactgaaaactacccagcacaggcttcgtggggatgctacagagcaaatgtgagcagggataatggggagttgaacaaaatgccttctatcctgggattatttgatgagtactactgacattcaaacactgccaatctgtgtcttcttataacctctcaaataggctgatcaatcgcttcttttgttgactgaggactacagaaggatacacatttaaattcaagagatatttagggttaactttaggaagaacttctagccaagaaaactgtggttaaacaactgcacaggatgaacaattagcacggcataaagaacacgggccttagcttcagcaagaccaggcttgtgtcctggttccatttccttctagcagtgtgattttggataaatcattttctctctttgaagctcaacttccttacccataaaatagtgacaaaaccatctaccttgttggtgctcagctggcctcattccctccttctctagacaggggtggataaaaccacatcgctagaccctttctagtcctaagattacctggtacaggctttactctgactgcaggagagatgtggatttgataacactaaggtggtccttatccaccaaccttcctgctctcttggcaaactctgagaggctcatttcctgaatgtttctctcagaagattacatatacactacaatgcatccttttcttccataagaaaatgtgggataggctgggcatggtggctcacgcctgtaattccagcactttgggaggctgaggcaggcagatcacttgaggccaggagatcgagactagcctgggcaacatggaaaaaccccatctgtactaaaaatacaaagaaattagctgggcatggtggcatgcctataatcccagctactcaggaggctgaggcatgagaattgcttgaacccaggagggggagggtgcagtgagccgagatcatgccactacactccagcctgggtgacagagcaagactctgtctcaaaaaaaaaaaaaaaaaaaaagagagagagagagagagaaggaaaatgggggttaaatcaggaaactaaactttatgccacactttcttgggtgcctgtgaagcaaatcacctcacccatctgggtcttggttatcctgttgggatatgcaggggatacgttaaggtcatctctacctctaaaagcctagactctaattttagagagatatggagagtatttcagaagtctttatgtgttatggtgggttttattaagggattatctctatatagtgtctctgtgctcttaatttacccccacacaaaatgctctcatttccttcgcaaaacatattgtctaaagcccaatgcaggctgaatgctggcagctagtaggccactctgaagcaaatctcttgtcctctctgtacataacttccctcatctgtgtaaagggataataatatcttacctgacggggttctgtgaagatgaaatgagtcaatgtatacaaagaacttagaacacacagccccacctaagtgtgagctaccagtggtcctagtgccaacacatctgctcacatccgttccacccatggagctgtgtgcttattccaggtgagctatgtttcctttcaaatctttttgtgccaagtgtacttgctttgcatgcatactgtgcaagcattatataaaatcaattaaatatggaagtcaagaaatagttgtttctgtaaaaactaagctaaatgccttgtaaagactccatgaaggcaggctgggcatagtggctcatgcctgtcatcccagcactttgggaggcagaggtggcaggatcgcttaaggccaggagttcaagaccagccgaggtaaaacagcaagacacccattctctacaaaaagacttaaaaattcgccaggcacagtggtacatgcctatagtcctagctactcagaagactgaggcaggaggatcgtttgagcccaggagctcaaggttacaattagctatgatcgtgccactgcactttagcctgggtgacagtgagacctcatctctttaaaaaaaaaaaaaaaaaaaaaagactccatgaaggcaaaccatgacaaaagtttgctgttgaatgaggtgtgacggagacaactgcataacactggaaaaattctggaaaaacctcccgacttagattactttgcaagtattgctgagttctaggtccaccttaaaaaaatgtaaatggaagttgtggctgacaaattatggctgaagtttacacaaggaagatacttcagtcagaggacacttagacaagaaaaagaccttgggcctatctcaaaacattcctagtactcaaaatattacagcaagtgacataccactgggggaaaaatatcagagtctccatgcacacagcacgagcagggaaaaaaccaaaatgctagacaatatactacttcaaaatcgtattttcatttaaaataaaatgtgtaaagtatgtgtcattttacacacaccctcatcattttcattgactctttgagctaactggccaattatcagtcttgatttagtttggcaacagcgtttcaactctgcatgagcctgtgttctcgcatcgtggatgtgcctatggggtcgggggttagaaagcttccattagataatgtgtaaatcatatctgcactttgactagcatttcttaatatacatatatatacacccatccataaatacatacataacaattctgctactttagaattttttttttttttgagatgaagtctccctctgtcgcccagactagagtgcagtggcgtgatctcggctcaccacaacctccgcctccctggttgaagcgattctcctgcctcagcctcccaagtagctgggattacaggctcccgacaccacgccaggctaatttttttttgtatttttagcagagacagggtttcaccatgttggccaggttggtcttgaactcctgacctcaagtgatctacctgccttggcctcccaaagtgctgggattacaggtgtgagccactgcacccagcctactttagaatttttaaatgtctttagggaattttctaattttcccccaaataatgcataccttgagactacctgaatccatacctttttctatatgtgaacttcacgacatttgatttatccatcctatacagttatagaatattagatcacaatattgggcttaaaaaatgtcagctaggtgcagtggcacacacctgtaatcccaaatactttgggaggccgaggcaggaggattgtctggggccaggagttcgagaccaaagtgggcaacatagtgagatcttgtctctacaagaaatttttaaaaattagccaagtgtggtagtgcacgcctgtagtcctagctactcgggaggctgaggcagaaggattccttaagcccaggagttcagggctgcagtgagctatgatcacaccactgcactccagcctgagtgacagagcaagaccctgtctctgaatgaatgaatgaatgaatgaacaaacaagtgcttaccttgttcctaatttaattagcaagctaaacatatcttgcacatggcagacgtaagctctggaatgtgccctcaatttcactggctccagacccacaattctctttaactccctggcagacacacttcaccatctggagtccctactgcaaccaaactgtccactgtcaaccatttcatctgtgtgtctgtgtgtgtgtgtgtataggggaagccatggcctgtccaacaactcacagtcccaacctcatgtagtctggtaaatcagggaccctcattcacagccagagaatgaaagaaaagctgcagaatgcagttctgacccctgggctggctagagcacaaaatgaaaaggatagactgctgaggaggtggggtgtcacatgtctgtattttgctgttcataacgacggcaacaagtactaaaggtgtgcgaaagcagagggaggcataaaatgagatagaaggaaatgatgacttttaagtggcaatacaaagacggggtggctaaaaagaacatcttagcagtgatcaggaaggaagggatgacacatctttgaacatagctataatttaaattaagagtggaaatgaggtatatcttggaataagaagtatctaggtgttaacactactctcagttgaattattcaaagaaaacatctatgtaggaagtcttatgttcaggggagggatggtggaagtgtgtgatgggcatctgctgagatgcccccatggagcagccctcctccattctgaccttgtggcttgaacagggctgagcctacaaggcaagtacatgacccaggacatctaatgaccagtgcctctcatggctccgtgaccgacagtggcaaggagtcaggaggggtgagctgagcctagcccaccaaagtccatgtccatcagatgcaagactaagctgaaattaccagagaagagggtttttcttcctgctagtgaaacagaaacctagagcagctggtggctgtttctgccactgcttgggggcaagcttgcctgaaaaagaagccaacagagaaaggcagagcaagaaatgaagagaaaaactgctgataccttcagagcaactggaaatggccaatgccaaaagcaatatccctagatgtttctgttacgtcaatcagtaaattcctatttttgcctgagccagtttgattggggtttctgtcacttagagctgaaaatgtcctaattcaaaatgtaactatctagctgcaatatatatattttttcatttaaccacactgcttactgttcatgcttttgaacatagggattatttctacacataagacttttttttttttgagacagggtcttgctctgtcacccaggctggagtccagtggtgtgatatcggctcattacaacctctgcttcctgggctcaggtgatcctcccacctcagcctctcaagtagctgtgactactggcgtgtgccaccacacctggctaatttctttgtattttttgtagaggcagggtttcaccatgttgcctaggctggtctagaactcctggcctcaagcgatatgcccacctcaacctcccaaagtgctgggattacaggcgtgagccagcacacccaacccacatattcttaataggctcaacataagttatttcaaagggcagaaggaaaatgtaatccaactggagatacacataaatattaagatacagtattaataatgttaatagcaaacatttgttaaatttaccacagacacatagtaacattgaacaaatgtttgctattaatattaattctgtattgtgtcttaatagatgtgcattaggatatattaataatgtattaataatatacatctcaatcttcacaatgtttcgctataagtattcaaattatatctattttaaagaagggcaaactgattcagagaggttaagaaacttgcccaacaccagagcaggtggtaggtcagagacccaggaccaagcaagcatattctaactagaacattcgctcttaaatcactatgctctactccctccagaatatcagaagtgttactgaaaatacataaagttggttctgctgtaccacataaagaggttcagccactacacggtgccctgagccatccctcaacacagtgatagaaaggacggatccctgagtatccctgagaggtgttttccaactgcagggtgcaaaccattggtgagccatgaaaatgatttaatgagtgaagaccagcagtattccccgacagaatagaaaatatcagactatggtatataagggcaaatattgccttgtgaaacctttttgcttatacatatatacatacatatttatatcccagttcatgacatgaaatatactttcctataaatcataaagttttaaggccacaaatgtagagcagaaagttgtgtgaaggctggctgtaaaatcccctaaacctggactcacagggttgaggtggggagagagagagagagaagtgaaaactaaatggcctcaggaattgaggaaaattagaactgacccatactgcaatgtattttcctgaggaaatcctctaagcaaatctatctgattccctaagagggcttttttccttaactaaatattagagactaaggatcctttcacaaaacccccaatatctgatgtttatgtggtaattcaaaactgaaaagggtgaagcagcgatatgaaagcaatctgctgggtgagcgctaatgaggtccatgcagcagacagcaccagagcccaagctcggagcagctccccaggcacacggctgatgtggaaactcacaggacagcttgagtttgctggggaaaagtcaaattggcaagcataacagtagccttgcctgggctaaaagaaacacctcgctggctccccctcgctcttctcttgtgtggcagcgtcaggcggccccaggagatgctgaggggcttaacatcccacgcggtgctcccactgaggctcctcggctcctctccccgcccaggaagaggacacttcttaagcttttattaaactgttgtcataaattgcttatgagagcaaagtaacaaactatcactttccctttccttccaagtggcgagaactgggcctgtgcctgctccaaagcactgagccaaaatcagccggcagaaaattgccagccatcattaactgtcggactggcagagcagaggaagtccattttattagaggctcatccataatatattttgtttgaaccctgtacagactgaattcattaacatagattaacaattcatcctcgagctcagattcctttgtgcttctcctaagtggcatcactcttttagctcctcccactcacaataaattatttaatcgcaaagttcagaactattttctgtcagtgttaaatatttcctatcagtggctctgaaccttctgtggattaaggatctcctttgagcatctaatgaaagctacacatccttactcaggaaaaatgcacaaagaagccaggtgtggtggctcacgcctgtaatcccagcactttgggaagccgaggtagacggatcacttgagtccaggggtttgagaccagcctggccaacacggtgaaaccccgtctctactaaaatataaaaattcgctggcgtggtggtgggtgcctgtaatcccagctactcaggaggctgaggcaggagaatcccttgaaccctggaggtagaggctgcagtgagctgacagccgagatcatgccactacactccagcctgggcgacagagcgagactctgtctcaaaaaaaaaaaaaaaagaaaaagaaaaagaaaaaaacacaaaagcgtgcacacatacacaattttgctaggattttaggggtgcagagatgcccagaaactctcccacggtctcttagaaagcatatgaacccccagttaagttcctcagttctagtatgtatcacctttcctagtgccgaacacattcatggcaaaaaattagttcacttagagagttaagtgtttctctcaaacacctactgaaaaacaaaaccagcaaacaaacaaaacaatgatattaacatttcctacttatctttattgtacttcagaaatgaaaaatcagttaagtgtttagggtcctgttatttgcttagtgctaagaggaatataaaaaaagtaaaagacagtccctcatcataacaaaattaacgtgatgaagcaatgatggagaaaagagatccgtacacagttatatgctaaattacatggtaccagctaatggcacagtggcaattttttttttaatttttaaaatttaaaaatacatgtagggagttcaagtgcagatttcttacatgcatatattgcctagtggtaaagtctgggcttttaatgtacccatcacctaaatagtaaactttctacccaatcataatttttcaaccctcacctccctcccatcctcccactatttttagtcttcaatgtccattattttattctgtctgtccatgtgtacccatcatttggcccccgtttacaagtgagaatgtgtggcatttgcctttctgtttctgagttattttactgatgataaaggcctccagttccatccatgttgctccaaaagacaagatttcattcctttttatcgctgcatagtattccaaggtgtgtgtgtgtgtgtgtgtgtgtgtgtgtgtgtaacccacattttctgtatccaatgatcctccactgatggacacttaggttgatttcatatctttgctattgtgaacagcagtgtggtgaacatatgacttgaggtgtttttaaatataataattccttttcctttggttagataccggaaatgggattgctagatccaacggtagttctatttttagttgagaaatctccataccattttccactgaggttgtactaacgtatattcccaccaacagtgtataagcgttcccttttctccacatgctcaccaacatctgttatttttagtctgttgaataacaaccattctgactggtgtgagaaggtatctcattgtggttgttttatttttgtttgtttgtttgtttttgtttttttttgttttttttgaggcagagtctcactctgtcacccaggatggagtgcagtggtgtgatttcggctcactgcaacctctgcctctcgggtttaagcaattctcctgcctcagcctcctgagtaactgggactacaggtgccctacgcccagctagtgttttttgtatttttagtagagacagggtttcaccatattggccagactggtctcaaactcctgaccttgtgatctgcccacctcagtctcccaaagtactggggttacaggtatgagccactgcacctggcctcgttgtgattttaatttgcatttctctgatgattagtgatgttgagcatttttttcatgtttgttggccacttgtatgtcttcttttgaaaaatgtgtgttcatgttttttgctcactttttaatggggttctttggggtttttttcttgttaagttgtttgagtttcttgtagattctgcatgtcagcccttagttggatgcatactttgggaatttttttttcctcattctgtaggtttactctcctgatttttttcttttgctgtgcagaatctttttaatttaatttaattaagtgccatttctccatttttattttcattgtgcttggttttaaggacttggtcataaattctttgcctgggccaatgtccagaagagtttttcctaggtttcttctaggatttttatagtttcaggtcttacgtttaggtctttaatccatcctgagttaatttttgtatatgataagaggtatgggttcagtttcattcttctacaacatacatccaattttcccagcaccatttattgaatagggtgtcatttccccagtgtacatttttgttgaatttgttgaaaatcagttgtagatatgtggctttatttttggcttctctattctattccactgatctatgtgtctatttttataccagtaccatgttgttttggttactatagctttgtagtgtaatttcaagtcaggtaacgtgacgcctctagattttttctttttgcttaggattgctttggctattctggcttttttggttccatatgaattttaggattgggttttttaattctgtgaaaaataatgttggtaagtttgataaggattatattgaatctgtagatttctctggggagatggtcattttaacaatgttgattcttctaacccatgagcatgggatatttttccatttgtctgtgttgtctatgattactttcatcggtgttttgtagttcacctccttgtttaaatatattcccagctgggtttttttttttttttttctggtagctattataaatggggttgactttttgatttggtcctcggctagatcattactgtactagtgtacagaaaagctactgatttctatatgttaatttagtatcctgaaaccttactgaattgatttatcaaatctaagagttttttggtggagtctttaaggttttctagatataagatcatatcatcagtgaacagggataatttgacttcctcctttccaatttggatgtcttttattattctctcttgcctgattgctctggtgagaacttccagtgccatgttgaataagagtcatgaaagtgggcatgcttctcttgttccagttcttaaggggaatgttttcaactttttcctattaagtatgatgttggctgtaggtttgtcatatatggcctttattatgttgaagtatattccttctgtgtctcgtatgttgaagacttttatcatgaagagatgctgaattttactgaatgcttttttctgcatctattgagacgatcatatgtttttgtccttaattctgtctgcatgatgtatcacatttcttcatttgcacatgttgaatcatccttgcatccttaggataaatcccacctgatcacggtatagtatctttttgatgagctgctggattcaatttgctagtattttgttgagaatttttacatatattttcatcagggatattggcctctagttttcttttttgttgtatccttgtctggttttggtatcagggttataactagccttgtagaatgaggtggggagaatcctctcgttttttttttttggaatagtttcaggaggattggtattagttcttctttgtatggttttttcctttttcttttctttttttttttttttttgagatggagtcttgctctgtcacccaggctggagtgcagtggcgcgatcttggctcactgcaacctccgcctcccgggttcaagggattctcctgcctcagcctcccaagtagctaggactacaggtgggtaccatcacgcccagctaatttttttttttttttgtatttttagtagagatggggtttcacagtgttagccaggatagtctcgatctcctgacctcgtgatccacacaccacggcctcccaaagtgctgggattacaggcatgagccactgcacctggcctcctttgtatgtttgaaagaatttgcctgtgactgcatctggtcctgggctttttttgttgagagatttttattactgattcaatttcactactcatcattggtctgtgcagggcttctatttcttcaatctcaggaggttgtgtccccaggagtttatccatttcttccagcttttctagtttgtgagcatatagttgttaataataatagtctctgatgatcttatatttccatgatcagttgtaatgtctcctttttcatttctgattgtgtttattttgatcttctctcttcttttcttggttagtctagctagtggtttatcaattttgtttatcttttcaaaaaaccaacttttcatttcactcatcctttgtattgttttttggtctctagttcatgtagttttgctctgatctttgtcgcttattttcttgtaactttgagtttggtttgttcttatttttctagttccttcaagtgtgatgttaggtaacttgtgacctactgttttgatgtaggcatttagtgctataaacttccctcttagtactgcttttgcagtatctcacaggtttcactatgctgtattttcattttcattcaaggaattatgcttcattcttcatcgacctttttagtgaacacccaggaagttttcctgtgtgcttgtagtctgcctccctttttccaattacaacaccttggtctttctttgggcaataagctggtgttctagagtaagatggtaaggatgtgacccaatcctggcaatcacagcattccacctatctcacattaacaattggtttgggactagtgggtgcttaagacttgtccagtaagactcatcctgggatttctattcaagtattttcaaagagagactcatttactacagttattaaactcatgggaaagacaataggagctgctagtagctaccttgaaaccacatgaggataccctaagaatgaagccagtccaagagaaagcaaaggcaagaaatggacagagccctatgacatggtttggtcactggatatatttttaggtatatgaggctaataacctccatctcacagagtgcatgactaaccacagtaaatttaggattctgtgcttctccatcccttctccataactagtttacctcttaaagggtatctggaatttcagttgtcatgtaacatgaaagttttgaaatgatgactggcccatttactattaattttcttgacacctccatgatgctagccaacaatggtctttaattaaagtcacacattttcaaaattttatatgtatttaaattaagagctttttttgtgagctaacatcttaaaatggaagttagcaaaacattgttagataacactagtataaagttacctaatttgctgtctaaaagtgttggagtaaattaagcaaaagttgaaacaagaagatagcactttagcatcaaactaaatctccaagaggaaggaaaactaaagttcaaggctaaaactctaaattgcatcttaaaggaaatgaaaacaatacattaaatatcacacagtttttaaaaactactgtctctatgtggtggtattacagaaaattagaacaaaaataatcatatgcatttcctaaattgtctgtctagaacatgttatcttgataatggggaaaaatgagcttttaaaaataaaagacaacgtaataatacaatttaaagataatgatatgtttgtccattaaaacttcgtaagaatgggctccctccatgaaaaattactcataggcctttactgaaagaacctttaaatggtaaggtacgccttttatgtgtttttgggtatgttttcagaatgtttcttaggatcaccagatcagaaggccacaatgaccaaccaccagcttgggcaagaccatgcaaaaccaaacttcagatttcagctaattgtaccccagaaacctcccaaagaaaatgtcaaaagcagctgggcacggtggctcacgcctgtaatcctagcactttaggaggctgaggcaagtggatcacttgaggtcagaagttcgagaccagcctggcccacatgacgaaaccctgtctctactaaaaatacaaaaattagctgggcgtgatggcaggcgcctgtaatcccagctactcaggaggctgaggcaggagaatcgcttgaactggggaggcggaagttgcagtgagccgagatcatgccattgcgctccatcctgggtgacagagcgagactctatctaaaaaaaaaataaattaaaaaaaaaatgtaaaaagcagtcttgatgaggtgttaaatcctaataaggtcttgcaatcaagtttttctcaaagcataacttcaattccattttatacttgaacaataaatatacttcaacaataacattttccttttattataaaaagaaacatgttcttccaactcctcaaaatataagatatctagttatgtagctgcctcttaactttttagcggtgtttttaaaaataggaaactatttgaaaacatgaacctactgattccaaagccctgcaatgatttagtgaagctcagtgtctcatactttgtttgttcacagcgtgaaccattatggagaaagcttattaaaaagttctcatttcacattacaaatccataatctaacgcgctaatcatactcattcaattgctgcacatccataaatgccattgtacacaatcatcattaaaattcactgtggaataataacttttaaaatctcatcttgaacaaaaagctatttgaaattaccatattatctttatttctagattaaatttggttaaatgcctttgcacgctttttaatataagaatctaaatataatgaagaaacaacccctaaaatattccattaccacagaaaatataaactgttaatacatgcataaagtccaaatgaaaacaaaagcttcagcttagacctgaaggccagatccacaaatattataagaaccttctgaaaggacaccctttgctttctaaaggagagagtatgtgccaaacaagctttgaaaacaaatttgcattctatttaccaaagaattccatgtataatacatgttcaaggtgggggttggggagaggaagtgacatgagtataaaaatcccacagaaagatactctgcttggagctagaagtgttaggccttggatggtaatagaagaaatagcctgagaacaccagaagttttcctaaagcaaggccctgaaatgtgaacacaagagagctaacagcgtgggtggttactgcttccagcagccccaatggtactgaacatgtccaacttcgtgatctgggtgctggttacagagtttcttcagtttgtgaaaatccatcagtatgtgcaccatacgatacttcataatccctaaggatctctgtgctctcctttctaccaactctccaatttcacatcataccactctctccagtcacacaggcctactttctattccttgactatatcaagcaatttttgacgtcaatcatcctgctaattgcatctctttcttctctcctttataaagacagggtactcctaccctaagggtttgtttgagatgataactcagtaaagtcttttctggccacctttgcgaatttattcccccctcatattactaaccacacttcctgaaattattccttctaattatatctgtagttgtttttcagctgtctcccctagtaggctgtatgcatcatgagaatggagaccatgtccatcttatccacttgtgtttccccagcacagtgccttgaatacagaaggtattaaaaaaaattggctgtatgaatgatatttcccaaccccttaagttttcaggtattatgctaaaagggtaaatatagaaataagtaaacaagtagttaaaaattaaaaattagcttgaatacaaattttcagactgctttcatgtgccttgctttacccacaaccagcggtagcagcttcatggcactaatgacaaaacaataaaccaacagctcctcagtaatctgacctaccctgttaaacaaaaaggatccaccacactgttaggatatccttagcaaaagcaaagctactaattcattcttttctcctccctgcaaaaagactgaaaaatcactccacacacgcgcgcgcacacacacgtgcgtgcgcacacacacacgtgcacagcacacacccccacacacacagcacccccacacacacacacacacacacacaggtaggaatggctcttcagcactgaactggcatcttcacctactacccaaaccactgggacttcacaatccttacacactgtcttggccccagatgcagagacattttatgccaaatctgtgggtggaaaagtcaattccatccttcctgtagaaggatacacagatgattgttatacaactttaggatgacccatgctttcctgtctcaggaagctcccagagactccctaactgcatctcattcacccacgtggtgggtttcaaacttgctctgatgataaagcactgggaagcagagctgcctattgaggaaaaatatgaaacactgagatactttgcttctttttatgaacgaggaataatttttctggcagaaatggcagtatatgaatgccatctaaaaccatagcttatacgtacctggcaggggagattatttcaaccctaagaaagaataaaaaaacaccataccctaaacttgcgtgttctcaataaaataatagagttattaaactaactggttgtgtccaaatttttctgttaacattcttttactacttattcattcattttcactaatactcaccaaaagagatgtggtagcaaatgccaaacacttatgaaatgttgacaggagaaaaacatgaaactgaaaaagtttctattagcccattttattttccttctgtggattgagataggccattattcatttttagcagtggggactactgggctgggtcttttgaagtccaattattatcattctttgccaaagataaggaaaatagacttctatattttgaagaagtttctaattctcaccaagtttatactcatcaaaaagtgaaatgattatttcaaaataaatttgttaaaaattataccaatattttgaaagagccaagaagccaaatgacccttattaccacattgtattataatgtgcataaatgttaaacatgaagtagtttaaacattgactaaacagaaaatctggaatcatatactcttattgagagcaacaaagtcaaagccaattatgagacaccaaaggatgtctttgatagtaacactttaaaaataaagataataaaatagtacattttatcatactagcgtttttatttttctaaacagaatacacactgtatagtaacatataaaatacaaataggtctgtggtctccaaaaatgacactaaatcaactgaagcagaagaaaatgcacaaatggtattaaatcatgacacagaaaaagagagggtagcatctggcacttctggcgtgctactaagaacacactcggggaggaatacaaattctacagtctctgaactaggcagggtggctgcaatttgggaagctgtttttttcccttaggtagaataaaatgttcatcagaccacatttgtaagtattcactcaataatgaatacaacagtaaccattttaacatccaagtagtttttaaaatcacacacttagaaatacaactgagaattccaaataatttatgtaaatattctgcccacaactgggaagggcaaaattccccattccttatgcaagggctgtacgtagtggcctccttccaaaggaggtgggccgagtcactttacagtggagaaatctggcagcggattgcatcggccacgtgatcaagattatgttgacatgatcacatcagtgataagtcatgttgacaggatgtacccctgatacaacaaaaatggcacttaacctctgtgggtcttcccctagtctaatcatgagaaaaacaacagacaaatctgaggaacattccacaaaatacctaaacactattcctcaaaactgtcaagatcatcaaaaacaaaaaggtctacgaaactgtcacagccaagaggtgcctaagaaaccatgaacaacgtaatgtagtgcccagggtgagatcctggaacagaaaaggacattaggtaaaacctaaggaagtctgaataaggtacaaactttagttaataataatatatcaatattggctcattagttgtaacaaatgcagtatattaacatgtaaggtgttagaaatacttgttccccggtgacgcaaagaaacagcactcgaacataaatttaatcatcttagcaaggccatttttattaaatgtatgttcgaatgctcatacatttatttctctgcagcaccagggaacaagcatttctaacataaggtgttagtaacaggggaaaatgggtgcacagtaaatggaaactgtactatctttgcaactttcctgtaaatataaaactcttccaagtctcacactgtccccctggatctcaatctgctggctaagtaaatccatactgaatttagaacagagattattaggcaaaaagtttttaaagttgcagcgaagggagggtaaacggcttgtgcaccgctgctagctaatatccacagcttccccagggactttaatgtggtggcacttgaagagattggtttgccaatcgatgggctgcttttgaggctcttgattaacatatgtagagttccaaagtgccttgaaagctttctattatctcagcactccaaatgcagtttctaaatgctgatattcagtttcagctttttccagtttcttcttcagccttccacattcatgatcacctgttcacccttagcgagcctcagagcagagtggagttgcttgaaacccatgtgggcaagctgacctactgtggataggccagagtctaactgagggacagcaagattttcagatggtctttagacaacaaattgaaaatggtaattccttttctttagcagcagggcataacctgtgaatgtcttcttgtttaatctcccagcactctatgatgtaggtcctgtaaatgccctcacttaaataacaaagacacagaataagccagaagaaataactcccttcagagtggcagagcagaatcctaacccatgcctctttgcctaaaacctgtactgtctctggcttgcatgttcccttccatgaatataatgcagtaaaacaccgtgggaaacaagcctttcaagaattcaaacagtattactagacagtaacgacactaagacaatttccctcccatgttttctacagcaaaaaggaatcactattctggtaaaaatttccatcaggctgggatcttcctttccagtatttcaaatttggaaatcataaaaaataactttaaacacaatacaaatggctaaacatgaccggatattcaacatgaatattactgtcataacagggtaatggggtgatataatgacggggaaaagttagtatctttatttatctctgtctttttgcagaaaggaaggaaaatttataaatctgagtaagaagagtataataaagaaatggttaagtaggagttcacaagagggtttaagcctttctatgtgctaaaatatgacatacacactctattttcttgaacactattttaaggcaacttttttattatcattagttactgattttccttgaattactttaataaccactattggaaatactccataacataagtaggctcgaaaagcttttctgcatttgcaaaaactgtaaccatagacaagccatagcccctgtatcttcagacagaatctgaacatttttagcccctgtatcttcagacagagtctcaacatccaggtgctcctctaaattaaagcttaattttcacaattggtagaaagcagaaatttgagtcaaccagctgttaacagcccacagaaaaccagcaagcagacttagttattttttccttaagtgtagaataaattgactgactgtattgagctgtttttgtgtttccccctccagagatgtcacttccctgaagaatttccaccaacatataaccaatcctttcaaaaaacaggcgttctcttaaaattaattcttatcattttctaatccacaacatcttaaagtggaaaatgtaatttttctaagcagaagtatattttgtttgtctccaagtagattctaaattccaatcagatttagtccaaatgccacttaatgactttgtgttccaacccagataacaagacaagctgctaacttaccatttggtgacaaatacctctttcttcaagtttcccccactggtgttattattagcaatgaagagagtggctcataagcagactttttcaaaagctaaagcagagcagggtaaattttcatccctcatgttttccccataatctgtaaaatatttcacttagattatcatgattttctaaaactttaatatatttactacagggagattttctaaatatgctgttaattagtttgttcattccacaaacatatttaattgcttctaaatgctaagcacagagaaataaaattgaatgagattgaagagactaatatcttcaattgagggaggcagggggcgtgttttccttgtttaggacgtgcctccaaggcctgtctagcatgaggctccgctcagcaaatattcactgaaatgtgaacaacaaagctctgccttcaggatgtggataatccttgaagacaagtgccaggcactcttctagattctgtagatagaacaatgagcaaaacaaatgctgtgccatcatgacacttacattcctgtgcaggggagcacaataaactaaactatatatataatataatgtgtgacaggggctctaaagtaaaaaaggcagtgtaggaagatggggagcttttccagactgagtggtcttacacttggaagaagtttcagatgagctgagatttaaatgaagtgagtggcaaatgttgcaaatattctagataaaagtgttctaagcagaaggaactaattaatatgcaggcaactaacgataacacagtttgcagctagtataatgaggtatgtggccgagtttggtagctgtctaccaaaactccattttgtctttctggtcacccagctagaccacatgtctcagctgcccttgcagtttgagtggctttgtgacttgtctttaccaatggactgtgagagaagtggtaggtgtcacttctgaggcaaggctttaagaaacaaatatatccactccatgctctcttctttaccctttcacataaaacggaacacaatggggctagcagagccataacgtggaaagggcctgggcctatacatcactgcaaaaaggacagtcatccaggctcacgcctataatcccagcactttgggaggccaaggtgggcggatcacctgaggtcgggagttcaagaccagcctgacccaacatggagaaaccttgtctctactaaaaatacaatattagcagatctttttccattgtcatatccctaggacctggcacaaatcctggaaaatggtagatattcagtatttattgaataaatgctactgaaagcatgaaaaaagcaagtaggtcaataagtaattgaggcaagggttcagcaggggtttatgacagcgacactttaaagaatggggcaagtggcttataagggcctggtaggatggttggggtggatattcttggcagtggaaagcgtataagcaaagaaaggaagaaaatacatgacacatttgagggacacggatcccaaagtgtttccatgcttgtgtgcttttcattcaataaacatttagaagcatctgttatgcgctgagcactactataggtgctggaaacacaaagcctggtaaggccaggccctggtgaagaggaagcttgaagcacacaacacaaggaagacataaaaagaagagtggtaatgctagtggggtcactacaccgtcgctgcgtcctgaaattccagcagacactgtccaggaagattagctgtgggcaggcacattccagcaaaggtacgaaacagcatggcagctcacagaactgcgaatagtccagccccctcaaaagtaggctccatgatggcaatgactttgttttattcactgctgagtctccagtgcctagaacaggccctgcactttgcagattttgaatgcctagacatttgaggggaggggatgaggttataaataaggctataaaggaggcataaactatggcataacagaaggaattcaaagagctctgatgggaaacagtaaggccagatttgtgttttacaagagcattctagttgaaacatgcttgaaggggtgtgatacctggacaggaaaagcaggtagtagatgactgcaatggcccaggcctcaggagagaggagatgaaaactgaaataagacaacaggaggaaagcaggggtagaaagaaaatcacaggccgggtgcggtggctcacacctgtaatcccagcactttgggaggccaaggcaggcggatcacaaggtcaggagatcaagaccatcctgtacaacatggtgaaaccccatctctactaaaaatacaaaaattagttgggcgtggtggggcatgcctgtagtcccagctactcaggaggctgaggcaggagaactgcctgaacctgggaggtggaggttgcagagagccgagatcgcgccactgcactccagcctggcaacacagcgagactctgtctcaaaaaacaaaacaaaacaaaacaaaacaaaacaaaacaaaaaaacaggatttaagaactatacggggaggactgagaaggcttgtgatacatacatgtgtatgtgtatagtgtgtgtatataagtatataaaaagagagactaagacgactcctaaatttaagaaaaaccaggcttggggaaaacagtaattcaattttgcatatgttacacttgggatgctttagagtattctaggaagaatgtgtccaaaaggtagcttacataggcatgatgttcccagaaaaggtttggtctagggtcaaaaacagaacagcattcaggtgaaagctaatgtcatgggagggaatgaaactgcccaaacatagccaccacttactgctgtgcaagctgtgcactgcacaactcctggggctccagttaccgtgggtcactgcagctttgtacagctattacgaccattttttggtagatgaatataatgtatcttgaaagagaggtacctgtttgtaattcatcaaagtcatcacataacaatatgtttgttaaaggaactgccagagcaagcagagatgagaggagggaaagagaagaaaccgggagaaggcaggtgagggtgaagaggggcaaatctacttcatttttgcctaggcttcattttaaagctgatctataaaaaatcttacatcctctacatttaagatctcaacgattttattaagccctaagctttcagggtcttaacagattgtgttaatacaggaaatatcaggaacttcctgaaagcagtcctcgccctgctttctcatggacatctcagtgtttgtcctttggctcatacatttgaggcctccattttcttcataaaataacgatgacaatgatgaaaacacccctacacatacacatgcacacagacacagttaacagttctcctctagctttccacacacttttcaagaattatgagaatggaataaaaatcacttcagggcattttcaaatggcttttccaaaactagaaataagcataagtaactgaacagctgtaatggcaaagaatgctagtgagtttctatagcaagacgtgctgtgtcaaaccagtggttccaaaatggaggcaattctgggcctccctgagaggacattcgataacatctggagacatcttggttgtcaccctattggggaagggtgcactggcatctagtgggtagaggttggggaagtctctagatgttctataatatacaagacagtccccaccacaaagaattacctggcccactacgtcaacagtgctgaggctgagaaaatctgtgctaaatcataagctccttgaggcctagaaccagtaagtactttttggcaaaaagcagacacacacacaaaaaacgtgtgatgagacaaaattaaatgggagacagttatcacactatattgaagaaatgggcaacaatttcacttttccccagcccctcctgttatcactgccttccttctagactcccaatccaaattacatgaaagccaataacaggcattagaaacctaaatgatacatacagtttacatgcttttctatacaccaaatcctagcatttctatcaaattcttaccccaaatgagtaagatctttgaaaagtataaacatcttttcctgtgtaaaatccattattttctaagaatcacatgaataacaacatagcctcctacgaatataaataaaaacacttcttgattattgttctcctacatactaataaatgcaattctggcagttaatttagattaatgaaagaagcaaacagaatgaagtaaaatcagaagctaaatataggtgatctaagttaatctcactgagtccttttatcccattattaattaatgcttcccacacctaacctaagtagccattcatttgttgccccaaattgaaatgagggtaaataactttcacacattttttaaggaggcatccgatttaactgctgaggcttgggtcttgacattaaaattgactgtgtttctaaatttttttttttttttcttttttgagatggagtcttgctgtcacccaggctggagtgcagtggcatgatctcggctcactgcaggcttcgccccctggggttcacgtgtgtttctaatttttaaggccctactttaatttctactgtcactaaataaaaaagaacaaaagctttttcttttaaaaaccctagacatcatgttcctgcttctgctggaaaaagagacaggatatcaccatctcaaaccagcacctttcagcaactgaagcctttttgtcctcaccctgagtgttaagacaatggctccctcacacgtcacaggccctggaagtgctacaacagctgaatgggttttcatgggacataaatcactttcccactacctgccacctacaaacctacttctcatgaaccttggatcctgcacaatatggctcgtcatatcctttgtgactgctatgaacaaggggactatttgcatgagtagatagagggcatttttccttttgacggttggtgtttttcccccttgttccttgaattttttttcattaaaatcacagaaacattcaatgtccacatgtcagttaaattttcaacttatacttgcatgtttcatataactgttgagcactttaataagattcttgaaagcatatttatctgtccatttcctaatatatctccatattcttataattttgcatgagagcttttgagcaaattttcatcccattttgggggccttaaagaactgaggagaaaatatacacagtagaccacgcatttactgattgacaatgttttcccatatacaaatttcctaaattcacttattcctcttgaaactgaattgctgaaaagaataatgattaaagatattcttgtggatgtgacaccacctacatacatctcatcccattgctctgtattaaatttggactgcttaaagtaggagttatatatacttgttatggggaccaaaaagctgcctggaattttgtagcctttatcacaagcagctgagaggctgtctgagagtcacataagtagatcacagctgccaatggtcagtccaggtgcctgtgttccctcctttttcagtggcctagagtacatgcttcacctgcatgccccattcagacaagaacagatgctgctgcaacaaagtggtccaaccacaacaaacaacacttctctgtgagccatgttatgccaaagcctctgcaggcacagatcatgaagcaatttaatacaagcttagataaaaagccaagtgaacaatctagaagccaaaagaaaacacaagggaaagttccttagttttagcgaggagaagaaacaggcagagtacatctccaggggaaatgagaggaaaggggaggggaggcaacagctgtccgccaggtctatttcagggaaccggtgaaaacgttatttcccttactctggcaactgagattatgagtccttataatccgtgcttataattctcaactctttctagggtcaggaggagcaagtgacattgaacagagcccaagcagaacaagaattatgtgtgctgattgtgctaaacacaaagtggagccccagcatttttctgaaagtggctggaaagcaatctctagcttggcttgtaaaaaccttatggcgggtgggggtggggaaatgagggatgcatctctcccctaaacaagtctcacaggaaaaaatatccattaatgaaaagacctttgcattagaaaaagatggcagtggggatgtatgctgacaacctcgagaataataccaaaggctagagccaaaacatgtgattccagtgtcaggccagagcccagctggagcagccatgggaaaaaaagataccatacagaggagaagcagggggccagggctgagtgaagtgggtgacaaattggtgctaaggcaccacaagcggcaggcttgttttctcccgcctgatgttgtaagaggcttttacactggaagcctggatgctgtggaggagggcgggtggcatatatgcagctgagctttactctgagacagcaggatgctgtcaccaccagcatagcagggaaaacatgacgcaagacccatctgggacaggtgggtgcacagcccttggcaggggcaccgcacgcaggacaggagattcaaaccccaacacaacacattccctggggccaacgaacaagcctcggcctcaagaggaggaatacaaatactggagctgattgtagcagaaacagctgtgctgcagcctacacggccaagtgcaggagacgctggcatgatgtcttcaagagggtgcaggctcccgagtagtgcagctacaaagctgccccccagggtttaactggccaattcttgcaaaggggcactcaataaataatttgaaatttgaataagtctctccatcctgcctactcccagcacaaaatccatcaacagactggatcttctcgtaacctgttgggcctatgaggacgcagaagtgcaaaatacattccctgccctcaaagggtttattgtcatctaggcccgatggttccttccaaattgtgggtagcctcctacagtggatagtcaaaatcaattaaatgggtcaaaataaacactgtttttaacacacacaaaaaaagaagaaaatgttcctgtggaactcttaattaaaatgtatgtgcccatcacaacattaaaatatattccttactatgggacaaattaaaaataatttcaaaaataactgattactgaagaaaccaggcacatctaaccatttacaaagaacttttacacaattggttttacagaatccagaaatcccaggatccagctatcattattatgccttttttcagtggttcggagatgtggctgccttgttcaaagcaacacagcacggttgggatgtaatcgcagatgggtctgcctccagtatgtcctcaagtaccacaggaggtcagagaagatgatggtgagcaatgagggctagacacaaaaggagagagaggaaacctgaaaggggcctggaaaggcagggaggactttggccagggcagtgggtcagagaagtagaaacgagttcagttagttgttggcggtggtggcggggcggggggcctggtcaggcgagtgttcagtccaatatagccgtgggtactggaagttcagagcagactaaagggattaaacagactcatctggtctccatcagtcctgagacttctctagcctctttgagtttcactttcttcatctgtaaaatggggatgacaacaggatctacttgaaaggactaaatgaaataatacatgcacactgcttgggctcaatatatgatagcttaaaaaaaaggagtcacatcacctacgcagaatcttgcaccaatagagaaaatgaacacttgtcactgtatttggccctcacaacaatcctatgagataggcaagatgggtttttagagctcaggaaactccagcagacagacagaatgacttatgctggggcttctgacccagtcctcttattccacagggaaacaagtagaaaataagtctggaggccaggcacggtggttcccgcctgtaatcccagcactttgggaggccaaggcaggcggatcaagaggtcaggagatcgagaccatcctggctagcaaggtgaaaccctatctctactaaaagtacaaaaaattagctgggcgtggtggcacgtgcctgtagtcccagctacttgggagactgaggcaggagaatcgtttgaacccagaaggcagaggttgcagtgacccgagatcactccactgcactccagcctgggcgacagtcccccacccccagcccaccaccaacccaccacaaaaaaaagaaaagaagtctggatcactcagggaggcagacagaggacctcagaggctaggcaaagaaatttagactcccaccaataacagttagggcttaaaagggttttgaggaaaggagatggtgagtgagggagagaagatataaaggctttgaaataaagatagcatactgctcttagagttaaactttaaaaagccaagacatgcaaaatcatcctggagaaacagctccaagccctaaagaattgaaagtattatatctaagggtaagaatgtcaatcagaagggcttggtcagatttgaaagtggaggaaagcagatagtcaaagagaacagcaatggccttgccactcccagcaatatgtagtgagaaagggcctgaggcaacctcctgagccttggagggtcaggacccactggcaaagtcagcctcactgtggagaaggatgcaggcagctgaagccaactcacttggggtattcccactggcaagcctcctgactgtgaaatggatgcctcggacttaaccttgatgccatctgacacttcacttctctttgtttttattccataccagccaagtaagcatctgattatgatttggcttcccacgaaggcctgactacaggaagaaaatgtgtactagatgttcccacaccagaatcccaggccatgaaatggaaatagaaacagttctattctcattttaaggcagtaagcagacaatctggttttatatatccacttcctgaactgggataacacgatggagagattagctctggctaggctcataaaatcagtttctaagccttggtcctcaggggaccaaggatgtccactggaacacaccgccctgcagaactccttgggaaaacccactctgaccatctgcagggacgtcctattagaagggatgtgggaggcagcctgatctggctgcggcagagtgcaggatggctgggggtgctcgtgtcagcaagctagctcacaggctacagacataaggtgaccaacagtgtaaactagagtagaggcagtaggaatggagaaaaacagaggaaaatacaagagacactaaggaagtaaaagaaatgcaaagatgactggagtttctatctctgggactcagagtggggcccccaccttggcaagacagagaagaaaatttgctgaacctggatgtgatttgagatatgttcatttgagatgacaccatcaaaactatactcagtccaatgactggttgggaccatgataggaccatattcattagattgcttggtcactctattcatttcacaaacatttactgagtgtctacaatgtaccagatattactctgcctgtcactagggacccctgccttcaaggaacttacatggtccagtggtgttggcagagaggtcaatttactatcatagtaaatatagtaggttctatgatggggatgtgcacagagtccaaagggaacatctaaaataatgaacaccaagagagagagaacaaaactttttcagccaaaggaaatcaattttctttaaacagaagaatcaatgttatcctttcatcttcttgaagttttgaattcatggaaatgttgatttttaaatcaaacatcaaaatcctatctaattttacttcctttcaccctataagtggtaaaaaacaaatagcaagaggactgaaaaatactcttagctgagagattgcagcaacacatgtagaaactcccaaaaaaataaaggtacatgccagatctgtgacagcccacagaaaggcaaacatctagtacatgggccaaaaaccaaaccatacgtaaggcactgcctacgtaaagaccacagattcattcagtttcatcatctggcacaaagtttccaaactgcaattcatattaacaattactttccattgactgaaaatttaaaagatcacaaatgacaagaaaggtaaaactagagaaatgtgccttgtctatagggcatatataaatgctgactgcaaatttcagcacttagcaaggtggagggaaaaaagaaaaatgccacgtgaaaagacacaaacgcagtgtctgagccagcttagagccaggataggttaggcagagggaggaacagaaacagagagagatggactcaagaaagtatccacatgaagccatatttgcctttgagaacctaatgtgacctaagcccttgaccaggtaaacgctctcccattttgccatctctcctctttcatactccaccccacttatgtccacatcgcacctcctacagacctgagccaaactggctctgagcaacgcgtgctggggcctcacctaccagtaccctgagaaggcctgagaacagggcctctcagggtgcctgagaggtggaggttgcagcgagccgagatcgcgccactacgctccaatatgggcgacagagcaagactctatctcaaaaaaaaaaagaaatccatgtagtaaaagttactgtaactcactcagaggtcaatggaccacttgtctattttcctcattctagcaagttctagcagccctgatcatctggctttcaaatcaaaggcttattataaaacagcaaattcaaaatggagatgggctggccactagccctactgacaaaagcaaaaccagacagccaaggaggggacacacatcacataaagggcggtgtgaagaaccgcgtggaccctgaagtccgtggccactcatggagggcaggctgcacgggggagcgcagaaggggctgctggcggggaggagggagtctggggaaaggggaagtgcacagggttactgcaggggggtggctggcaaaccccaggcagcctggagcattgcaaccaacaagaagttctcccacaaaccgttctggcttttttttttttttttcaaatttacaatgttagtataatgactaaaaacagtaactaaaagcactactaaactgataacagcatttttattataccattctgggtgaggtaagtaaaaaaaaaccacatactgtgcaaggttaggaaaatttgacatcagaaagggggcacttgtgtgtgtaaaggtgaggagctacccatacggtggaaggttagccttgaggctgacaaacctggatgcaaatcacggctgctcctctcagctgtgtgtatgtaaaatgggcatcaaactatctacatcatacgattttgtaaaggaaaggacccagggcagtgaccatttcctttggtgaattagtttgttcacacgttcaagaaacaagtaacaatatgtactaccagacattgtggatataacagtgaacctccaaaatttctgctgtcaatgatattacagtccggtggtggagagagacaagaaaaggcaattacaatataatgagagagacattttatttatttatttatttatttatttagagacacagtctcaactctgtcacccaggctggagtacagtggtgcgatcctggctcactgcaacctctgcctcccgggttcaagtgattctcatgcctcagcctcccaagtagctgcgattaccaccacacctggctaatttttgtatttttagtagagacggggtttcgccgttaacaattttttccaggctagtctcgaactcctgatctcaagtgatccgctggtcttggcctccaaaagtgctgggattacagccatgagccaccacactggggcagagggacattaagaccgtaagcataggcacaatgcactctagggtccctgaccaatctacaaacagggagaacaaagcctggacagtgacacagttgtgaagattaaagagctttaattaattcccacttacttcagcaaatatttaatgtggctgtgtaccagcactgttctaggggccagggtcacagcacagaacagactgagaccgctaccttcatgaagcttacgtttgggaaagcaggaaaagtaagatcataaacactataaagcctactacgtctcagacattctgttttcagagggcaaggaagacttcagaaagagttcattcaaagtgattaaaagaaaaacgtttatgcttaatgggggaacccctcagctatctgaaaagttagctgtccaaaataacacaatcctagcactagctgaggttttagtgtgctccccttttaccttcttgacttccttttctcttatacccattaaagtaaatatggagatgaaaagatgttgtaaatacatttccctcacgtagcacctcttcctcattcacctggaacatgtttacctagtgtgacaatgaacagtccagattgtctaactcatgagaaagggccatgtcacaatcacagtgatttgtttaaagaatcttgcccactgcataattagcctgtaggtcaccatctgtctctaagtcctcataaaactaaccatatgttgttttcatcaagggctgaacaaaagtaacatagacccttctccaaggaaaatgctacacgtttcttatggagaaagaggatattgagagaatgcttggcttcccagttattaatgcttggcttctcagttattaccatatttcctttatatttagaaaatttttattttgttctgttcatgctttgaccatggctattaacccaagcaacactaacaattgctagaagtttctgaagggggctcttctaggagacattgggtaaataggcttagggcctccaaattttatttttcctctgtggtttgacctcgtaatatgaagagaaaaacatacaagcaaatatatcttataaacagttctatctattgtccattgcatttaaaaatgcaaactcatgaaataacaactttttaaattttgtattttgtacagatagagtctatgttgcccaggctggtctcgaactcctgcgctcaagtgatcctcccatcttggcctcccaaagttttaggattacaggcttgagccaccatggcccagccgaaataccaacttttaaatcatagtaacactattctaaagtagataacaactacaagagaatctaaatcatcacttgaaactgtttgaaaactgtcatcgaatactattttgatttatgagagcaagaattctcaaactgttaagtactgatcttctcacatcacccaccaaggactaaacaatcttaataagaagcagaagtacaaaatgttctgaattttagtttggtttagttcattttttaaacaaaatatggataaaaattatcccaaaaatgtacatacagcttaaaattacatggcagggaacactgaagcatttaggtaactcaggaatgttagaatctcatggtacaagtggatcattaacactgctcttatgatgcagagaaaccagttcatcaactgccttccctgagggcattacaaaattaatctgatccttggtctacagattcacgcatcaactgtatttacaaaactggccacaatgtcatcattttaaaaaggccaagagtttcctacaaggctaatgatcccatttggcctgggaaagtatttgttgaactgaattgaatggtgcagagaagggaattttaactttccatatatcctgactcattaatcctcaagttaacccgttaccaaaaacagccaacctctcaaacctttaaaggtttatgcgcacatcatatttcacctacttactgaccttgaattgcatctcttcattttttctaaacttaccaacagttgatgggcagggttcctcgtcatagagtttcactaaaggtttattttaccccctgcactgagagcacttacctttctcacgtgtgtataatttaagcctaattcttacaggatatttaacagttatccctcagagatcttgagcattctcctagagacctctttaccttatggcactaggtcttacaatgaatgtttccagtctaacagggccttgatcttcttagcataagctgcagtgcttcatccaagggccctatcaaggtttctccccttccttccacggcaatgtcctagggtgtcacaaagaatagtaacagcagcgtgatctaagggcagagagacagacctggcttcccatcccggctcatacacttcttgcaatcctggtttcaacttttctaaatgggaatgccatctcctcacccttattcagggtagctatgactattacctaaaagcacgaagggtgcctagcgacggacctgatccccaacagacacatggtaaatggcaacattactgaagaagttagaggccgctctgcctggtgaagtctgctttttgtaatccatttaaatggtctttgtccactgtccaatgcatttaagtcctcctaaaaaagaaaagggcaccacgaagattaagagctagccaggtgaagagggtggcagctggaatgttctgggccacaggaaaagcacagactccggagtgtaggagctgagaggtgcagacaagggccagagccagagccagagccagcacgctgagtggagaaggaaacagagtcttgtgaatcccctctgcaaggaacacctcatgacacagggaaagcttacaatgtagtggcaaatttttaaaaataaagtacaaactcaacatgaacaaaatggatccatatatacaaatatctggaaaacaaaaaatatagaaaattatttaaaatatgtaagtcatcagagataatcgctactcacacacacattctctctcagatttatacataggctttctgaatttttcacaaaagtatttgagcacatagtatatctctaacaggctggcgggctcttttttttttttttttaaagcccatactgtcagtctcttttcaatgagacaatataactcctaatctttcagatctaagctcttcaatacacatactacctgagaagtttgaaagcccccagtgaaccttgttccccagctctttctgctgattcccttctctctttctgctaacgagacgtctgtggttatttactgggtaatttcaccagccagaaccactggggctaatccaagggtttcttttcctcagaaacaaaaacaacagcagcaaaatctccttatttataatattcaacacctcccacaacagtcacataatattctagaaacttttcctctttcatctacaatatcctgaatattgtattcaatgccattcccatccatctgcgccccccaccccacaaaaaaaaaaaaaaaagtggctgggcgtggtggctcacacctgtaatcccagcactttgggaggctgagacaggcagatcacaaggtcaggagatcgagaccatctggccaacatggtgaaaccccatctctactaaaaatacaaaaaatagctgggtgtggtggtgcatgcctgtaatcccagctacttgggaggctgaggcaggagaattgcttgaacctgggaggcacagattgcagtaagctgagatggcaccactgcactccagcctggtggacagagcgagactccatctaaaaaaacaataataataataaaggttattttatgtcctttctcagcctctgataacttaggttattctgttgctttctggatattcacattatttacaagaaaattaaaaaaaaaatcaaacagtattaatttcctctttccccctcaattcatgtacacaatccactttgccaacatattaaacttcaaatgtttcaattaactcaaaatcaacctgcaatgttacaaaacttaaacttacattgctaagtctacaatcaccacaaatattgcctttttcaaaaagggaaaatttttaaaaacatagttgtatatcaaccaaattagattgtctgaatatgttgatttttatctagatattttgatttaaaaaatgtcatggggccatgagcagtggctcacacctgtaatcccagacaacatactttgggaggtcgagatgggaggattgcttgaggtcagaagttcgagaccagcttgggcaaaaaactaaaaaattagccaggcgtggtggcatgtgcctatagtcccagctacttggaaaactgaggatggagggtcacttgggcccaggaagtccaggctgcagtgagctgtgatgatacctaggcaacaaagcaagaccctgtctcaaaaaaaggccaggactaagaatgatttttctttcagcatacacctatttattactttattctgtttgtttgtgttgagacagtgtcttgctctgtcgcccaggctggaatgcagtggtgcgatctcagctcactgcaacctccacctcccgtgttcaagtgattctcctgcctcagcctcctgagtagctgggactacaggtacccgccaccacatctggctaattttttgtatttttagtagaaatggggttttgccatgttgaccaggctgatcttgaactcctgacctcaggtgatctgcccacctcggcctcccaaagtgctgggattgcaggtgtgagccactgcacccggccatatttactgcattttattaagtctcccctcctggtattcatggaaatagaaaataactgttttatattctgctgaaaaatgaaaccccaatctaaaactcaatttgagaaaaaattattcatacttctctctcatatttctgttaacagagaagccagaagcagtgccatccctactttcaaccctaaggctcacacattatattaaagttttgtgaagtacctggcacttctcatgcagaagttactgacatactgatttaaaatgtttaccacccttaaaatttgccaagaaacttgccaaccagaatctttattgtttccccccctgaaactccaagtcccctcatcatttgccttctcccagcccagagacatctacctacctttccctcacagcatcgctccataattgacctccagtgaaggacctaccattacataagtgatgtcatttgccaacaactttacctgtggtacctatcagggtccgtttattttggacctgtactgtatcaatttttgctgtttatcacatttgacaaaagtgtcagcaagtagaaagcagcaatgacgaagccctgaggaaaactggaacaccccagagaaagaaaagagaagcaatgtcacatggcctttaggagcactggctccagagcctgactctttcagcccaaatccagttctgctattcactggctgtgtcaattggctgtgtgagtgactttacctctctagaaatggagatacccataatactaatccttagggtgtttgtgataatgaaaacagatcaaggaggtaaactgggtaaagtcctcagcacagtgcccggcacatggtaaacacaataagtattagctactttttagagatctgtctaccaattcaggaattaagaattccctcagagattcagcattattaattataccttaaatctgtgtgagttggcagcatcacattagatcacaagattcaacacacatcctattttttggcacttattaattctggagagctaattagaaagtgaaagttattttaggaaaggaatgcaagcagttatgcagaattaatcaattatgcaaagctgtgtggtcaggacacagcccaagtctcacagaacctccccttgagacatgaacttgcaacatgaactggaaaccccatcacctttatccctgcagagccaacacatctgtgaaggaattcattcacggtacccttaaatacttacatttaaagtgaaagtaatcgtggaatgatattcagtttgtctattcacagatgaattcctcttagctcttccccaaataataacttccctagacttttctccttctttcattaagtatttattagtatttattttatttttttgagacagagtcttgctctgtcgcccaggctggagtgcagtggcacaatctcggctcactgcaacctccgtctcctgggttcaagagattctcctgtctcagctacccctgggattacaggcacacaccaccacgcccagctaatttttgtatttgtagtaaagatggggttttgccatattggccaggctgttctcaaactcctgacctcgagtgatctgcccacctcggcctcccaaagtgctgggcttacaggcatgagccacctgtgcctagcctattagtacttattatatgccaaactctgtgcaaattgtctttggcactattctcttaggtagacagtgccacttttcctccagatccaaagcagactctcccacctccccagtcctctcagccaccttgggaattctttcctctaagttacatatgacacctccctaaagcacacctcccactacacatgccaactgaaagcttctatagggtaacaatgatctattttttacctttgtatgccccacacccttgactgcactagcctgtgtgcattaaaacatagataaatatcccccatgtagttactaataccaaggaaataggaagacgtgctggatggggggctctggtgggtggctgtcctccccacaaagctgttagagcagaacaggtgctacccgtacacctccagaaagggcatagtcaactgcaacacagcatccacaaccatcctccacccccaagagcccaggctggccgtcacgttctcagcttcacttcagcatcttccagcatcctcaaacacgctcttcttcctttatcaggaatgccatcaatcttcatcacaggaagagaaacaatactcaccctccacaaacctatgcccaagtgcagcattttacctataaaccagagcaaggtacatttctggagccctgtactattcttttaggtggacagtgaataagctgagagagagttaatatcaacccatgcaactgtacaggaaggattcatggttctgttttttaaaaagagagagagagctgagtaaatgagtgtttaaccaaaggacagggctctgctttctattaagtttgactattttttaaccatttctttgaaataacattgttattatttttcccactaaaattgtaagataacaaggcagacaagaaaattgcgttacaagaatgcacttcagcattaaggctttcacacacagctatcacttcccattaccaatcctgcttttcaagagtttctctaatcccagctgtcttatgcagcattaggacagttgggcttagctatggaaggcgaaagctcctgactcctttattcaagccagatcttcataaacaatgtgaaagagacaaaagacagcaaataatttggtcccaattactatatgaaaatttatgtgaaatttttcacacattcatattagatgctgaatagattttttaaaaccctatatacccaaaataatgtttaaattatcctctaaaagaatgaacgtatcatatatatgactataatagtaactgttttgtgatattttaacagtactcaacagctttctcttcttattagtgattctctccatgttttcatctaggagaaaaccttccatactcattagtggagagaaaatagatatgttagttgaaaccaaaatttccattatcttctttaagcaaaataaactcttgcacaccaacattataaacatgaacacatttatatgtatgtttcacacacaaagtctctgagaaactattttaggatgtggccacccaccatatcaggtcagtgcagatgggggcagatgatgtggactgcacagttgagtccatctgaccccaacaaaacagttcatagaaacatcatctgactctgactgctctatcccagcgaggcaagttgtccagctgaccttttttactcttatacacactgtggaaagatgagggtaaaattactcttggctcagacttccagggcaggcaggaagccccatctacaccagcttcaatcttccttcacagggaggtgggtgatagtggaacaagccgacctggaaaaggtttcccagagagaagtcagcaagagaagagcagacaccagaataccaagatgatggccttgaagtccaagatgaggaacaggggagaacaaacaattaaaaggaaactagggagggtgtctaatgcattcataaagagagttatttatttgattttaaagccaaaccacagaatgtttaataatttagcatgaaaacctgtttttttattcaaaaatgagaaacctgccactgagactatttataatgtcagccaattggagacccgtacaggaagaagacagtttcctctttgctgcctgggtaggggctacaaaggacaaggctgacagagtctgattcctatagtcttttccctctctaatttctgtggaaaacaaaagattctggctagatctccactttctcctctctactgcctcttctcaaaccactcctgttttggtcaaagttaataactccaatctgaaagcacaggctgaccattagaaaccccagagtcaatataaaggggaaaaaaaaattaacgggaacaatctgttggcactgagaggcccaccatgcactgatataaaaactagtactcatttgggggaatccctccttatttggctttcattttctaggatttgtgcagaataaatgaccaaaagatctttgaataacaaataataagaaataagtaaattacagaagtgaaaaagccattctgaacacacagcaaaataccaattgaggaccggtggcttggctggaaaccaagcttaaagggaaaaatctgatccacctcagaactccctcacttctattaataatatgttttaccaacccagctgtatcactactagatgcaaaaatgtataattagagtcaggaaaggtaaaaaatcaccttaaggaaactctatgcctcagcactttctaaacgcccctgtcttctaggcaactctgctcttgtctccttgttcttttatctcaatcttgacggctaatccctctgcagggtattaattactctgtcacaattacgttattccacaaacaagaaaaacataatacaatgaaatccaaaacggattaactttttattgattgtattaacaacctaatattctgtgattgcaccattagtacacattttgctgcacattaaaaagaaaagggtaatttcttccctttgtctctgatcagcttaactgatttttttaaaaaaacaccagaaatatttcaaagtaacctgcgcagccagtaatttgcttatagatgtaatttttgtctaagagaccctctgcatgaaatcaaatttcattagactgactagaagttgaagtcacttaggggtatacagtaaatgcacctgatagcagtaacttaagcgtactcttaagaatgattctgtatggcagatgcccccgaatgtgttcagagttctgagctagggatctggaagtggccaccccagagatctgttccttgtctatgaggaacatctgagctcccggcccatctcttgtgggacatgggctgtagggaaatggaggccccgagttttggcatgaatgaaggttgccaggtggaatcgttaaacagagtactaagtgaaaatgcaatataaactgcatagcttttgcaagtgattgcggttctcttgtccagcgcatagccgctgggccctctcccctgtatgtaagcccccgacgcaaccgcatgttgcgtttgctggctctgggtcacttcttcagcctcctgaacctggtgccatccccactggagctgacggcacaacagggacccagaggacagcagctcagacgctgaccaggatgctgagccttaaccactcaaactgaggttctgtctaggattaagttcacacaaaactgcaaggaaaagaaacgcccatgacatgtgcactaataaagaaaatgacatagaaaatcacgcaaagagatttgctttccgttttgacagtcaaaacaggcatttgccacacgttgacttgccacagatgtgagcacaaatctcatctccaaaaagctcactgtgatctaaacactagacttcaagtcacaaatctcgtggcaaataagtctgcagaacaattgtttgaggagttcaagctgcttgaaaaatgaagtccaagatatctttctaacagcttattttccacatcactgaagttcggagatggattcatacactaagttcttcctcaatgcctccccagcactgaccccactatattgtaaacatgtgcccccctcattaaactgcaagctccctggaggcaaggattatgttgactttgttctattaaggcacttatcactggaaagaagaaaagtgagcttggtacccacaaaagatgtcaaatagctgttatgagttgtgaattccctttgtcagacaaaaagcaaaacatattccttggtaccgtataaaagcactggagggagggaaggcagatatacttaccattagaaaatagaacgttgtatttatccatacatcactcacctcctaccctcatcccctcaacccaacttcgacttgtcaactgaaataacttaaggcaaagtgggttggaagtcaaaactgtgtatgtgattcctctattttctacctcattttatcagtttagtccgatattttcacttttattcttaagaatccagaataattttccttcattttgtctcccttttttaggcccacttatttattgatataaagcctttcatttttttaacttttaaaatgcaggtttgttacacaggtaaacttgtgtcatggaggtctgttgtacagactgtttaatcactcaggtattcagcctagtacccattcgttgtttcttaatcccctccctcctcccaccctccaccctccaccaggccccagggtgtgattgttcccctctatgtgtccatgtgttctcagcatttaacgcccagcctttcttatatcaataatctctaacaggcaaaacagaaattccattttgatgattaaaaggaggaagaaaattaacttcatggtcctgacccacgttcaacttgataagagaggagagagcactgtgtgaaggcaagagctggtaagctcagacaacagaaagaccgggactaactcctgctcatcacttcactacacggccttggccatgctgctgatcttcacagcatcaggttcctcatgggtgatttgggaatagcaactggaccaagcctcacagggtgagaaagaagaataagtgagagaacgcatgtaaagtgcccaggaggagacgtggctcctgcacctgtgattgctattattcattgcttccccactccctcttcccatctgacatccactacacagtcaatgtagggttttgtgatttttcacacaaatacagagaatctggaactttgccatgcttgtccctggctccccctccctctcccactcccaccttccagtctcaaataaccccccattccaaaggccaggggaccctactatataccctaatgcaccagagcttgttttgaggaaaataagaggtgagatttttacggagagcttccaaattattttttcaaagagatgcggtctttctttgttacccaggctggagtctagctcctgggctcaaaggatcctcctgcctctgcctcctgagtagctgggactacaggtgtgtgccaccacacctggcctgaaatactcttactaaaataaggacacttgaactaatgccatcttatgggaaagttattcaatcattcccattatatgcaagcagtgaaaatactcatttctttttattttaaaatgtccagttactgaataagcatatatgcctaagtattactgaggtcagagattgcgtacaatactcaactctgtttcccaagcatgttcacagtccatagttgaatgagcaaacaaatacactgtcagtgcttgagtcagcaggtaagaaaacatttacaaatgaggaatgaatacacaaaagtatttgcaaagatattacacaccatcttctacttatatatgtagactttccagttcaaagtcatgcccaaaatcctgtactgtatttgaaaaatcatttccttgctaaaagtctctttataaagactctgtgattgcctcaggctaacttgttcttatcccaagtttttaagaggaaaaagcctaaaagacattttatctcttcatgcaataggcctatcgccactgcaaagcatggtaaaaggaacttcagaaaagatggagtgaccaagagaattgaatgtgtcttgaatgagaaggcacaatttatcctcagagtgctcaaagttccacattcaatctaattccttctatccacaacaaataccactaagaagggatttaacatttgaggatacactgtgtcctccttccaccgcttcccaagtaagctggctggtggctggcttaaagagaatagcattcttctcacaatttcttcacccagctttacctctgacagaactcaaagcaagtgacttatctgtgtcaggactaatgttgaaagagcactagatctgcagtcaaaaaacctaatttttaaaaagttttttcaaaattcttatacatttagggggtacaagtgcatattttctggtgtgcatatattgcatagcaacaaactctaggcttgtagtgtacccattacccgaatggtgaacactgtaacaaacaagcaatacttcaacgttcagcctcccacctttggtagtctccaatgtctattattccactctctctcttttttttttgaggcagtcttgctctgtcacacagactggagtgcagtggcgcaatcttggcttactgcgacctctgcctccggggttcaaacaattctcctgcctcagcctcccaagtagctaggattacaggcatgcaccgccacacctggccattttttgtattttcagtagagataggttttcagcatgttggcaaggctggtctcaaactcctgacctcaagtgatccacctgcctcagcctcccaaagtgctgagattaaaggcgtgagccactgcgcccagcctattattccactctctatgtccatgtgtatccattgtttagcttccacttgtaagtgggaacatgtagtattttactttctgtttctgagttatttcacttaggataatagcctccagttccatccatgatgctgcaagatgtgttaagaagcctgttttctagtctagactgccccaaaccagatggatgcccttggcaatttatttcacctctctgggtgccaatctcctccactgtgaaatgagacactgtagaagatcagtaaagttccttgttctcccagaacttgcaggctacatattcaggtgggaagatgggctgaaattttgctctctagctgctaactaaatcgtatttttaaattctgcttctcagactcttgaaaagttggcctgagaacataagacaccaccaaacaatctggaagaaccagtgctattacaacaaagcaatgagagagtcaagattccttaaatgtaggtctggaattcaatgtcaattgatagctgatccttttcatgccagtgctgccaaatgtaccaggaaagttctttaaaagcagactgaagttttaagagtccacactattattttcttcttaagtctaggtaaaatcccttccaattagtttaaaagtagtattttgaaaatgttaccaaaataatacatgtttctcactttttctccttcctctcctttttctactaacgactgaagacattttgggacaatctaacctttccccattaactgacttgtctgtgtgaagaaaccagactgcagatttgctgttggccttgtgtaatttctgagccagggcatggtttccaaggtaacaagttaaaaaaaaagaaggcacaaataggtctagcacatttaatatgtaaatgaactaggtcactaagtatttcactaataggcaagatgatagattaaacccttctattctttttcctccatttaccctaggaggaatttatttggggcttttacagcagacataatgattttcctttggcaatgcagtttccaaaatacaaaactccaaagagagtttgttacagttaatcaagcgaaaagcagcttctgttgaggaatctaaatggagaaaggagagggggtcctgaagcactgaatctaattctagacacttgtttttgcagttctcttacagataacacacaatagcgtgcacatgcacccttgccaactcttcacacagtgagagttagagttcccattctcatattcccaccaagccagcggcatgcacaagaaactcacagttctgaagctggaggagtgactttggcttccaaagggaaaaggggagccaaagtggtcgtgccctgtcctgccccttggacaaaggcagggaattgaatgcaccggcagttgggaggcagggtggggcaaaagccaagggtgagggctgagggagagcagcttttccttggatggacatccttcgatggccagcatgcagcgcagccatcacacatgccaagggctgcttcccagcctgccttcaggaaaagtggagggcgccaaagaagggcattcataacaatgcagtaacaaaagcagatagatgctctgggggacatgggcagagaagaagcaacagcactgtgtgtgccagtgatccaattagaaagcccagcttccacacgcaggctgaggcttccacagcttaaaccccgtggtatccagacaccatgatttctagagttcttagttgcagacaaagccccactgtgttttcccgggtgaccatgctgccaatttgtctcataccttccaaagaagcctaattattagcttcttcctcggctgtctggctttttcttagctccatgaagactgaacatatatttcctcctctaaagaaggtaggcagggttggggaagacaagcaagtctggaacagaaactccgcccatccataccccagtgaagcaaggcacatcgccatctccataaacaccaaggtgctggccgggcgcagtggctcatgcctgtaatcccagcactttaggaggctgaggcgggcagatcacgaggtcaggagattgagaccatcctgaccaatatggtgaaaccctgtctctactaaaatacaaaaaaattagctgggcatggtggtgcgtgcctgtagtcccagcttctcaggaggctggggcaggggaatcgcttgaactgaggaggcgaaggcagcagtgagccaagatcatgccactgcactccagcctggtgacagaacaagactccgtctcaaaaacagcaacaacaacaacaacaacaaaacaaggtgcttggatctggggccccaaaacctatccaagttttcaaataacagttggtctcttcggcatttccctgaaggtgttcactacacttcttgccctgtcctttcactttgagttcctaaatgaaacccgtcgtcggccatcctcccgccctgcacagtctattctgcaaactagatattctgtgtcacacttttcagagtcctttcattttcctgttttgtaaaagtggttgtgtctcggaaagttaaaacgaattaacttcatcatggcctgcaggatgaaagagataaaatgaaaaaggattaggctttcaagacatcactgagaagccttttaaatgagccaagtgtgccgatgtcacatgaatggggtggccagtaacagagaccgcagaagatcacagaaatctgtttccaccgtatgtttcgctaagtaaagaaaggacagtgctgggtgttaacttcggttcaaaaaaaaaaaaagttaacaacatcccttttctgttcccaagtctattacttctaaaaaagatattttaacattatcactattttttaaagaatgtcttttctcatcttttgctttgaatatatttaatataatttattctctcttcccataggtccttcatattatttccactcattattgttgaaatcttccagttttctcattattcccaatgcttcaaaataaaagagaaatttagtaagattaaataatggaaaaaggaagccaaagaatatccagttacgatgttcaaagagataagctggccctgaggcatatttatctgtcctaaaagaacttcaccaaagagaaatttaagctctacaataacttgtgtgtggcctagaagacttcaaatgttgtttctctaatgtgaatgttgaaataatgtcattgagtttacatttaataacatcttacgtttgcagagtgctttgttttttaaggtgtcttcatttataacatatcattttatccttttgataaaaggatagattaacaaccctagaaagctggctagaaattaagctatgattactgcattctatacatgagaaaactgaggcccagcacaggttaagggcctggaaagggacacacagcagaaatgtgacagtgttggaaccagactccacactcctgatccctaatccagggctcctgcttcaacaccttcctctttgatgctctctacgtgtgaagaaagttcaccctagattagtacatgctggaaacaagtggaaacaagacctaggttatccttaatgccagacagttgtattctgccacactgtgaattccaggatagcaagcactggtcagcaaattggcgcaaacatatatttgcattataatatttcttatgggtcaattaatctcctggaactaagaacaatcctggtctggaagcatgactgagacccagatgtcagtgcttaacagctgcattactggcctgacttagagaagaggccggaaatactcccagagttgttcacttaaggcctgtgatgatggccctagcagacaaaggaaagggaaggagggcaattaccagagaacttaattccctataaacaccaattggagtgactgatgagggcatgaggggcacctttctttcctccttagcaggattctttacattaactggataattgcttcttttctccaactgcctagacccacaacccggaactggcacgccagctacgcgcagactaccagaattaggttcaaaacagaaacagcaacaatgtaattaagctttttacaaacatgataccatggcacaaaatttttcattaccttgtgttaatgaaaaccattttctctgaccaacgcgtaaaatgttggagcaaaataaactgaatcgtctatctggtgttgcagtgtcagtgcaggcctagcatgggaatgtctctgtggaaggtggtggggtttttctcccctttttctctttaaagaatctgctgagttatttcaatagcacttctagctctatttacatagtcacactacctctctcctgtgctgtaattacaggaaaggtgctaccaatgatcagatttactttcagtatcccatcctactgtacgaaattccagtcacatcactgcatatcacaaagacatgctgcaaaggtacacaacacagaccatgaaatgaaacggcactacccccacttcaaaaggtacctttaacaaaaaccatctgctaaagatggtcccaaactcttatcatctgattctcatattcaatttataaaatgaatagggtgctgctaggcatacaatttatgtgaaatagggacctgagccaggaagctgcccaataaaggaaggaaatgaactcaggtttaccaagtgcctatgatgtgccaggcacaacacctatgactctcacttatttcatctcatctaattttccagaaaactctgtaaagtggatattcccatcttacaggtgaggacactaaggctcaagagatgaattggccaggcgtggttgctcactcctgtaatcccagcactttgggaggccgaggtgggcagatcacgaggtcaggagatcgagaccatcctggctaacacgctgaaaccccgtctctactaaaaatacaaaaaattagccaggtgtggtggcatgtgcctgtagtcccagctactcaggaggctgaggcaggagaatcacttgaatccgggaggcagaggttgcagtgagccgaggttgcatcactgcactccagcctgggcgacagagcgagactgtctcaaaaaaaaaaaaaaaagagagagagagagatgaattaacttgtccgaggtcacagtgctgatcagtgtcatgttctgaacacaggtcaactgaactccaagactagtctattatcagctcactaagaccccacaagggtgaaatggctcctttagcctaattaccagcattaagataaccatccatccacacaggaacctgagaaggcaagcaggaacacacactttgggtacctgtaatcagtaaacctcaaagactggtgtgtacatcaagtaggaaaccaacttccctaactcttggttcccagtcatagcccaatagaaatgagcaactttgccctgccatgcttttccttttttttgtttttttgttttttttttttaataagtgaaaactgcttttatttacagacatattttttttaggtaggaagttctaaagtgtcaacaaaataacataccagagctagtaaacactttcaataagttgcagaatataccaggccaatacgcaaaattcaattatttatataagttgcaatgaacaattaaaaactaaaacatgaaaaacaataccattaataacagcacgcaaaaacctgaagtacttaggaataaatttaacaaagtacatgcaagaactgtacactaatacctgtttagataaataagacacttaataatacacttttaaattcattttttgttaagaatactaaatactatttatttgacaattatctccaaattgatctatagttattttgttcagtatggtatccatgagccacatgaggctactaaacacttgatatgtggctagtctgaatcttaattcagactaaggtgactaaggtgtgctgtaagtgtaaaaacacaccagatttcaatgacttagtacaaaaaaagaataaaatatcatatcaatgtttttatattgattacaggttgatgttttcatatattggggtaaataaaataattattaacattaatttcatggttttttttctttttaatgtgtctaccagaaatatttaaattacatgtgcttacatattttgacatgcattacgttcccattagtcatcatttatctataagtttaatgcaattccaatcaaaactgccacagggcttttgctaaatcttgacaaactataaaatttatgtgaaaatggtaagaaccaaaaatagccaaaagaatttttaaaaagaacaatgttgaaggacttatactcccttatttaaagatttattataatgctacagtaatcaagacagtgtggtatatggccaagagatcaatggaacagaatggagaatccagaaattgacctacacacatatcctcgatttttaacaagatatgatagtaattcaataaagaaaagatacacttttcaataaatagtgttataacaactagatagccacatggagaacaaatgaaccattacctttatctcatgccatacggaaacgttaatttgaaagagttcagagaactgttaaacaaagtggaagagaagccattgtttagggctgaggctgtgctctaggccccaaaagaccagacagaaccagtatggaatcgctcctgttcggtgccacataatgaaactgaacttcaaaatgagccagtattcaaaaaaccaggagattcacagcaaccaatcagaaagggcctggtttacctaactaagggatctctgttttttgttttttttttttttttttttattatactctaagttttagggtacatgtgcacattgtgcaggttagttacatatgtatacatgtgccatgctggtgcgctgcacccactaatgtgtcgtctagcattaggtatatctcccaatgctatccctcccccctcccccgaccccaccacagtccccagagtgtgatattccccttcctgtgtccatgtgatctcattgttcaattcccacctatgagtgagaatatgcggtgtttggtttttttgttcttgcgatagtttactgagaatgatggtttccaatttcatccatgtccctacaaaggatatgaactcatcattttttatggctgcacagtattccatggtgtatatgtgccacattttcttaatccagtctatcattgttggacatctgggttggttccaagactttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagcatagtttgaagtcaggtagtgtgatgcctccagctttgttcttttggcttaggattgacttggcaatgtgggctcttttttgattccatatgaacttgaaagtagttttttacaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagtaattgtgaatgggagttcacctatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagccgtgagagagggcatccccgtcttgtgccagttttcaaagggaatgcttccagtttttgcccattcagtatgatattggctgtgggtttgtcatagatagctcttatattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggttttgtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcatttaattgtgatgttagggtgtcaattttggatctttcctgctttctcttgtaggcatttagtgctataaatttccctctacacactgctttgaatgcgtcccagagattctggtatgtggtgtctttgctctcgttggtttcgaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcggtgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcgggtggtaccggttgttcctttccatgtttagtgcttccttcaggagctcttttagggcaggcctggtggtgacaaaatctctcagcatttgcttgtctataaagtattttatttctccttcacttatgaagcttagtttggccggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaaggcttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacatatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttactggctgctttgtttacctaagcaagcctgggcaatggcgggcgcccctcccccagcctcgttgccgccttgcagtttgatctcagactgctgtgctagcaatcagcgagatttcgtgggcgtaggaccctctgagccaggtgtgggatatagtctcgtggtgcgccatttcttaagccagtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctcctgttttttttttgagacagtgtttcttttcacttctgtcacccaggctgcagtgcagtggcgcggtctgtgctcactgcaacctccacctcccgggctcaagcaattctcccacctcagcctcccaagtagctggcactacaggtgcgtgccactatacccagctaatttttgtttttgtagagatggggtttcaccatgttgcccaggctggtcttgaactgccaagctcaagcgatccatccacctcagcctcaatctcccaaagtactgggattacaggcatgagccaccgtgcctggcccctcctaaattttttatgtgccttagtttcaggtatttgagagagagtctcattttctacgttcaaaggcaggaataacaggaacttcagagttattgaacataaaagactcaggagaagaggaaaatgcaccagaaagtaattctgttctgttgttatttatactccttaaacaataaaaggacaaagtttgccaaagagcaacaggaaaatcctgttaaaacatacacttcaaaaaatctccaagagctttctgaaaataacacacaatccagaggctatttagaaagaagcaaaatggacaaataatataaaagtgcgaaataacccccaatttcatatagattataatctaaaaagccattttaatttttttttatttttgtttttagagacagggtctcacagtttcacccaagctggagtgcagtggcataatcatagctcactgtagcctccaactcctgggctcaagggaccctcctgcgtcagcctcctgagtaggtaagactacgtgcacatgccaccatgcccagcaaaagtcatttttaaactggtcttttcaaacttggaaagtcaaatctaaagaaacaaggtcataatcagcagtaaaatttacaagaagcaccacaaatgtctttactttttaaaagaaactttttaaaaaaattcaactttgaggtataatttacataaaataaaatatattcattttgcattaccattaagtgtgttttgacaaatgcatccaaccatgtaaccatccccacaatcaaaatatacagcattcccaccaccccaaaaagttcccttgttagtacccccatgtcaaactccagaaaaccactgatttgctttctgtacctacagactagttttgcctgttccagaacttcatatgaatgaacattgtatgtggtcttctgagttttattcctttgactgcacaatttttctggaattcatgcatgctgttgtatgtatctgtaaatttgttcccttttgttgctgagtagtattccattttatggatataccacaatttgtttaaccattcactaggtgatggattcttgggttgtttccagtttttggccactgtgaataatgttgctatgaacattcacatacaagtcttttttgtggacatgttttaacttatcttgggtaactactaaatggttttccaaaataatcacactacagatatatcttggagatatgcaggttccattctagaccacagtactaaggcaaatattgcaataaagcgagtcacacaatttttttctcagtacacataaaagttatatttatactatactgcatctagtaagtgtgcaatgccatcatgtctaaaaaatgtacataccttaatttaaaaatactttatagccaaaaatgctgaaaatcatttaagcctttagcacatcgtaatctttttgctggtggggggccttgcctcaatgttgatggctgctgactgatgacggtggtggcgctgaaggttggggtggctgtggcaatttcttaaaataagacaacaatgaagtttgcagcattgattgactcttcctttcacaaaagatttctctgtaacatgttatgctgtcagatggcattttactcacagtagaacgtcttttgaaactggagtcaatcttctcaaaccctgttttatcaactaagtttatggaatattctaaatcctttgctgtcgtttcaacaatgttcacagcatcttcaccaggagtagacttcatctcaggaaaccactttctttgttcctccataagatgcaactcctcatccattcaagttttatcatgagattgtggcaatcaggcccatcttcaggttccacttctaattctagttctcttgctatctgtatcacatctgctgtaccacatccactaaagtcttggatccctcaaagacatccatgagggttggaatcaacttctccccaacaccagttaatatttatatttgtacctcctcccatggatcatgaaggaccttaatggcatctagaatgatgacttctttcctggttttcaatttcctttgcccatatcaatcagaggaatcactatatagtctatggcagcattagaaaatgtatttcttaaataataagacttgaaagtcaaattcctccttgattcatggactacagaatggatgttttgttagcaagcatgaaagcaaattaatctccttgtactataagagctcttgggtaaccaggtacattatcacactggaacagtaatattttggaaaggatcttttttataagcaataagtctcaacagtggccttaaaatattcagtaaaccaggctataaacagatgtgctgtcatctgggctttgttgttccatttatagagtcagcatcattcttaaaggccctaggattttcggaatggcaaatgatcattggcttcaacttaaagacaccagctgcattagcccctaacaagggagtcagcctgtcatttgaagccaggcactgacttctcctctctagctatgaaagtcttggatggcatcttcttccaatagcaggctgtttcatctacatcagaaatttgttgtttagtgtagccaccttcatcaattatcttagctagatcttctggataacttgctgaagcttctacatgagcacgtgctgcttcaccttgcgcttttatgttatgaagatggctgctttccttaaacctcatgaaccaactttggctagactccggcttttcttctgtagtttttttctcctctctcaaccttcacagaattgaagacagttagagccttgctctggattaggctcttgtttaaggagtgttgtggctggtttgatcttctatttaaaactttctccatatcagcaataagactgttttgctttcttatcattcatgggttcactggaatagcactttcaatttccttcaataacttttcctttgtattcacaacttggctaatggtttggcccaagttttttggtctatctcagttctcaccatgccttcctcactaagcttaatcatttgtagcttttgatttaaagtgagagacatgtgactcttcctttcacttaaacactgagaaaccattactcatcagcctaatttcaatattgttgtgtctcagggaatacggaggcctgaggaggagagacaagaatggccagtcggtggagcagtgagaacacacacatttattaagtttgccttcttacatgggcgtggttcatgtcacaccaaaacaattacaatagtaacatcaaagatcactgatcacagatcaccataacagatatagtaacaatgaaaaagtatggaatgtcgtgagaattaccaaaatgtgacacagagacatgaagtgagcacatgcgattggaaaaatggcactgatactcttgctccatgaagggttgccacaaaccttccatttgttaggaagcaaaaacccaaaaaccaaaaacataatatatgtgaagagcaataaagtgaagcacaataaaacaaagcattcctgtgattaatggtaaaaattaaaggttgacccacaaatgtctttttaatctgcagcatgtctgatacgatcactattggtctgataaggaggaagcctgtggtataagaaggttattgagaatttcctctccttttttggcaaaaccagaaacactttactcatttcaaaatttctttttgacaaagcctcacttacctctcttccactccctcttctccacagatgcctaggtactcacagctctcatatcaaccctactctaaatccctgaggaagctacagaacctggcctaccctcatttgaagtgttctgtttccaaaactacatttttctcctttccctctcttcttcccctacaatcaacgcttttgccctgcgacagaattgctcatgcagaagattaggaaagcaagctgattaaatagacatttatgcaagggactggtaacccctttaaatgaagatgctcaaacacgggtgcaagagatggctgtctccataattctacaatgctgctcttcttccaaacaggctcctaacacatatgacatacagcaatgcaataaagtgaagtgaaataataccaggtataatagcaatgaaaaagtttggaatatggcgagaaggtggctgtatgctgtaaagtggggaaaattttactttaccactgtagtgtgggaagtttactgtatttacagtctagacctacctagccaaattctctgtccctcaatgttatgcctgcttttcacagcttctttccttcttctatacctttgaactcaaaaattctcaaaagtctcaggttcttttcattagaacccatagtaacagtggtggcaaggagatgtcatttgtagactgcatatcgccatctgtactacagtaagctctctaatcattttacctactagttcctttagactcccccctaccaggcactttgctttacagctttgtcaatcctaggaacaaatacagacatcctttgctgaggaacatctccccaccatatcactgatatcacacatgttcatgatgttgctaaaggacatttaccctgggccttttataaaagatcagatttctcaagtataaaagcaattttgctatcaaaacaaatctgttgtcaatacattttgaggctaataccatgattagttggccagctcaaactagcgcatggaagaaaaacaaaatcagtgccttggatacaccaatgccactgtggtgtttgtcttctgctatctcaattcatgggaataaagttacccagagagcttacctatcaggcaggaactggacagaacagttgtggcctatgcaaccatctcagagtgttagtggaacacacacactcaagtggatcagaactgtctcaaacaatataaatttaatgtggtggttgatcttgctgtgggttacagatgctcatctccttcacaatggaaaataaaattggtgcccacttcagctcctcagcatttcttatcttactctctggctacttactctgaaggctgaaaccagctccagtcatcagagaacagaaaagccacaaaacccctctaatcacttccgagttatgcagactctaagacagcccgatcctaatggacacttgagaaacaactactttcttgaatttctggaattactttggtcattttgaacgaccgctctattggactgccatttccttttccctgtttgatgcttactgaacctctggagtgtatgaaaacaggctgaactagcatgaaaaaaaaaagagagtatcagtcatttcaatcacgcagcactgcactgaggtcttggcactctgtgatctcgtagtactgcagcacccagtaaactcattatcatcactccgggaaatgaagccaaaactcagttcatgtaactttccccatcaccaatcacccaggcttcaaatatgttctattctttacaccaaacccctaaaaaaggggtggttattttagtcaattcccgggctttgtgaagacttctttccacagaaatgaatgctttgtaatgctaagcagattcttacactgaaaactgttctaacatctcgtcatcaaaatgacagagccactgcatccttgacacggtgctgttctggaactgaattggtgagatgaatcagcaatgaactgtcttataaaacagctaacatgacatgatatgtattaatgggaacaaggcacgcaaagactatgaagtaatgtctttaccattatctaggcagtagtgggatttatacttgaatactatatttagtctgaggtttccatttttaagatgtacgaacaaactagaataagcccagggggcttacatttagagaaatatctgttcctaagtgtggaagaaaattttacaactacaactaccttcatacccaaaaagagggagagagaaaagagaatatttactgagcacatactacagtctcagtactccttatgtgactatttaatctctaatacaaccctaaagagcaggtctcatgccatttgtcagatgtgaaaaccaaggcttggagatgttatgcagcttgctcagggacactcagctgagattcctcaacccttttctcccactcagacttcactcttacaacatccaactgctaccaggcactgtgactcagtagatcccaaactgaattcactcgctctacattttaaattatataataaattaaatacaaaataaatatttcagtatttccatgaaagaagtcagtttgtgaaggtttaaaaaacaataatggtaagttattgcttatgtgttatctcttttctcttttttgttgttgttgttgttgaaacaaagaactattttcagaaagtctggtgacctactgacatcatcaaaaaccgcaaggtttgaaagagtcaaacattttaatataaacttgaagcagtaactggattatcagcatatcagaaaaaatgtgccaattatcaaccaacaacttggctaaggttcaattgtgggggcactaatcagttcactgagcataatatcgcatcacccttccaaagttggtgccagaactgtttggtggacaaagtaaccaacacacgaccggtcagctgagaagagcagagacatacctctgccctgccctacctcctaattcagcagtcactactcactgtgacctcctgcatgaatcacttgagtctctgacccaaagaatgtccaaaagatgacaagcatacaatttttaagaaaaatactccatagtatactgaagttcacttataagactaatttaaaatacccagtttatacagccttttaaatggcttagccacaaactgtcaatccctcggaatacttcatccctgtgaataatcacaggaggaactaatttttaatggcttctcaacagtctaaaaatggaggtgtacatgtggctatttaaaattcacccatttatagttaatgtgtttttgatactatatcttagctgcccatccagcattggtcaaaaaaatcacgaaccattgtgaaataaacacctccctgtagctcctctctgctgtgtggacttcacggagttgtccccacacaaccctgcctctggaatccagcttgtccttgttacctgaggtggggctcatgttgacaccaccatttgttttctctgtctatggcatctgtatgcacacggcacatttctccaaaagggacactgaacacttgtttctgcacagcagtaacagctgctctgggcaatcaagaccatctaaaattatgcacatcacaagagcctacattttaaatcagaccaccctaaacaaactccaatcgagtgaaaatctacctagccattttcatgtgatgcagtcacagagcaaaagaagcttgattttatttctgcagattacctttatctttgaagccatctttgctacataaggcaactcatcaagttcaattgttgtcttaccccattctgaaaggtttgcccttggatctgtacttttcaaaagaaaacaggacaaacacaaaacactcataccataaagacttccaaagcattcttaggtttgctttatgagctactccaggaaggttacggaaacatctttccacactacatgctatttctggataaaactataatggatatacaggtagataattcttaaacataaactatgtaagtgtctaaatatttgacttcccctcatcctccaccctacatcaaacaccattattaagaaaacatactttgaagtatttatgtattagggttcttggttatagttttccaaaacgacaaaaaagctattattagcaacagcttaagtgagacagcttatgcaattattgaacatatatgaaaggcaatgaggaattaaatgcagaggtttttaaaattcctgaatttttgtgactctttttgaagaaaaggagcagaaaagaaagctctgcagtttggtaaagaaacgtcatttggttctataaaggctttacggtgattctcactccaactttaaaaatatgttttcatctttagggggcatttatgagtagtcacaaagtaaattatgtgcaagaaggtgaaagaaagagtacttcctaaagaggcgaggtgcagacggatggctgcaaagggcctcctcagctcaactccccatagtggggtggtgtggcagggggaggtggtgaggcagttgggggaagggagcagccgggggacctgccatcccagcagacattctggtcagcatcctccatttccatagcaaaaaaccatcactgtgcttgttaagttgtcatttcctgaaggaaagcacctgtcaccctcctcattttccccgctctgggcagttccacagagtgtaatcttgcactgcgattcccagcagctaaggtaactgagttttcagaaaaacaggggagagagttcatcaaagaaccacacatccggagatgggtatcccacacaattagttttgtggaagtggaaagcaatcacaagagaggcatttctgtatgtttggtgaaagtgttgaggaatgcgacatgtgataaagtcttagacatgaaccccagaaagactgtcttacctaacgaaagaatttgctatctttaagtagaaattctaacatccactgtgtttctctttttactttggtttccaggaagctcattataaatgtaatgctcaaataacctcagtagcctaagttatttggcatgatttcccccttcctccatatagtttttgtgatttatttgtattttatcagtcctattgcctacatatacattttgttacaaccttccttacatgctttttgcctgtatttagagtacacagttgggaaaaaaaagaaacaatctgtgatgccttaaatgaaatttttttttttttttgagatggagtctcactcttgtcacccaggctggagtgcaatggcgccatctcagctcactgcaacctccgcctcccaggttcaagcgattctcctgcctcagcctcctgagtagctgggattacaagtgcccgccaccatgcccagctaatgtttgtatttttagtagagagggagtttcaccatattgcccaggctggtctcaaactcctgaccgcaagtgatccgcctgcctcgggctcccaaagtgctgggattacaggcatgagccactgcgccgggccatgaaatttatatatactatacctattcataagatggtattttttcctgaagatttctcaaaaaataagtttaatgttagaaccctattcgttatagcataacacgctagacataagctgcgggagtgtgaacgaacaaagtatctgtttgaattcacaggattctagactacatcaggcagacattcccgttccctatcacagataaagatacttatgataggaattcttcacttcctttttttagtcactgggatcctttaggactctgatttttaaaagccatggaacttcttccccagaaaaggatgtgtaccctcacacaatgtttgacatatactttccaggcattcacagacccctggccccatctgggttccttcttgctacagaaatggcaggtaaaataagtctccactggagtcaatcacatggagtcccttctgagcccagcacagcaagctgcatgttcctaacccccttatctctccgcaatcagtcaccacggagaggaacagtcttctgtgacaatcccaaccctggcaggtggcagcggaagaacgaggcccaggtcacctgaccccaatgaggatgctgatgattttcctcctctccactgttcagaggcagcatgcttctctccaggaaaaagaaaaaaaaagaaaatccacaacatgttgccactgttaggggggaaatagactatgtaaacgcagtgctgtgtttttaaccactaaaaacctcactgtgtcttcttcatcagtctctctcctcgacagttctctctgacttgaagttgaggacttttcccactaagtccacaaccttatactcgccctcagagagatgttcgtttcttcttttccccaccacaccctgtaaactcttttctgtcgctcccacaggaaacaaaacaaaacaaaactgtagttactaacacatggcacttatttctgcttactgagcaaggtatctcttatcataaaaaccaaactttacctctcactctcttgcacgagacttacatttagagggtttcaggtagcaagtcaggattagactaagaaatcacagtggtctagagggtagtaacaggaatggatgcaaaaaaaatgaaaagaaaaaaaacccaacagctaccaccactagaccaagattttcaatccccactgtaacatttaaattcaactaagaaaccttaaaatatatacacatactgctgtccaagccccatgcctgactatttaggtcggatttgctgggggtgagctctgggtgttgggagtttttaaagctcctgcgttactctattgtgcagccagagtggggcgcacccaaccccgaccactggctgggggagagggccagggcagtgctcggaatgctggaggtaaaaccagatggcatcactgcttgtccctttttgctggtcctcctgggtagacatgatcacccaagtcaggtgtgtacaggcagcccattctctgaaaaacagtggcaacagccagcagcccctgtaacacaggacacaagagtggagcagtgaaggaagctccccacgagcactgtcctgaatacagtctccagcctctcgtgtccaggtgcaggtctactctgagcaagctttcctttgcaatgtattgaaggacaatgtctctgggtgcttaattactctcatcagcaccacctctcagttcaggggtaatgtcccaaactcctcttccctgggtggtcaaggcattatctgtcccttacctagggaggcaagaagaccccacacccagaaaggcaggtctgggagagaccaggggagacagggctgagcctgacggacagtgagttgaaggattctgagcagaaggggagggcaaaggtaagtcagaggctgcctgactgatttctctggcttcataagcagaatgccttgcctctttcaagcaggagggctcctcatttaacacaaacaggctaatataattcgcagaggcattagcccagctgctgtacagcaaaggccccgggcctagacagccttctctccctctgagctcatcttagtccattctgtgtcactatgacagaataccacagactgggtaatttgtaaagaaataaactcatttctcacagttacgaaggctaggaaacacaataccgaggagctggcatttgcaaagggccttcttgttgcatcatcccatagtggaatgcaaaagatgaggggcagcaagagatcgaactcagcctcaagcccttttataatcagcactaatcccctcatgagggggagccctgatgacctaaacacctcccattaggctccacctcccatcacggttacactggggactaagtttccaatatatgctctttgggggacacattcaaaccatagtagagctccattcagttgctaccagtaggaaaaatctttctttaacaacttaatgacaggtaaatcaactccaacttccctcctatttgaggttcaaaattatctacataagtaggcccttcatgatgagcagggctggccctggccatcttacaggtaccttcaattactagaccacacagcacccaggcaaagaactggcgctcagcacgtatctgtcgagtgaatgaactggttccaagaagcatattcaagcgtatgtacaaagagctgcctattcatttagggctacagtaggaatataaaatgctctgtggtgccccttcattatacatctctgttagctaacaactcacttagggctgctcacccaccctaaggctgttcagggaggaacgaggactaatgtggtagtcagtgccccggcatcctccccgctactctttttagtactgaactcccctagctctagtcaggcatgtgattccccctgaccccgctccccaggtatagactatatttcctaggctccctgggaactaggtttgttcctgtgactataccgtgatgtgatatgactcgatgtaatgtgtccaactttgaggtcaccctcttaaagacacagccacttgcaccactggctaagacatggtgacaaacggagccatctggacagccaggcatggaggaaggcagaggaactcctccaaccctgacttcttaactctggactacgatctgaggacacactgtactactcagggatgtccttgtcacagaagagattagtccacaccttaacatattccagaaggaatatgagaacctgttttccaaccctgaaacaagcctctaatttgtctagggcaagtgagttagcctcccccttgcacaatttcctcctttataaactggagatgaaagcacccggtcaattttattaatactaagaatcaactattaaagcacaaatgcattgaaatgtgatgtgaagcagcctctgtgaatgaaactatatccaggcagcacacactggtgggaagtactgccccagaaggaaatctgccataccagaatattactatttttgacaagaagctgaaatgtgagctcagcatagcattattctaaaataatgaaaatatgccagatgcttaccaacatgaactgtacacactgattgcacaaatatgtccattaaaactaataacacaccaggggagaaaacaagctgcctcgtctgtgaagtggaccaatcatagtttcaattgtgccttaccaggtaagaacagggtcttcccaggcaagaatgtgcgacccagaagtcactgaggtttgtcccaggcagggctatcaccagcccttttggcacctctgaaggagtcaagaaatgggcctggtgatttgcttgcgtaagaaacagaaaagaacaccctcttcctccagactgacccagctccatcccctggcctgggccgtggagggtggcgagtgggctgcatttcagtggattccaccctcatttgcccttcagccaggagcccttgtgtagggaaccaccacacaactgcatgcagggcctggtcccaaatttacaatgcacatggcattgttatcaataatgtagttagaactaatgtttcctaggaatcctaattctacacagacactgtcacctgtcagtaaatctgccagaattccctcgctggaaactgacgtatattttattccaaagaataactaagtgaatgctctttcccatctctcttccatctgaagagatgagaagcaggaggaagaggagggggaggaggatggggaggtgaagggagaagaggagtggggaacaagaggagcaggaggaagaagcaagcaagttccaagcaatacaaaagggttgtaggtgaatgaaggcttacagcccagtcctgcaagcagcagacaggatgcagggaatgaaaaggctggaagacaacagccaaatatcaaaggatttacaagaacaatgatgtatccttcaattaaattcttttgcttaaactaatctttcagttcttgtcatgttctcaaatgaaatccatttacaactcccaacacaaagccatcagacaccctagaatttgcttagcagacctaaacagtgacactgctgtaactggcaaggaccccttttcttttaaagggacattttggcaagtcatttcataaccaagacactaaggagcacagaatagaaacagcaggccacctgccatctctgccaggagcaccatcctctcccgctccccgcggggctccccccgctcccctatctctggccacaagtcccaatcatctcagctcttcaaacccaccaagccctctccacatcaggcctcccttactctgtcccctcagcctgaaatgctccttcctccctccccccacagggctaacctctccatccctgagttttcagctgcggtctcacttcctcagagcggccttcccgcccatcaaaactacattctttctgccagtctcttaccccgtgttttattttttcaccgtagcacttatcacaatttacaattatggttttttccccctgcagtgtttatcatctggcttcctcacagacgtacacaccaagaagtcaagaatcatttctgtcctcttcaccattttagatgggtgcccaggcccagaactggagattaagtcacaacacatctgggttgagggcaaaacctttttttttttttttttaattccacgggtgattcagatgcacaatgcccttttgagagaagtactaacttgacattttcctagcaaattaatatactgaaataccaagtaaatcactccatatgaaagaaaaaatttacagtaatgctacaatttctgataagcacaatctcttcataaagcagcaggcttacaaatgttgcctatgctttctcttatggtatttccagatatgtttactagaccataagttattgtaataaaacctacccaggatattatggtttcaacaagcacacagaaaaggtattttgcaaatgaacaagaatccatataaactaggctagtttagtagttgcaaccattttacccataatcctgtgctctctaattatgcaaatatggcctctgcaaaacaccaaggtccaaaatcccttcccttataacacaacagggtcccagactgcttacttcaatgactgttaatatgccaacctttccccataaaattctctagtccctattgtaaacatcaaaatatctgccatacaaccaagaaaaaaaaaagtgactgatgtaatccagtcctaagctatctctcggtggtggttacagcataaattattacaggttgatattgagggtggggaatagagatgctggttgatggattttaaaatgcatggtcgctgttactactaaataccagtttttcatttcaaagattccccccccaaaatgactcacgctgcattttgacattgctttccaattttatccctccctaagcacaaccaattatcacttccagcctttatctagccggctaaatggtcccttgcatcactttatcctctccttatttctggaactctttttctcctagagcccttcactctgaaatttttccaaacaaccaccaactgcctaaacaatgatttcattttcaagaaagtagtttagcagtggcttggtatctcaaagcacaaatgagttttacagtcttcagagttttcaaaagtcatttggtgttattcatctgtagtttataagtgtagatgcagaaaactgaaatgaactgcctaaaactttggagtcttatgtctaaatcaagaattctgcctggggccttattctttagtcccgtaagtcagactcacaggctccccctcttcaattccgtcatcagcctgtcacacccactgacccagctccatccccttgcctgggctgtggcgggtagagtgggctgcatttctgacagaaatggagccaggctattttacatatgggggacaaaggtttccacaccttgtgaaaccctaggcccagccaactggacccaaagtgaacatatgacccagaacagccgatgcaaacccagctcagcagggccttccaagaggtcaagaggggcttgagccactcttgttttttaaagttcccaataacattaaaaataagaaaatgacaaaacattttaacgcctatattgaacaaattaacatttctaacatccaaacacttataactaattatgctcttcataaggcagttacaagatttataaaatgtattaattcatagtgcactacaggcagaatgtctattaatgagaaacatatttaaatctggatgacgaatgccatcttctttcaatcctgccagtttgtctctgtgactaaacgtacaagttcatgtggagacaacatgaagtaataaatctgaggcccttcatgaatgtcaggcccaagctaaatgccatcgcagccaacagctgctgccatcctccctgatatatacactatgccctattggccaacaacatagggcaacatatttaattcaagtgtctacttcaacagagatgatgccaactagctaggatcatcacagtcaccgtagcagaaatttcaaggaggaaagagtcaccaaccccccagtgctgccttggatcgggaaccacgtgacagcccatacctgtgtggcccagccacagttcatatcctcagatattctcaagattcccatctgccttgccacgtgtaacctgctatgaaaacccctgctacagagtttttgtgccttgggaccaagagagcctaatgccacaaccttcctacaactggacaggctgcccctgttcaaaattcacacaagcctggaaacctcagggacaatgacaatacagtacttttccctctctcttagcaaattgttcccacctttaaggttgtcatcgccccttctttccaatcattttgttctcaatcactcagcttctcttcactaaaaatgtcccgtgtttgactatcattatttctagattctcaaatgcagagatttccgaacaatgcttttagggaaaagaaaaaacctggcattaaacacagacgttgatggccgggcgcatggtggctcatgcctgtaattctagcactttgggaggccaaggcaggcagatcacttgaggtcaggagttcaagaccagcctggccaacgtggcgaaaccctgtctctactaaaaataccaaaattagcagggcgtggtaatgtatgcctgtaatcccagctactcaggaggctgaggcagaattactttttgtatacacacacacatattgattcttagactcgtcggaatttcagacatgtttagttaatgccttagaataaaccaaagaagataagtgtgtcacacttacaatgaggggcaacaggtggaattaaaggagaaatggccaaatctggatggatggcaacaaagttctgcgaaatgtcagggcacgtggcaactacagcaagagaagaagcagaacaagtgaaatcaaaaggaaacaacgaagatgctaagattcaactgccagtgcacacaccaccccggagagtgtttccaatttcccagggctctgcagaagaatcttatccaagcactaggtggttctacaaggcccttccttctgcttgtccttttccctcactatggtttctcagtccccacgttagctcaacccacttggcccttgcttcccttgcattccccagaatccacatcactcctcagaaccatacctctgcttccctcttggagattaaaacctcatagaaaaggaattgtaggggcagaggtaagaggtgaccccttatgaagaaaacttctggggcctcagcccagcctctgagaaacagcccatgtttacacagaccatgctgaaaaggaaacccacggctcctggagtttgtgctaccttgaaataatgcttagaaatatgggtgacggcatttcagcatcgaacaggtcaaggggaagttaaagagagatctttacctagtgtcactctgacaagagctgtttaaaaacaaaacaaaacaaaataaaacaaaaccagcccaagaggcgctggatggcaagatgaacaaagcacagcctccactctcaaggggagcatagcgcacagcctcagactcaccctgaaacatttttgggcctcaatctcctcctcttagtatgaagagcctctagtgccactgtaataatatgtttctataattcgacaccatgcttttcatactttgcctctcaaacaacagttgcaaccagtattgttccaacaacaaatgggacaagatcatttacgagagagggaattaatgggtccttctctccataaaataacgatacactccaatttccaaattcttgaatactagatattgagaagctccacgtaaatttttttttttttggaaacagagtcttgctctgcagccttgacctactgggctcaagccatcctcccacctcgacctcccgagtagctgggactacaagtgtgcaccaccatgcctggctaattctttttattttttgtagagactgggtttcaccatgttgcccagtctagtcttgaactcctgagctcaaacaatcacctgccttggcctcccaaaatactgggattagagctcacagaaatctttaagaaagaatttatgaacaaaagaaagggtgtaggtgtcacttacacagaagtaatatttgtgggactcactattcaaaaaaagcaaataccaaaatacatgtatacctaaaaattatttaatcagatttggacatcagagatcatctcacatctatggtatcatctagtctggcctcttcattttatacataaagaaagctaggcacagagagattaagtaattcgcccaaggacacccagctagtgagaggcaggacaaacagcagaacctagccaagaatgatttaattattccaaaaaggtatcagaggatgttagcaaagtctgtgataagctcctagtctttggaggctaatgtcaaaggggacagccaagccctcccacaaagcactgcttactgctctacacaagccagaactcaggctgatcagtgtaggggatgcatgtatccttggctcccacattcatgcatttccgtcatgccaaaggtagcacatgtcctgcaaggcacagtagctgacaccccttctaaaataggccaacagctccaaagtggttatggccttctcagattgcaggcccagtttcccacctcactgttgttattgtaccacacacaatcacctcaccaaaccataggaagccaaagctagcggtgccagcccaccagctgagtagcagcagctgccccaaagacatcaccctaggacctcacttcctgttctggcacttaagcctgtatccatgccagttcaaggtctggcccatcattttcaaagctagagctggacaggccccagatatccaagaaaccatctgttctagaattctccctcctccaacttcacttcacaacaggccatggcatctgccactgtccttggtcttctgaacagaaggtgtggagctcttgtacacaaccttggagagaacccaggtcattctgaccctgtccggaaagggaagaaccactgttttaaatcaaacatcctgaagcaaacaggtccatgcattctatctggcagctttaactcccacagatgttagaaaaatgtagaaaagtgcattcaattttctaaagtcctagaattctggaccatttccccttttcaatttatatttattctttaataaatgcttttcaaaaaaaaaaagtcaccagtataaaacaaagacaaagtaggaataatcacactattaatgtactaatacctcagacctaaggcactgtgaacttactttccaattaagagcaaaaccagaataaaatcaagcattctttgaaagccattcaagtattactatatacaaattctaagtaaaccccaagcaattacatttgtataatagcagtcgtaataactaatattgattgagcttcactacgtggcaaactgcattaggctctttatatgtacgattcactaaattcttctaacacctctgttattacctcctcctttttttaagcaaaggaggcatatgaaggataagtaacttgcctagggtcatatcaataaaaggggcagagtcaaggttcaaacctaggtccacgggactctaaagccagtgtttttcatattataccacactgccttggggtcttcagtgtgtaggagcaaaaactaaaactgcattttaatttagtaagcagcaatcaccttccattttaagaggttctgtgtaactgactgccctgaaaatttacaggcaaagacagggaaattggcactcatctaacaagtctatagcatagctgtaaagcagctgtgcagaagccgggggacaagtgaatcgtgtgctaggcaaggctttacgtgcctctgtctcagacttgaaatttttttttaaactggggagccaaggagaagggaaagataatctttttctaaattctacagagagtattaaataaacatgatcagccccataaagctctgataaagtcagtcattaaaaataaaaaactgtatctcctactacctctcattcttcacccaacaagtataaaaatccacgagcacacacacaaactctatcagtattagcctatttaaaccttaaatttttaattctgcttatctcttttgggaaattcattcaggagacatttggctttgcttatacttctgttgctgttattttattgcaggcgtcaatatgactgtctcttgggtggcagctctcagacatctcgtgcagtatcaatattcacaaggcagcctcagatttactgctaaactgagatcatgagcatgaaacaataaacctacaggccactgggcatatttgctgttgatcatgcttggatcagctgcacaagcttgtgatgtttatgatataagcaaatggctttccttgctctaccttttctaattcttcccagtcaacttttatttcaaagtcttacaaaccatctatgtgccagctactgtgctagctgctggcaatactgtagtgagcaaaataagcttactgcctatttaaaaaggcagaagtcaatcaaataatgatgcaaaggagtgagtaattagaaaagagcaccgtgaaggaacacagattgacgagtgtccatctgttcaggctgctataataaaaacactataaactgtgtaacttataaacaatagaaatgtatttctcacagttctggaggtggggaggtccaaaatcaaggctccagcagattcagcgtctggcgaggctcatctctgcttttcagatggtgcactctcactgcgtcctcacgtgttggaaggggcaaacaagcttccccagcctcagttataagggcactaatccaatttcacccttaggatctaattacctcctaaaagcctcatattattgcattgagtactaggtttcaacacatgaattctgggagacacaaacatttagacgtagcatggagaatttgggcagtttttaaacatggctgcaaattctgaaactcctcccactgagaggtgaggtctatgtcccctcactcatgaatatgggcagccttatgacagcttaaccaatagaacatgttggaaatgacgctatgtaacaaagctaggtcataagaggccatgcagcttctttagctcactcttggaaccctgagctaccctgtgagaagtctgaccacccggaggccacccagtcgtgaggaagtctaagccacatgaagaaaccacagtaggagccatggtcaacagtccccgctgaggctggtcttggagtcatcccagtccagacagcaggcatacacacctgaggaagctcccttatgattctggcctccagctgttcacattctcccatcatggagcagagataagccttcctcactaggccgtctctattcctgacctgcagagtccacaagcctaagagtggttgctgtttaacaccacagtgtttagaagtgctttgtcacacagcagtcgacaataagaacaaaggtgctgcatataacagaggctgccttgtgccaggaagtcatgcgagcgctctccatgaaagtagcattagggctgcgatctgaagggtgaaaagacctccattaatggaaagagagggagaagcaggctgtaggcacaggcactgcaatcagagggagtgtggctggcacagaaaaaacagcacagagtgagaggagagtaaaaaggctgacaaggtaggcaggggtcagaccacattgggtgctttgctggtctggtgcttgacagcacttagaagtccctggaggggttgtctatatacatttttttaattgaaaattcacgtaacataaaagtcactgttatgggttgaactgcatatccccaaaattcacatattgaagtcattaccagcatctcaaaacgtgactttatttggaaatagaatcattgcaggtatacttaattaagaggtcgttcagggtagatcctaatccagtatgactgtgtccttataaaaagacaaaatttggaccacagacacacacacaaggagaccaccatgtgaaaatgaagacagaggtcaggtgacaggtttatacaccacggaatgacaaagatggctggcaaaccactataagctaggggagagccacggagctgattctccctacaaccatcagtagaaaccaaccctgtgacaccttcatctcagagctgcagcctccagagttgtggggcaatacatttctgtagtttatgccacccagtttctagaacttcattacagcaaccctagggaaccaatatgtcactttttttttttttttttttttgagacagagtctcgctctgtctcccaggctggaatgcagtggcgcgatctctgcttactgcaagctctgccccccaggttcataccatcctcctgcctcagcctcccgagtagctgggactacaggcaaccgccaccacgtccggctaatttttttgtatttttagtagagacggggtttcaccatgttcaccaggatgctctcgatctcctgacctcgtgatccgcccgcctcaggctcccaaagtgctaggataacaggcgtgagccactgcgcccggccagatgtcaccattttaaagtgcacagttcagtggcttttagtaaattcacaatatagtgcagccagcaccactatctgattgtagaacattttcatatcccaaaaggagacctcattcccaccccccccgcagcccctggcaaccattaatctgctttctgtctctatgatttttgcctattctgtacgtttcatataaatagaaacatacaatatgtggccttttgtgtacggcttgtcacttagcataatgttttccacgttcatccatgttgtagcatgtatcattacttcattcctttctataccattgtatgggtataccacaatttgtttacccattcatcagggacaattatctgagctgtttctactttggggctattatgagtaatgctgctattgaacattatgcacactttctttttttgagacagagtctcactgtgttgcccaggctggaatgcagtggcacgatcttggctcactgcaacctctgcctcccaggttcaaatgattctcgtgcctcagcctcacaagtagctgggattacaggtgcccactactatgcctggctaatttctgtatttttcatagagacaaattagcctgttgcccagactggtctcgaactcctggcctcaagtgatccacccgcctcagatccccaaagtgctgggattacaggcataaaccactgcatccagcctcatgcacacattttatttgaacacctgttttcaattcttttggaaatgtatacctaggggtaaaactgatgagtcatatggtaattctttaacttttttgggggtccaccaaaacactttccacagtggttgcgccattttcattcccatcagcaatgtctgagggttctctggagggcttcaagcaaatgagatattgagttgtgcttagaaaaaaagtcatagaaaccagcattcatgagagaacatgagttcagttttgaaccgatgggtctgacatgacttttaaaacattcaagaggacatgtcaggtaggacagtcagtctgaggcttaaaaatgaggtcagtcagctctggagttaaactttgagactcagcaggtcatgggcatggaagagattccatgagagaaagtgcaaagtatagaaaagaggggcttctgaacttttaggagctctgaaaatgagtggtgggacagaagaaaacgtgtctgcaggaaggagtgtgataagcagaatttaacaaaattataatattggtggactaagaggaaggagactgagcaaagacaaaagagactcatcattttgtaataagaaacagatttgtaaatggtctaaattgtgacattttaacaaaaaaggataaacaccattttacttctttctacatttttcctttttaaaattcctttccttttttaggggaggggagggtagtggtggtggaaaggaaaggttttaattcccttagtcttatgtgtaagaggttaaactacttgacctgttatcagaactggtgaataaatgcttttcagactggacatcaaacctatctaatttaaaatagacctcccccaagggaactgcatgaaaagaatctggtcatgtacttaacaagtttctattgtttcatcaaagggtctgaaagctggagaagacagttggatgccacttcaaagtatcactaagaaatcaacaacgattaaagcaggagaatcataattcctccacacaccctccctgctgacaagaaggtatttaattagagtccaatcaaaagatgagaatcctatgaataaacctgtaataatatcctctgtcccacttcaaaattatagcttaaattattttgttcctcaaaagccatagttccagagattataaaactctctttacatatcaatcacgagtgtagctaatcctttcaagtctacaatgcaaataattaaattttaactttgtaatcatgagaacaaaggactcttgggattaaataaacattgcctttagaagagtataggaaacagttttagctcaggccggtggcctttttgagatacaacccatcccttactcctttggtggctttcaacattaatacaaaattgggaaatttaaaattcactgtaattcattacagtgagttactttatttgaaaacaacacatgcacacatacatatatacaattccatgtttcctctgtattcacgtactttgaaaagttcaattttatccatttacagaagaggtgtcctcccagagtaagtttggatattagttatttaaggtaagcctatgtcaggtggaaatatgattgatgttaggaccctataaataccttcttttgctttatatgaaactatgaaattggttctaattatattaccaaattgaatcatattgaaaaaaagtaataaaatcattgcattagtcacaatcagccacatttgctggtattcaggcctggtatttgacatatatgttattccaaagccttacaaaaacccaaatagaagttattaccatccctgttttacagacaaaagttcaggggcagaagatccaaatcttacctttagaaacacagaattgaaatacaaacctttaaaaaaaaaaacaaaccacaacgctaggactgcctctaccacactatgccttcatggaactgttatgagagcttttagaacattattgccaagtacagactaagtgcagcataatgatgaggagataaagtcaagaatgaaagtaatggtttcccagaggaaaaaaaaatacgtattaacataagtaacatttcattactaagagctccataagaagttacttgatttaatctaggttgggtttttctgtgttttttgtttgtttgttttgtagaggaggtgtaaaattttagatacggagtgatactctgttgtaaaagcaagagcaaaaattttacaaaacactgcttccccacagtacataagaaaaagtcttctcaatgtccctgtccctagttcagagaatcagtatgacgatagtacttggagaactataagagcagtaacttacattaattagtagttaatggggtagagccacaaacattaacttattcattaattctcaacatacttccctgaagcaagtctgagcttctctttgatagagggaaagaaagtcaatgttacataagtgatggcagcctacttccaggaagtgatcataaatacacaagactaacgccacacttaagactttagattcctcctatacagagaggcattaatgaacgtatttttagacacaaccaatcccaaaaaaaccatcattgaaaatttgtaggattccaaaaggcaaaatacgatttgaaagcactgaaacataataatgataataacaacaacaataataggaaagggaggaggagaaaaagctaataattgttgagtgcttataatacaccagacaattctgtaagagccctatgggcagtagttatttatgcctagtgttccattactggaacgctaagcatgtgggagttttttatacccttctgctcaaggtggttgccaaggtctgattgcaaaaattcaaaaaattgcaacctcagacataaatggattaactctcaatccttacaatgagcttgtgaagcaggtattatttcccgcttataaggaaatgaaggtgatgtgagttgcccagtcacactgatagttccgagcagaatttggagccactttggttccaaagcccatgaaactgaccaagattttacccagttaatcaaggtaagacttattttcatgttcaactcaagattacccatgcaagattgacgttacttcaccaaagagaaaaaacaaaagtctgttatgttttgccctttacatatttccagggccagagggccaaaccccttccttcctgtgaacctctggtgcaatgaaatgtcaagccagatctggtccactctaaaatacgactcacttgctattactatctttaaatggcttcatccgacctactccctgaaaccaatttcctcttgaatacatttaattgcttctttatgaatgaaccctattagtagcatttattcattccttctgaaaaccacgtttaaaagcaagaaaatagtatgtcagagtagtatgtttatttcatcaaatacacatcttctcttggaaaaaaaaaaatcactttgcttattagatctttctgtgccaggtaagttttaagagaaaatttatactaccacatatttttaagttgagtactatgtttatgagaaataaagcaatgagtggaaacacttcataactaagtatctctaaaggattttccataaaccaattattcactcattcctcacttgttactatatttatcaacatcaacatgttgttcaaggaccatccacatgagaatcacctggggctggctgttgacaacacaggtgagatctaatgaatgctggtttcccagtgaagaaatctgcatcactcacgaacagcccaggtacatgctggtttcccagtgaagaaatctgcatcactcacgaacagcccaggtacatcttatgtattctaaaggttgaagaccactgagtcccctttatgtgctaataggacaaacagatacacaaagggcttatcataacctcccataattgatcttaaattgatctctctgcttctaaccttgaccccatccctacatacctgcttattccgtaaacaacaaaaggatttttaaggcataagtcagatcatgtaacttctctgctcaaaattcccccagagtttctcatctccctcagtggcaacaagcctagaataatctccctgctctgcctttctgactcatttcctaccactctcctctcccctcctgcttggctccagccaccagaccgcctcctcctcacccctggcccacctggtgcagcagaaccttcacccctacaggctccctctgccgggaccgctttcctgcagctagccccacagcctgttccttcccttccttggggttcctgctccacaatcactagtgtgggaggccttccctggccactttatcaagaacctgcccatcccttttcctgcctgattcgatcctctttagcgtttatcactatctaatgatctaatgtacttgctgttttacttattttttcttgttggttatctgttaccctccactaaaatgtaagcttcatgagagcaggttttttttttttttttttttttggtctgctttgttcttaaatgtatcccatttggcacgtaatagacatcaaaaaatatttactggctaaaaggatgaatgaatatcatcaatgctccaaaaaagggtacttgattaatgaagcattgtaagagagagcaaccagcttggggtagggggcagagcgcctagctctcctcgtggcaggtaacactagtggggttttcaaggaaggacagaaaacatctcctaagaaaaggaaggacattctacacatcagctggcctgtaattaaaagtgtcagtgtcatgaaagatgaaggaagaatgaagaatgcttctagaatgaaggagactggaaagatatgacagctgggtatgagtgatcctgaaccggatccttttgctataaaggacgttactgggataactggagaaaactgaagggattttatcagtgaaggtttataggagttcttattttagtatttttgccattttcctgtaagtgtgaagttgtttcaaaaggaaaaaaaaaacacaaaaggaaccagaataacacgagtaaatgcaatgcatcaaatgatctgtgaataaaatgcccactgaataaaacagggaaaaacaacaactatttcttccaaatgttcctatttcccttactcccccattcctccatgaaaaactttgggcctgtatcatcttggcttagagtcagccaaatacggtcattcttctttaagtataaatgcaaataaaccccctggatttcagtgggaacacagcatgcagcagaacatttgtgtgtataaactctgtagtaaatgacatctctcttctccctacagagtagaagcttgatctccatgaattgctgtaactcaaaacatactttttacacaaaaataatgatggggttgaaaatagaaaaagtaaatctttggactggactgctgttgtgagccaaagagaatgattaaatataaaacaagagggaaaaaaacaacagcactaggttataaaagaacagattgacatagattttttgaaactggaagttacaggcaacatgcctagaatttagataacagtattaaggactgaacactcatccaaacatctacagctcccctgacaggtcaaattccattacaacaaacaccagtgcaataataatctgagtaatccaaagcattcctggttaacgacctccttaactcaagcagtatgcaatatctaacaccattccccattttaaacacaaaagtacaaacgtaaatacagcaagtgattgttcactgtacaaaaggactcatcagaagtctccataataaggtataagggtttttttcaacatctagactagtgtttgtggggccattttttaaatacagaaaaaaaaattaacttacatgcaacttttgaaggacatgtctagatacagtggacccaaaatgttaacagcaactgaaagcaagcacaagtttaacatgacaacaggagcatctatagattgactcatgtacctcccaagtcccctactttcctctgtaatgtggggtacaccacactgcctggtattggtttaatttgaattttcttccaaattattaaagttgacaaattctcattttttaaatatgaagttccagcctctcctggaaaatggttagatctggcaacacaggtacagattcctgggtcaaccaacagctaatggaaaccagctccctgataggcatggcagaagcattgctgacccctttaccacactccccatcactccctattgcattcccagcacccttaatggcttattttctgcctggtccttctaagcataggaatctgcaacaccagcttttaaaacaactaaaacaaacaaacaaaaattactactcaacttgctgatatatcaaaactgagctgtatcatacattgtcctatgatacattgtacattgcagagagaaggcatgctaagttaatattatggataaattactttaagatttctctaaatgacattctcacaagcatccctggcaaaaggcaacatctataatctttaactgaaaacactttgctttggaaatgggaatgctttgaatgtaccttagcttatcaaagcataaatttacttgtttttaaatgagttcaaaactagccatcatagttatttatgtatatgttactgcaattaaataaaaaggaaaaaatgcttataaacacacacatattatcctgaaacagaaacaataagcataattactctaaagtggcaaagaatggataatttgtctatgaactatttcacagtctttgagttgtactgtgtattacacataaccagaatatcttcagtctcaaaaagactatttctgagcacacaaccaagattgcaggcaagtcacacaacccctctgtgcctcgatgtcctcatcagaataatgtgaaaaataatagtgcagacatcttaaagggttactgggaggattaaatgagctgatacatacaaacagcacttataacactgcctaccactattgcccaaccttgtatcaatcgacacactagcctaaaatgctgataaattacgttctcctaatgcaaacattctcatctctgctctggtttgcagaatgaagcagtctcctggtcttttatccaaagcacactccagtattattaatttaagttgctgctaaatctcaaaagtcattaataaaatgtagtgatttctcaaatggtttatggtcagccactctaagaggtacttaatagaaaagaattagctcaaagctggtatccagatgatttatcaaaacaactatcaggtttaaagaaaatccccagggcagtaaaaacccagcattcaaaaaacaccaatgaagaaaaagactgttgctattcacaaaggtacagactgttagtgagtgaataaatggaagaataaatgaatgaagatcaaatgggttatttgctgctgaccacaaacttatgcttccctttcaaaaaaaagtatttttaatcagatcctctgcttatatttgtgtcattgttaaactgtcttgtcatacttacataaccaggtaataataatctatgaaaatactcgactaaccaacccaaacgctttccctaaatcttaacatatgcactgactgcatttggtgtggtcagagatgggccctgtcctgaattcacgctcgagttggggaacaaaactaaccaacaaggattaagtggtaacctctgagtatctactaaacagcatcagagttcctggagggttatgcccagggtaggctgcaagggtgctcaaagtgaacaagaacaggacaaaggcaaagcagaggaggcaccaaacgaaaagcactgcagctgttccagccatgaggcctgatggagaaaacaacatggcacatgttctgctcagcaaatccctacccgcctccaatacatacagcagcaccacctcctctaaaacattccctcattacctgatctttagacttatacaccacttctcgtttatgtgtgtatttatttatatgtttttcctccattggactgagagctctcaaagcacaagaatcaccttaatccatcttgtattgtcatccgaggcacgcatattccctaaacatccctggattgaatgaagatgacttagcaaagggagggattctctcaacccgggagactgtgcacataactagaaagggaggggcccacggaatccaacgccaagcttcctgtgcattggtgctacccaggagaaaggagtgcccctgtcctcaagaaacttaagtccacttagatcacaaaaagttctctgagaaagtatgtgaagggctctatttagacagctatttattactctgaatttgaagccctcctccccttgaagtaaggcctactggcttaagggccctgcagagctaaagatgtgaggataacttgccactggtgcttagcacaaatagcgaatgagagttcactgggaagtacaaacgaagggaatcaacttactcataaatctcaacaccctttcttttgctcactggctgagaaactgccatctggaaggctcagcagatagatgaaaggcattatcacagttctactggaatatttctgcttggcaaagaacacaagatgccagaacttgaaaaaaatcatgtaattctgatgacctcatttcacctttcttttcagccaatccaaattcagcctgttgtagatatttaacaattagagaaaccttgcaattactttgctgaatcgctcgactggcaaaacgtccacaaggcctgcgcatctcctacattctaatgctctggtagctctgagacccacggcaagcaaggagagcaccccctacagacaacattcacactgagaagtggcaagaaagtgaggaagacaattccaggtccctgagtccaccaccagactctcatcaagttcaccccaatatctgggaagcatatagccttcactgcacatgttccatccctgactccgggtgggtgcacctgtacctgtgaaacaaacacacccacacacaggcaaacatagcactcgatcttttttttttggcatttgctatgtcatctggtatccctccagactgcctgggcctccacgagtcttagatgcctgaccctgcagggccaacatgaagggagccaccacttcaaggtcccatccaactgctgctaggaagccaggcctgagaggggctctttagtgttgttctgttttaagacctcaggctataggatctgataaaaattatcttcagactagtggtgtcataaaaaccccttttcccctgaagggacccagcaatttgaaagtgccttgcaaagcatgttctcctggattcttcagagcctttcctgaggcagacgagcatctgctccaagtcagacaggaggaaactttgtctctggggactcggccataataggccttagaaaccaagatcttaggccactttttagtttttcactgttagtaattcaacaagattcccctggcaccgtgcacactaccttctttgagtctttacatcagtagagaaatggatgcacagatcatctgtgtgcctctcactgagcccccgctaaacacacgactaaaaccagctctcccctagaatgcattttgtttgtttggccaaacacaatgcaatagtgtccttgaccccttccagttgaaagtctgtctgcctctgactggcagaagtacctaccctctgccaccctgtgttcattttccatttctgtaacagtcttggtgcctcccactatcatattccaaaatcccaggtgcacagagagtgttcttacctcttaaaatgttaacaacaggcacatctgtatatgctgccagagtttcaagaagataaattatcttcagccagaatcaaaattcagcaacagctcccctctgaccccccgaccctggaaccaggctctcccactctgggagcctgacaataaaaccttttacctgaatgactacatatcactgggctttagaagggatcatcatatatgctgtcattcaaaatgagagtaactttgaaagtgaaaggggacactattaataaattacatggggacttcaggggtataccagcactgtcacggaaaaccaggacctatggagcacttcgaaaaccctgccctgagtgtgggtgctaccatcaatgctgcattaaaaggacagccacttccctctggaagttgactgcctagcgcaagatacagacaatcaaataatcacccaaatatgcaataatgacctcacctaattatgatgtatgctctgaaggaaaagtcctgggtggtatgacagaatattccaagggttaacttgactggggatggggaggaggactggagtggaagagaaggaagaggagaagggaataaggctgcaggtgggccctgaaggagaaagcacagaccgggaggatttgatgctgcaccaaaagcagcagaagctgtggaggtcactcatagcatgaggtgtcgtgatcagacagacatgaaggaccactgaggtccagggcaaagcatgaaccgtaggcaggaacacggaaggcagacagcaggaagccagggcagttgggaggatggaggctcagaccagggcactggttggactcatgagggcaaagggagagctgaaaaggtaatacccaaaggtgataggtgagagggttaccaagattctggcttagccagaaaataaaagggccagtacataaaacagcaaagccagttccttatataaccctaaaatgccttagggtggccttgtaatctccttagtacagcatgaaaaatcccttgcaaggtaatgttaaaatgaaatgcaaacactaaaactacgctacaacagttttccctcacccacaaatcaatgaacctttcaacagtttaaacaagagagactcacctaaacaactcaataattctcagtgtttgcagcgacctgttcagttatgtcacccaataataaaattgcagatgaagttatgagtcctgagtgatacaggaagtttgccttgagtgtacagagatggtattcaaatctcaaaccctcttcaggattcgaaatctctaaaatcatatctgacccctatttatttcatcacttcgatgaacaattttatttttaaacagaatttaaaatgatcagcactcaccctttgagaaaatctgataaataaacacacaggaatggtttaggttacaatggctgcactaccctgaaccactgcccgcaaagactggatcgtcatgaaatatatcacagacaggaaaaggaactctgcccatcctcttttgtatgtcatgccaagaattctcatgtacttaaaagtgatcaatcacggccgggcacgatggctgacgcctgtaataccagcagtttgggaggccgagacgggaggatcacctgaggtcgggagttcaagaccagcctgaccaacatggagaaacctcgtctctactaaaaatacaaaattagccaggcgtggtggcacacgcctgtaatcccagctactcaggaagatgaggcaggagaatcgcttgaacccgggaggcagaggttgcggtgagtggagatggcaccactgcactccagcctgggcaacaagagcgaaactctgtctcaaaaaaaaaaggaaagaaaagaaaaaaaaagtgatcaatcacaataaaaattactaacaacttctatgtttatatcatactctccatttcacaaagcactgacctttttcagtggccttggcagcacaagcaggcaaatatacatgggagtatcaagatttatcacaagggcttgactggcagggagtggcagggctcttccatatgctatctctacagcagatgggtacaaggggccttttgccttgccctacctaagccaccaaaggaaatctctctgtgaccaatgtctggattatagcatataaagtttcctttcctgagactgttacctcccaaattttctagaaaaatttccatttcaaatactgtcaattgacatgcacaaaaatgtactttttccccttttggggtaaatgtattattttcaataaaacccatcaaatgtggtttactttgcatgctattataaaacacttgctgtaagtccacacataaggagggaaaaacgctttgtcagatgctttgtcccaaattaaattttttataatatataccacctccttttcttgaaagacatattcccagctcactgaaaaaagggttccaggaggtatccatgaaacacgaaggaaggatctgagaaacgatagcatcctgagcacccaaaatggtgacagataaatttctacagatgaagaccagaacagagtggggagaatgaggagaagataatgaaagggattataaacccaactggacagagtgggagaagagacaaaagatgtccattctttggaaagtcctttgggttggaactgaaatggatcacagaagtggggaccctatactacttaggacttctccacagacagacctgtgagtgatttgacagaccacagcctttcagggtgagaggcaagagagctggacagaagcacaggtaaggaggctgccatttataacaggcactttccattcgccccagtctccaccatcagctgcctgctcctgcacctgcatatctttccacatcacagaagggaaaaaatattagttgacatttagctaattttacagttaacgaagcactctcacattttcttatttagtcattcatgcattcaaaacaatttatggaatgccttccagaagccaggccctggcaaagcttgggataaaacccccttaaggtcctatcccatggggaactcaaagaccagtgagaaatgggtcctctaactgacttagcaccaaagaggtcatggtgacaagcctgggcctgatagtacaccctgtggaggtactatcccaacaatgaatcccctacatgaggaagggatttattggctgatgtcttttatcttttcaccatggcttagaatagttccaatggtggatctagctagatagaactcagcccatatgacatgacagcttgtaaaactcacagtttaatagccagcttgtatttgaaccatttaaacccaccttcgatttatcctttagaagacaaacaatttgctgtgaatcaaagaccatcaggtggaaaataaggtgctgaacgggggaaaaaaagagactacagcaaaacagattgcccagagccattcaaactgaaaaagcacaacatgccagactagcactctttggctgagagcgttccacagccccctcttcatagatgccatccacctggccagaagaaaattagacaaatactctttttagtatcattatagatttaggtattctttatgatttaaaaatattgccaacaaagagctataaggaatatataaagactgaactgctaaatagggtctccctaaataatagggtagggatagaagaagtttaggaaagagcacccaaagggtataattctggaaccaattttgcaagagtaacaataatagcagcagcagctaatcaagccctgagctaagtgctttgtactcattacctctttattctttacaatcttattgtaaaggtagacaccatacctttgatggaaggtagacagaaatggcagaaatatcatttaaagcagaggtaagcgcaaagctacagagtcaagaaatgtaaataagggcataatgtggcagttctccaagtcccaattcccacaaggtggtggaaaaaggactgacacctgcatacatagtggactgctttacagtggaggacccttgaactgagggagcctgaatattttataatggacatcaaatatgccctacacctttgctccatgcaggtaagactgtggaacagaatatggatgagaaaatatgagaggtgacaagtaggcaaggttcctataatggtgcctagctttaatcttttccaaattaagaatatttagctatttaaagcaggggagtatgacataatcagaattgctgctagagaaatctcctgcagtagagtggggagagtggcgctttagggaaggatgggaggtattataacaatgcaagtgagaaattactcatagaggtatgcaataaaaataattttacatataaatattatctctattaatctgtgcacttaaataacaccttgtacataaaattaaaagaaagtcaagtaaaactgctggaaaaaaatgcggctggcagcttcttcatctggatgacaaatatactggactgaaatgtcaaatgtaattatagccagactattaattcacaaaaaagagttaactattttgaacatgaatgatcaagcttattctttaacataagtgaacaaatggtttacttggcttcacaggtacaataagagaggttcagcaactgcaggtcttttggtctccctaggcccagtggagaccagctggagagtggaccctggtgtgaggtttcttagcccagtctacaggataccaaagcacctgatgagcagtccttgtcaggcttaggaaccctcccccttggtagggagcttcccagcttccccatgagaagccccatcaccagcaagttcctcttcaaagagtgagaggcacaggcagtagttatcacactaacagaagtgtctgaagccatgcaacttaaaaggactgtccactttctatgccacttacttaagcctttgaaggactgccgttgctcctgcccttgatgcacacagcactgccacactgcacaactccagggagcatcacgcacattccagggaattgtgcagttcgcctcctgtgtagctgtacatggcggccctcagggataagaggtcactctcccacagatacttccccattaacatctactttctgatccattatttttttaatccctgtatccctggattccagcagtaactatgggtctcaactgatgaccacaggcagttaataattttcacatattattaaatatttagaatttggttttgactaaatgtcattaatattcattttgcaaacaacaggagtggtgtttcaacatcttatctcctatatttgagccctgggagtcctctttaaatctagaatcttaatttcaggcctaattattatatagatatattattcttttgatgggggaaggagcaaaaacttgttgcagtttacaagtaaatacacttttacagctctatcacaaagaaaaggtacaaaaacaattgttctgaacaaatgtccccacttggctttcattaactgcataacttaattataaatgtttctctaaatcgcccaaaccaacttcaagatgatctaagtgtcactctccaataggctggttaactgcttgaaagcattttatctataaatatcaaaaagtaaacttagaaattatctttccttcatgtccaacagtgctgaaaggtgaaaagaaaaagaaagaaagaaattatctgcctcagtccaatttcaacagagccagcctgtttctgagatcggctcttcctgctccttcttaactctgctccacggtcttggcctggactttcccacctgtctcttcttatttcagggccagatgtctgaccacccttgcgccttgcctctgcctgggttataattcgtgcccagtggggctgtctacgctcctgatgccatgagttctcctgcccctgccaccataacactggaccctgttgctccgcacgctcaaaaatcaagcactcccatgtgtcacagttttacatgttgcctcacttaaggtacaacaatgtcagtaaagatgccttggtctcccttggcactcagttccctggagatatactggccagaggcacagatatgaaatgcctgtgaagccttcatcaggtctaagggagctgagatgctctgaggagccacccaccatgaccctttgaaccatactttgtgggggaggcccgggtgattacctcctaaacaagacacatctgaacgcatttaactggctaggtatcaacttatatgtaatacaccggcatttggtttctttgttttggttattttacatttactagtttattattttaaaaaattacaatggatacagatgaagagattcacaggtaaaggtatggggcaagggacatggcgcttccatgccctttctagagcaccaccctacaggaacctccacatgttcagctcatctggaagctccacctgtatctggtcttgtttgattttaccctactcgcaaggtaataagttagcctgttactgtttcatagaagctggcagaagacatgagattcccgggtcaaggacaaaggactttattattcacagcatgattcagacaacaccagcatcatgtttacatcagtccaatggaaatagcgttgaggggcccagatggcagctgcacatgcagtgagcgtgcatccagctgaggaacctatgcttgggaaacctgctgctttatagtaagcagtaagtgagagtaggtcagtctttgtcccagaaagagacactacttcatccctcaaggctgctcattgcaaacacaacacgaagaaatggcccaggtaaagaacgttcttggtatactcagtaagacatgcaggagcacaagagacccatggagaagtgtctcccaacaatttgtgtgtattcccaaacttagatgactatccttacggggttcttggtctcagcaactcctccacatgaaccccctgctacactctcaatgtcatgggttacaaaagcagcagtacatgcctctcactggaaaaggattttgaaacactgatcttatctatgttatctatctattctaatctaatctaatctaatctgagacaaggttttgctctgtcgcccaggccagagtgcagtggcaaaatcataacttactgcagccttgaacttctgggctcaagtaatcctcctgcctcagcatccagagtagctgagaaaacaggcacaccccactgtgactggctaatttttttttttttttttgtacagacagggtctcatttttgttgcccagcctggtcttgaactcctggcctaaagcaatcctcccacctcagcttctcaaagtgctgggatcacaggcataagccatctcacctggtctcaccccataatgtaactgtttactccaatatcacagtgtaggattccccacaagcatatccttcgctcaatatggtgacccaacccagcttttgcttctttccttcctttctgtttcactttcttcaccattagaaacttatctatgtttagaaatgcacgagaaatcaagaaatgaatgactagtagataggacagaagctggtttcaatctggtcaaaacattgttccagaaatctttacttagttaagggaagaaaaaccatttatgacagttaaaggaaaagaaagcacttataatagctcagaaaatgaaaaaggatcagacagaattccacttgacaaatgctcacattctgaaaggcactaacttagggaagggagggagctttcctttactataacatcaatgattttttaagacatatttttacttctcagacagtgaagaacaatttaaaatgccagactccttaaacttcagcagcccataaaaatcgtttgcaacaaaaaaaaaactgtaatcatgcaaatataaattcaattagagaatctgtaactgccataaaaatgaagtatatattaataaattaagcaacttcctaaacatgcctatttttacacattacaaatttttgcagagacccagatggatgctaactttgttcctaggctaagaaatttatttcagattcaactaacgtatttcaattagtaattatgggatagctgctatatttcaggtagttttctaggcatatttatatacatgattttacggaaactgtaatgttctgtagatactaccattttaaaaaaacaaaacaaaacaggtaggtctgtggcctgaaaatgatccctgaggtaagacataagaaatgttggcgttgttatccagaaaggaaggactggccaggccatgtcaggaatggacgtggtggacagctatggctacacaggagaggaaattacagcccaggaggagaggaacatggcagctgctctgatgagaaaaccctcagatccagttgccaaaggaaagcatggagatacactctcctccaatgggtgggggacaaaggaaacaaagcctggcattagtgacaagttctattatacagggtacacttttctaacaaggaaagttgagggtccggacactgacaacaccttttcccaggtgacagtgaaccaaaagcccgcaactcccctgagtgggtcacctactggtccctcaattatcacgtcagcattcactgagtgctcagggttggatgtacatcatctcatggaatcttcacaatgatcctagaggtcgccactaatattacccactttttgcccaaaaggagtagttcaaagtgatgaagtaaccatccatggtcacacagcttggacatatcaaggcccatgtttgaatccaggcagtctcacccttaaccactgtcttacatgttgtaatattctctgcctagcattgggaagaggaggggagaaaaagttaaatcacagaaataaaaaagtaaatatcccctctttttatataatctcctactatctggagctcatcagtataaaacaataaaataaattccatggatacctgcattctgtaacaaaaaaaccaaacaggacatatgtgaatgtgtaggttatgttcgtcaccacagaaccttcaaacacctaataacttgtttaaatgaaatataaaaatattaaagatgacaaagaatttcaaataatgcctatgccatcaagcttaacttactcaatatacaattttatgtgcaaattaattggaaacctttgtgtttctgctaacttaaaggccacatatggaatccatatgaagcagaagtttttgagtctgctcattccaaagcatgagagtaatgcataataaataacctgaatagttacttaacataagcaaggttgatgttaatcaaaacgactgcgccaaaaccatttagtggaaccaaatacagtcaaagtgctgggacttgggaacttggacaattcagcgtgcacacatcctacaaagaacacaggccaagtgccgacttcatcctaattcaacatataaacggtaagcagatgccttctccaccagtctcagctcaaactccacccatgggtaaaatccaccaggactcccactgtcccctctgcacactgttcctacacagtgataccaagaacacagctgaggcacctgagatgctgggctcccagaagagaagctctgttctttgttttataaactggggtctttgcttaaaattttggttaggaaaacaaaggattccactatgaaaagggtaggcaaagtgttgaacagtgagtagtaaaaactaggacccaaattatttgtaaggtctctttcaacatataaatcctaagattatacaatcagggctgcaaaagaccaattaaagcatagttctaatacttgagtgctaaaaagattggccaaagaacaatgaaataagcatttgcacagctattcctgctcaaaagaattccaaccttctgttctttcatcagcaggtcaaccttcttagagcaagaaagaggtttagcttccctaaaagtaaaaagctctgtcttctcaattttggaattagaatcacagaaagaagggggcaggtgagggaaaaattccacagaaacaacacttaaactttaaaactggattttaaaagattcttagcaataattaatcatttgttggggtctctagctaagacttagtaacttcatagttcaaagagtttcttttctagcctccaactaataaccacaaaattttttttctgcttatgtgttagtttctaaaatggatctccagcttttaactttaaaacaagtttcatttagtttgcatatttatagtatactacagtaaagaaattttagtctcttatgaatgaaaatatttagaggtgatacggtcatttaggtagtttctctttttttttctccaaagagagcacatatctacagtcccacactacataacgacattttaatcaatgacggaataactgtggtcccataagattctaatgaaactgaaaaattcctattgtctagtgatgtattgatgatcttgatcctgtataggtctaggctaatgtgtgtgtttttgtcttcatttttaacaaaaaagttttaaagataaaaaataatttttaaaaaaaggcttatagactaaggatataaagaaaatatttctgtacagctgtacaatctgttaagctaagtgttattacaaaagagtaaaaaagctaaaaaaaggttaataaaataaaatgtgacagtaagctgaggttaattattgaagacagatattttttgtaaatttaatgtagcctaagtatagtgttaatgtagtctgcatttgtgtacagtaatgtcctaggccttccctttcactcaccactcactcactgactcacccagagcaacttccagtcctgcaagctccattcgtggtaagtgccctacattggtgtaccacttttttatcttttatatttttactgtaccttgtgtatgtttagatacacaaataccatcgtgttataaatgcctacagtattcattaccataacatgctatacaagtttgtggtccaggagcaacaggttatgccatacagcctaggtgtgtagtaggctacacaccgtctatgtttgtgttgtacactctacaatgtttgcacaatgatgaaatcccatgactcatttctcagaacatacccctgttgttaagcgatacatgactgtactttttttaaaaagtccaaggatatagatcagtatttaataagcatcaaggatatatattggtactatatattttatatttaagtggaatacatatgtatatatttcacaaaatatatttcaatttgttttgagacccctatcccttcacttctaaaatagtgactctgtatctttaaacatgacaagtaaaacaccgttttcaaatttttgtgcaattgtttcaaatcttcactggacagcaaaactctcaaagcatatagtgagaatattagggattattaatcttgcagggtcaggaaaaaatatgaaaatgccacatatagttgtatcatctagacagctcttcattcagtttattctttcaaaacccaatagatgaagccaaaagaacttggtaccaaagaaaacactattttccctaggattccagttatgagattaaaaacaaaaacagagtaggctttctcacaggagttgccctgtgggcagttgttgcccatccttggataagtagggcaccaataacgaaacaggtgctcaggaagttcccagcccgtcttctgcctccataaggtcatgctgaaaaacatctaaaactaacagcctggtttcttggggtttagttttcctgttactgaattacaactcctccctttttaaaaagtatagagtttttcaaatgcctaaaggagatttattgatttattttttttttctggttgtgtgaaattgatgtttattcacaaggtatttgctctgtttgttgaaaacacttattttaaatgttgtcctaagggggaaaggccggtaaagtcggaagaaatgcttaaaagccactaatgtaagagcacatttttcctttaaaaagttaattaactaaggtttgctaaattcaaggcctcatagggaaatacaactgaaactctaaaatatttttttcatttgaagtgtttgttcactgttctcggagcacctgacgaagagtttccacttttaatacagttgaaccgaaagaaaatattattgtagtaaatttcctttaaaaaagcaatattgatgttcccgtatttttggaataaaaaagcacccttttttttttaaattattatactttaagttttagggtacatgtgcacaatgtgcaggttacatatgtatacatgtgacatgctggtgcgctgcacccactaactcgtcattgaacaatgaaaagcaccctatttttaaaatgcattatgtaaatagactcattccaaagctgaccataagcaatacctatagtaacttgaaagaggagaggaggaagcccactgagatacagttcctaagcatttaaagttgacttcctgctggcctgagatacaatttcccaaagcattttccttctcatacctaagatgtaactactcactgggcctagggttagcaacttttcagaaatgggggatgcccctcttctctcccacactctcaacagaaaacagaacatggagtatgcaaacatttaaacacattccccaagcattttacctctagggatccatccacctcactaatagatttcagtttataaatgcatgccttgctgcaaattacttaagcacaagtgttccccaaagtgcgattccctggtgacttggggtaccagaagagaagttttagaacgtggcattaaatatccttcaatataaagtcactggttttcaactatcttttcatcctctggtctagttaaggagaaagtctccatttgatgccagaatgtcgaacacttgctacacttgttaacctccattataacaaaagaaaagaggcctctgactcaggcttaccaacaggcaccaataatagctacctagaagttagtaagtcatattattgtcattatatgcatttgaatagtgatactttttacattcctttttaaatatatgtatttaagattaaaatcagagtcaatttaaaagaaaagattgtttcagatggactatatctttgagattcaaagtgagatcagtgggccagagccatcagcatcacctgggcatttgttaaaggtactggatctttgtcccctctcactcctactgaaccagaatccgcatttgaacaacatatcccatgccacttgtatgcatattaaaatctgagaaactatggggtgacacaagagttggtccaaaaccatgcaggtggtttacaaatggctgaactttgggactcgctgctttagatcagctggcgacctaactcctgatcctcgctgaaatcagctagtggaggtcaggaggaccaggaagtaacatggttcgtgtttacgcaacagggagtcacaacccatctgaggaccatgaggttgattaatgaatctaaaccagcagttttaggggtgtttctggtaagctagagatgactttaaatacgcttctgttcctgttgtgctacatatatcattcttttttactaataaaaactacagtaaaaattctacttagacttatccctttatcccctgcttccccttgaagggctggggttttcagcatgccttctgcatgggaatgagtgacaggcacctactaatttagcacgccctggccttcctctcagagctgagcccagttatatggaagaggcaacttggaaatgtgacagcccacgtctcctgtgtcaggggacagtacaggtggcaaaaaaaaaagcacaagctctcatcgcatcccattatgccctagaggagaagccagtgagtctctcattcaccaagatgattagtcaatgatccaggtagttcaatccaaaatcctagctctgcatcagctggaaggacatataaggggaaaacccaagttatcaggatcactgactcaagtttcaccttcatgacctcaagaatttgtctgaaatagaggaaaaaaatgaccaaaatatgcaggatttatgataccataaagaactaaagacacttagttacagccatctagatagttccagaatgcccagatttaacagatgttgacaaagggtatctatcctccccaccccacccaggtgttaggcctaacaccaccacagctatccatcagaaactcaacttcccagtacaaaatactaataggagacactttgattttgcaaagaaaatagtgaatgtaactgggtaaagaaaaaagggaaaattaacaacaaacaatagaagcgaattcatggtctggtatccacgataagaactgcgtgccactcattacaatgaaaagaacactgtgaacatttgttagatctttttttccttttaagttattttgagaatgcacttatgtaggcagaatattacagagaacaaaaaatatatgttacaatgtaagattattttaatgattctgaaagaagggaaaacaatcaaaataaattatgaggaaaacagtataataattgctaatacctattgactattccaagcagtttacacatattaactcctcaaatcctcaggattccgagatagacgttatcttaatactactattaataatattaatactactaaacgtgccattttgcagatgaaggggagacttaactgcaaggtgggcaagtaacgtctaaggtcacaagcttgggaacatagctgggtaaaaatccagacacactcaaagtctaaactccttaacagcagactttctgccctcccaccacaagggtaccagaatgcccaagttaggatgaatctttcaatactctctcactctgaaccagacgaagaattcttctaaaaggtcagtgacctatggagtctccagttaaagggctaggccacattgatacaactataccttaaaagagaactaacttttggcattaaatgcatcatccatgattagattacttacttggcagaattaaatgttaaggctgcttggggggaaatatcaacagttggaggaaatttttgttggaagcacaacattatgctttgagaaatgcttaagtcaagtattcctcttttattaggactacttaattgagtacaatgcattaaaatagctggcctgaatatttattagagcaccagctgttccctccagatttttagaaattcaagccttagtgccaagtgtaatttagaaaaattttccaacaagtaaaaagagccctatgccttctaatacttatcaaaatagtaaatagtagctggaagtggtatagaacatcacttttcccttccaatgaagagagccaaaatgttttgccatttgtagatgttttgccatccacaaaaacaccattttgtaattgggcttagtgattatattacttaaaaattataccttgtgattcataactaacaatcctctatgtacatatggataatatcacagtgctaaccattgggtttgcataccattctggtttggttttgtttggttggcttttctgttttgttttgtttaaaaaaaaaaaaaaggagtggtgttagacccagtaaaacagctcagagaaataatacagagttttattcaaaatgttatttttcaagatttctactttaggaacccagccgtaatcaaagatctaactttcaaagggggtgaaggaaaaaagaaagttaagaaaataacaggaaaacactaggcataacccggatattccacattgaagctttctaaagaacactggcaaatatcatgtctgggtcttctgtatttgctttattgtcaactgtctttgtgacagtgctgcaagtttggatatgggaaaagaaatgtcccctccacagcattacagcagagggaattcaatgaacctgtcatgcagaccttgacgcagaaagcaactcccctcctacaaactgagcatagtcagggctggaggccaacgagaaagccccagaaaagggaggctgaaaggaacagcaacagtggatggggaggctgattttttttgaaggagaaggtggtctgcccttgttaagtgtctgtagttagagctactcaactgcactgacacacgcagagtggtccaggacaagcagggcaaaggaaccagaagtctagctcttcactgtgcctatcgaataaatggctagcttctagccctatatgatgctaactgctagcaaactagttgcagcaccagaggttctctttcaagagatttttctcattttgtttttagggctttcaggtttaaaaataaactggcgtttttggattaataaaaaattccatgagggataaaataggccaccttttttttctcgtaagcaaagaacactagcttcatgtgctggtgaaatggtcaccgctctacaccacccacgcccagctctcccacacatcccctccagggagcaacgggaaggagaggccacatcttcccaagaaaaacaagctaaagcttctcaaactcagctgggcatcacaatgacctgcaggaagttttgatttttttcttaacagaaattccaggaccccatcctggatggacctactgaaccagatctcccagtgggaagactgaaatttccttactaatcaggctgccacactacatgcataaaggggtgaaatatcaactaatcctacagaagtgacccctagttagtgagagggacttcccatgcatggagagattccaagagataaaaacccacacgaggagtaatttttttaaaaatgtactttggccatcaagattcaaagacatctaaaggctagaatactggttcttttctttcttaagtggtgggaccccttttttcaagcaaaatctttcttagtatcccaaaatatcaaactaataaccaagcttttctggaggaaagagaggtactgctcagtccacaccccaccagcacagacccacccacccacatacgcctcaaggaggcctaggattgctggtagcaggtttgaaatccaatgggccagaataagacatttaaatgggagaaataaacagaactaaatctaaattcaaataattaactggagggttagggcttctgattagcatatagcttagggggatggtttaatagagttcacttgaaaaagtgaaggttttatttcactaaaaagtcaatccaagccaaagtgttcgttggctgccagggaaagcaagtgcagtttagcctgggttaataactagtatttgtatttagagatttaccatttatgaagcacgttgatatgcatgatctcacataatactggataacaactttgcagaaaattattttcctggtttttttagatgagcaactgaggaactaatctgtgaaagtaacttactcaaagtcaattccagacagtagcagaggcttctgccaccaggcacagcacagcctagggactgaagggagagttcaagagcctgctgctcttcggatggttagaaaagcctgtgaacaacgtgtttcattctggttgctgcattaatagaggtgtgtccaaatgggaccctaggcagagcaccgtgaccagggcaaagaacaatctggaaacagtatatgtagacctaacactctaaaaccgaaccctgacatgctcttcaacatctcaaaagttactccacatctctgtactccaatttcttcatctgtcacaaagatataatatgtttggaagactctttgagatgcttacaagaaaaacatcattagtgtaaacacatggaggaactaggagcttttaaaggtggaaaacagaatgtttaggaatgacataatggctatttttaaataatgaaggaccatggggaaggaagataagtcttattttacatcattcaagagtagccgaggctcttcgccttctccttcctgaaaattcaaagccattaggtaggtccaatctggtaggcttcctacgtttacaaaaacgtaggaagagggatgctgtggaagcccagagcagggtatctcagggagaaaggtatccatatggggatgggggtggtggcacaggatgctagagcactaacagctgaggagggcagccccaggaggaaaggtggtggcagctgcagaagattggttacatatggggagatttaccaaataagtaaactgttaagaataatgcgaaccaagaatctcactgtcaaataaagcagttataaaatatggagaggaaaaactaaaccctgtggtatcagacaggaatttaaggtatgactgtaaactcatggttttaaaagtacatagatacagaattacagatgtacatgtgtgtctgtatatacacagagtagcaacaccctaatagcaatgagcacaccaagcaaccagatcttggcttctaaattccattctccattcaatagctccttggagaaatgtctgatacaaaagatgacacaggtaaatcacaaaatgagtttggaacatcttattctgccagagagcaagatggtgctcaaagactgatgggagttaaaagagcacaggagccaatgtgaaaagactgcactggccaaacctagggccattttaaataaagtaatgacagtaacattaaaccacactgaaaaaaggaagacactaagttcttactgatataaataaataacagattgaaaatttgatgaggaataggctatttacatggtttcaatgtaatttgccataaaacatttataaattacaaatgagaaaagagtaactatatggtagagaagcctggcagacaacaccttgatcaagtgaccatcatcagtaatgggacaaacagaaatcaatgccaccctgatagggtacaatgagaacgcagcaccatttctgtactattcctaccaaagatgcacagcctgaatctaagcttgtgaaaatggcacaaacacaaactgagggacattctgcaaaataactggcttataattgtcaaaagtatcaagagcatgatagtgaaggactgaaagagactaaaaacatgtaactaaatacaaagtgtggttctgacctgaattcttttgctttaaaacattatgggagcaactgggaaacttggatgaaatctaaggattaaatggtgttaatgtatcattggtaatttcctggctttcatggttgtactgtggtgatctaggagaatagtccagtttacagaaaatacatactcaactgtttgtgtgatagccaacatgctggcaactttgtctcaaacaggataaaaacaggttctctatactacttgcaattttcctattggtttaatgtttccaaataaaaattttaaatgaacagtaaattaggaggatggaaatgatggggagacagataacatctagtttgaacagatgaaactctacaattaaagtggtccaaaaacagatccatgcttagaaaggtaggcacgatacaatggagaatgcttcactgactaggaagttagaggagatgattcctacgtactttctgatgattttgtaattctttccttcaacatacttttttttttttttttttttttttttgagacagggtcttgttctgtcaccctggagtgcagttgcagcctcaacctcccaggctcaagtgatcctcccacctcagcctcccaagtggctgggactacaggcacgcatcaccacacccagctaatttttaatttttaatttttttttgtagagatagggtctcactatgttacccaggctggtctcaaactcttgggcacaagccatcctccagcctcagcctcctaaagtgttgggattacaggtgtaagcccccaagcctggcccaaacgtttatcaaaacatctactgtgtttcagacaatgcgcaagacactgggcttatgaaagtgagacagcccccacacttgaagcccttataatccagtggagtatgatttatttggaagttagaaattttaagacagtcatcagtattacacacagaaacaaacatgtgattcaagaatgctgtctacaatactccaattttcatttatgaattttcaataggctacaattattccaccatattcttgaagaacattttcatcctaacttttttgtgcttgtgggtggtgttaattgtggcatatgcaaaaactttatcacttttcgattatgaacagatgtaaatgacttacttgatgttttattttagaataacaagcatcttctaaaataagtctccacccaaaaagctggggctatcattacggaagagacttaacactctgaaactgaaccttgacatgctcttcaacacctcaaaagttactccacatctctgtactccaatttcttcatctgtcacaaagatataatattcttggaagactctttggggtgcttacaagaaaaacatcattagtgaaaagttctgttaaaaatgcagattgctttcaccttttgccagggactacctattactgtggacattaaaacaaagtgacccatctaaatgagtgcaacattttggcaagtttatggtggttgaaacatgatttggttttccaacttctccccacttggcttcatttcaatctgcggagtatatcaagtgagaatgcttctgcgccttcatactgccccacagagggagtggccacactaagcaagcctatattcaattactttccccactttatacctttcttacacttttcccatatgacactttcataaccatatttagctttcttcctaccatctccctgtaattcaaaacgcaatttagattcccatatggttgccatcgaagctaacagatgtctagcaaattaaaacaaaaattatgacttataaactgctgatgtatcatcattccagaacatcttgcaatttatagtgaatcataagataaagcttcctacttgatgccccccctcccccaccgccccaaggtttcctgagtctccctcctctctgaattaagccctgtggaagcaaattagaggcaagatcctgccatcaaccctggataaacttgcacttaaagacacaaggtaatatctgaaagcatatcaaaagagaaagttggcctcaagtaactgaggcttttctaatcctttgtagcaaagaaaacagaaaaatgacttggttctcccaaatcattccaccgtttccattgagttctttcctaacaagtcactataaaatctattgaatccatttgcctcatcttcttggcagatcttaagggtattatcattacctagtagtaatgatgccaaagtactagactaaggcattctagaagttctatagccctgtatggaaccagtataaaatctggagacaacaacagtaatgatattcactatttgttaaatattgagatattatgccgaataaaacattatctcactgaatctttaaaactacaacaccattaatgttatctttcctttataaacaagaaattaaggctcagtgccttaatacagtagactatatttttcaaagatggccacaacctacatgactttctgcaatgtgaccttgacacttctccatcaaaaggtggcttctaattcttcaccctttgaaattcagcagtctgcatgagtgctctaaccaatggaatagataaaagtggcactgccagttctaagtggaaccttaactggctggaagcttctttaagacttagagacaggaagaagccacgtgtaggtaggtgctccagtgacaactctggctaagctcccagcaagcatcagcttccagtcatatgagtataccatctcaggcatcctgcccagagggccttccggtaagtccaactccaactacatctcaccacaactgtatgagaccccaagtgagaactgtccagatgagcctggccaaatcacagaactgtgaactataataataaacaactgtgttttaaacaactaagcttggaggttatgtagcaataaataaccagaatattgagatcaatttacttgcctgggaacagttaagtatccagaatccaaaacagttaaaagccagaatccaaaagggcaaaacatctattaatgatgagtgatgggatgtggtgttcggtaccccaaagaaatgactttaaaacaaaatcctctttcttctccctcccccaaacccaaagcagtctcagggttttctgagaaatgtcccagtacggtgacaccctcaataaaatcaattcccttctgtcttgaattgttccaatatataacagaggaaacaagttttcccccaccagcctgtgataactaatgagaaaggaatctgtacaagatgttgactttgttactcagaatgtcattacaactgttatataaaaggattcagattttatacatgaagctgtaattctaataataaaaatatatttaatgactcacaggactacatttgagattcacagtggggagagagaagcacggacactataccaggaactgaacaagccaagaagaaattagtgaaaggttttttgttttgctttgttttgttttttttgagacggagtcttgctctgttgccaggctggagtacagtggtgtgatcttgcctcactgcaatctccacctcccgggttcaagtgattcccctgcctcagcctcccgagtagctgggactacaggcacccgccaacacacctggctagttttttgtatttcagtagggacagagtttcaccatgttggccaggatggtcttgatttcctgaacttgtgatccgtccacctcagcctcccaaagtgctgggatcgcaggcgtgagccaccgcgcccagccttggtttttttttgtttttgttttttgttttttgtttgtttgttttttatgaaaggatctttgaggaagaaatgaaagtaataaaactagtcttcagacaagtctccctaacagaaaatgtctataatttatcacgtgtcctggtatatactacttctgttataaattagtggccaaactcttctatttttcttctccagcatattggaactcaagaaactcattctgtgtaagaactagaaagaacgttataactcatccacctccttcaatttaacagctgagaaactgaggcccaggcagttaactgatgaagagccaaactgctgatcaggaaaagaaccaagctctcagtgctggtgccaccatatgttcaattttattttaccagaactatacctttgaatgtcaccagtgtatgtcaaatgtagtctagcagttcagtgtgaaaatgaaaattaggaaaccatgctgttggcaatctcttcttcataattgtatgggagtagcaccgagtctgctgtttttggcaatcacagacaggttggtgactctgtagagagcagaggtgtgtaacttttcagaagcaagctgccaagctactgaccccagcttttcagtcactaacatcttagtctgaattactttaaccaaaaccatatggttgcctttctgttgatcatcactagagaccatggtacaataaagcaggaaatttaaatatggggtaattttgaggcagagagcaggataggaaaggtatgagggagtatctgagaggaaggctttgggcacagagaggagaggaagggaaggcaagaggcagggtaagtgaagggccctcataaggaaggcactcacttaacaattctgcctggggcagctagtttagtcccatagcctaggtctcctttcaggcttcccatactcacccacccacctatgaagaccttcacaatcagaaaacatgcggctctgttctggacctctccaagcaagcactctgcaattctttgaagctctctacaattccaggggttttgctgcaacctaatccatagaaagggctaaatttgtctctatgcactccacagaattacagcaaactgtcagggaaacagacccaaatccttttatttccttaccaccccctgctaggaaacggcagagaaagtccctgggtgctttttgttgctgggtagctaaaatgtgcaacttttagaaatgttcaagtagaaacaagaggcctgaactcactaccccaaaaagaaccagtcccagttcggtagtccgtgcctctccaagtcacaaagtttcaagttccaatcaaatcagaatatcttactcaaaaccgtggctacccaccacttttaaacattttcacaaatggagaaggggcaaagaaagaaaataattccttcttcctgtacttgtagcagtgtttaattgcagggaggtgggtgactgctcccgggaatcatgcacaacactggcaaaaaactgcctgtggaatgatcggatatgacatccattcatgtgtcccctcattatctttattagtcctgaagacagatgacatgctgacacggaaagtggtctccaatcccttgcatttcccctcacaaaacatacatgaccaatgcaaggtattataatagaaaacagaaaataaaataacctggtaagagtgcggtacaaaaaaagaatatgaagagccgtattgacaactattctcacagatgtatatacgtacagcaaacagcccaaattaaaggagaattcaaataaatacattccgtgttcagactgctgtggataattattgatcctgcagttggagcattgtttacctcacactgaacagcaacttagagaaccccctacccagacagccaccatctttactttctatggaaatgcgggtgcccactgaggaagaggatgagatgggatgagaaggggaagaaaaataacatggtctttgaaccaacgttttccccttgtcctggagaactctttgtctggctgctgaacacgtttgccagatcaaggaaaagaatcaaaacaaacaaacaaacaaaaagagtaggcgtcccagcctaattacaataggttcccaacacattgcagtcccaagcagagcatcatttgaatcttgtgttaaagcatttgctctctcggttccccaataaaacatgcctcgcacaccttctcctttgcatttctacaaaggttcccccaaacggcccgctctgtgtcactcctttaaaaatgaggacgtggggcaggaacacactgaaatatatgttgacggtgacttattatcctgacgatgatatatacatacaaataaatccctctaccccgcacccccactgaccagtccattacgcacagggagcgctttccagctgaagaggagagcgtgcaggaaacgttatttacgtgcaattacaggaccatataccacggcatctgcatcctacacaaagcccgagatggtgcaagaagatacacgctgagcatggcacagaccagccgcggcaacacggagccaagccctcgtccaatcagatcgttgttagaaggtggacctcagggtcggccgtgcccgattagccttccctattatgacaccacgctctgcccaacatctatatcccaccgagagcaaatccaattcgtgtggttgctcatttctcaaactgccgaaccctttcttttatctgcatccctgctattcgttcctcaaaaagccaccagaaggcctcggtgccccctttccgcctcgatttctcttttcacctcttcccattcctcgaaaggattaaatgtttatctctccaacgcgcaagctggaaaggcggaaggcgaatgcctctatgctgctccggcaagcgcctgcggggctgcgaaaagtaaaggcaacgaacaacgtgggggaaatcgtcgcgaatcgatcggccacaatagttggaatcccaggagcgctccaacttacccaaaatatgacattgaagccaaatatgaagtatttgatgcaacaactgacttcaggacccttgtagtgcttcccggacatcctctgggttcatgaagacacttgccccggcagcccgagtttggagctccgaagcaccgttgctcggagcagcccggcggggagcaggagctcagggacaccgcacggggccgcggcgctggcggcctgggctcagccgcgcggggaccgaccggcggagagcggctcccgcacctccagcccctcgcgcgccgaggccgccggagccggggtggccgcgagaaagcagggaagccgcgcgctgcaagctcaagcctcgccgacgctagccccgaacacaaagcgagcgcccgcgtccgtgcgccaggcggtcggtccgtcggttcgtccccgggcttcgggcaaaggcggccgcggcagatgctggtggagacgccgctcgcttgctcgcccgcccgttcgcgcgcgccctcccacccctcgctccgcccgcctctcgctccgcccgcccggccggctgctcctccgcccgcgccgcccgcagctccgcccgccgcccaagccttggctaggcgcgcgcgcgcacggggtcgggcgctcccgggcggcggtggcaccacgtagccgcctccttccaccgctcgctttatccccgccccttctcgggccaaccccaagcgccgctgaccccgaacgtcgctgcggggtaggtagggggtgggagggtggaggaccgcaggcgagagggagaaggaagggcgcccggggagcaggctggcagagtgaccgggattgatgagcggcgcagctctggagggacgcgggcgagagggtcgctcctcggggagagggctgggtgagtgaggacctgcgagccacccccgacaccccttccagggtagccacactggcgccccctcctccacaacaggcttatgtggctagagaagatgcgatgccactggacagggaaggaaagtcgtcgtggacttcgctgaatggaaaagggggtagttggggaaggtggagaaaagagccacgggaagtgggaggaaaggatgaagggatgggacgttgaaaaggaaagcttcctgaatccctgtgtgactctaacccaacctccccacctaccggagaaatgggttttatcctagaaatggggacgaggaaaaagagatggctcaagggagtcctggcccgggatgcgatcctcgccctagggtctattgcaaccacacaaacccggacagcgcacgctcccccctaccccgacagaatagtgcctaagaaacctgcttgcctcctaactctaggaaggaatccacaacggattccagggaggtcttctggggaatctgaattgggtttttggatcacgaaccattaagcttttgaactctggggaagaatagaacaggtggctggaaattgttttagaaccctacctgagcaggtgtgctcattagttgcttatccgccctcctcctggagcactttcataggtgttggcaaagcaggtaccagtatttcacggaaggagaaggaagaaccgcccaggactgtgtataaatgtctatgggaatatttttaaggattcaaaaggctagaaggaggtgagatcaaaaaatttttccagcaccacccagtgcaacccgatcctggacacagaaatctaaaagatgatacttaaatacttgagtttgagagcctctagttataaggtttcctacgtaacaacctctcacttttctcaaaaactggctagttgacaaccggcagtcaagttttggctagtcaagaagctactttttcctgcaataaaccacatttagagatagtactgggcttcagcaggattgaggctatattgaggtcgcaagtatgaacgaggtacccacagagatgggagggccaggagatcctactcattcagtacctcagaagctatgacacgggataacagtagcttcagccctttggatgaaataatcctcactccctcaaaagtgctctctacccactcaaaacacaggccatactaccaccaatctggtagacttcaaaagtaaggtctttcagcagcagatttccttgttaacaggaaggtactgacaagctttacctaagcctattggagctatgttgtaattctgtatataaatagaacagtcgctgcaggaatactggatgagtcagaagaaaggtctgtcctaagctgatgtgacacatttcaaaaggaccagaaattagatgcaattgatgactgagttgatctctaagtggatttatctttgaaataaaaatcagtggatatcccatatacccgaccccacaccctcccccattgtcaacatccccaaccaaagtagcacatttgctacaaatagtgaacctacattgccagatcattatcacccaaagtccatagtttacattagggttcactcttggggctgtatattctatagggttggacaaatatagaataacatgaacccaccctcatagtatcatagtatcatacagagtattttcactgccctaaaagtcctctgtacaccacctatttatcccttcctccccccagtctctggcagccactgaagtttgactgtatccctgtctccttagttttgccttttccggaatgccatatataaggaatcatacagtatgcagtctttctttcaattttgctgtgaaactaaaactgctaagaaaataaagtcttaaaaagaaaaatcaatggagaagggaaaggtaagataactaatcagtaatttggaggggggggtggaaaaactaattgaattatctcatttcgtatatccaaaataagttctatgaggattaaggagttaaatatattttaaagcagaccagaaggaaaaatatttgtcaaacctctgtatagaagtatttctcaacttagaggcaatagaaggaaataatcaatggatatgattgggtaatatcttaaacacttctacgtgtccagctttttttagtgtaagctaaaccagaaaaaaaattggcagcaaacatgaaaaataaaaacctgaatgtctatattataagtagggctcatagagctatagtaaaatatagaatcgcagtggttgagtataaacagaaaataaatcatataagaaataaaatatatggggaaattaatctagtaataaatgaagtatacattaaaactaataaagatacaaaaataatgagcactggttagcacatacattgttggtgtccttatgaaataatatgtccatttggaaagcattttggctgtatatatcaggtcagagtgctcctacattttgactcagcagtccctcttctgggaatctacccaaagaaataccccagcagatggaaaaagttatacactgcaagatgtatatcatagcattatttatattgaagacttggccagaaattaaagatcaaagagtaggggtgatatccaattccttgtagttacttggaccacaatgttccttcacattctgtgcctctgcacatgtcatttagagtttctgcctggggcattctccttgtctcttgtctgtgagctgatttctcttattcttcactacttttgttcaatgtctcggaggctccttctttattccctcaacacccgctgtgttcttccatcccggcacttaaaggctgcctgtaagaacttgtttacctacctgtctcctcaatctgctgtgactccttctagggtgtgacctaacccttggtaatcttagaatcaccagagctctgcagatatggcaggtgcttgataaatatttattaaaggaatgaatgagtcatttgctcacagtttttacagctcttgaagatactgcttatagagtatgtggcaatatatggatacattataatgttaaattttaaaggcactatatatggaattatctccaagtaatattgttaaattttaaaaacaaggaacaaaaacagtgtacacagtaggctatcattttgtgaaaagataagctctgttggcaaaagaatatccatacacatatttccttgttaatgggtaggctatctatggaagaaaacgaaataaactggtaacagcgagttagggtggaatggggggcaaactgggggactaaagatactgataggaaggagacatgttttatttttaaataacccctttagtctgtttttgaaatttgtaccatgtatatgatacacgttttgaaaaataaagcagtctacaaaacggtatgcagttgtatgaaaaaaagttaggagttaatttttgccaaataagaacagttataaggctgggtgattttgttttcatgtttctggtttgcaatttttaagtgtggttaaattgcttttacaattaagaagataaaattatacataaagatgtaagaaagtaactaagtaatcatatttatttcacgcaactccttcacaactcaataaatgctgatctattttaaggagaaaaggagaaaaattttctgtctgaatactgctaaggccacctcccttataactctgaggttgaaaaatggttaataagtttaactactgacaagttaatcagctcttcaagtggcagtgaaaacaggtaaagcgtgttcttctaatagttgcctggctgaggagcaagatatgacaacagcgttttaacctaagacaccaaacttaacgagcttgtctgtctccacctgtgctttattgttcctgcccaccttcctgcctccctcctcttgggctctgtcattgtctgcctctctgctcctctctgtttttcttttgcttctctgtagccgccctgctggttgcctccacacccctcctgccgccttcctctcagaaccctagcagctgtgttcagcgtccccctcttaaagcagccacatgctctgggaagactggccctctgcgtcacatctggcagtcccattcctcttgctaatgtgtggttcaggaatgggcaggtggcccaattctggtcaacaagccatgagaagaatctgctagaggtttccttgcatctaagaaatggtctctttcgcccttggacttggttgggtttggatgtgatgcctcgatcctctacagcctgatgacaaagaccacaccaaggatggcagagtggaaggataaaaagaaccagggccttccagcctttgttgtatggctgacttaaccaaccttgaaggtggccttactcacgacttcctgtcagatgagacaaatttcttggttaagatactttgacaggggttttccgtttcatacaactgaaagtatcctgacttaaacaccttttgaggttctgccccaagcctttattgattttctcctcttgaatcaccaccagcatttctgcatttctcttagtaccacgttttttctattccccacacccaccaccccctctcttccctagctgtttctgtctcaaacaatacagggaaacattttagggtgtctgacagatcacacccacccctttctcagaccttctcaaccacaaggtgctctcccacctccagcgaggtttgtacttcacagttgatggggtcccggtagattcaggctgggccaacctgagagtctgtctcagtaacaaagggaaccctgcgcccagctgaagtgcaggcaatgtttacccgaaagctgggggtgggtccgcatttccaggaggaagccaagactctccctcatcctctgcagaaagaggaaggaagcctaaacagagaaaaacagtagcagagtctgacagcctgggtgctgtgtatggttgtgcattttgtgctctgaaaggctcccatccctgctaaaggcctgcttctagatttaaagaggactctgtctttgaggtctatgagatttttagatggaatcattcatcacatcccatttgggctttagatactttgaagtgagtatctcaaattttcaaatcaaagaaccctgattaaaacaaaaggtcttctcacctcaaatcctttatgaaatgaggtcaacttaaaatactttttagttagctatgatataaaattaaactatatttttgttatagttaatgaattaatattgtatcttctgttccttagtcgaaaagtgagcagttaaatggtctatttctctaacaaaacaattaactgattcctcaggatttaccgcccactgtgaccctcttgccctgtgcccacacatacctactaaagaccagttttcagatccccaggaataacataaaatggggcatatctgtctcgtaaatatgattgaataagcatatgtagagcacagttgtttcacttttaagaatcaattataatcatttgtacaataaaatgaattatgtctttcacacaatatgacagagcagtaattgatttttttttttaattcggccattccatcttcttctggcacctcaacttcctgctgctttggagatagctagacctgtgtggatcaaggcattaggccctgatgttaccttaccaggggccaagcacatgacacaagttcagccaattagaagcttacttcctgatactgagcagagcaaagaaagagaccaaaagccacctggagttcatttcttgcagcccctggacaagcctgaagctgcccttgagacctttgggagcctcctgattcttctgccttccctctggtcccataagctagctgtcaggttctaactgatgtccgagttcccataagctagctgccaggttctaattgagatccaacgggaatcagtggatgagtggtgggtagctggaaaaacactaaaggaatcatagacagttttgacatggctttaccctctctttgggtgtgagcaagccatatgtacagcattagcagggtaattataccttttacagacagtagtggctccaagcccagcacaagctcacatgggtgatcacctaatgtgcctcacatggcttggttacataatgtgcggagctatgcgcctgcgctccaaacccattgagttatgctgtgccggaagcctgcctcagcctactcctgactaaagcacagccatttcccttacactccaccccctaggcctagggcatcctccaggcaggcacatgtgcccatagggcagagccctgaatccataacccacaacaacaatacagaaagcaacacctcactactaggatcccagctatgccacttatgactattagggcccagtgtaggccagagcctagggatgcccaccatctccacaggggatcatcagtaaggctctcaactgcgttaatctgccatgagaccccttgcagggctgctgttatgttctaccgattgtcaggaataaaggtacaacattgtgttcctaaaagtgcacaggtgcctccttgggcagcagtttctatgtctaaggctatttgattttgcaataccacctttctaatctgatcaacctcattggttaacaggaggggggccactcaagtgtaattcagagcccaagtggtgtgctgtgcaagagtggtaacttgtgcttctacggttatgacacccactccagggatagtcactgccaagaggcagaaccaccaggggactcgtcgcacttgcacaaaccgagaacatagcacctcccagttaagtgagctatctgggcaacttggggagaacattggcaggtaaggccacccccaggtgcaatgtccagtccagttcactggtagctaaggccaccctgtgtccccacagacccataaactcccaggggacacaaaatccattggggcccaaccttggtgaggccgctcgttccatcataccttcagtgtggtgacatgtattatgtttgcacaggccatgatgggtacccatcccacaggggtgttgccccaatgtggctctatgtaccacagtacctgggcttggggtactgcatgttcccccgctagccagccccacccatcataaacactacaggccagccagggggcgggtgtgctgtgggtcttacagcatcctttttcaaagcttgccatgttgcctcacagacatcagccatgggaccccaggtctccagccatgtccagttctctgcagatactgaatgtatgtgccaaggcaagccatctgcagctgctgttggaagggcagtgcagatccaacagatggaaacttggtcacctcagcgtaggtgtgggcccagtccaaatgcagttagagcatgttaacctacagttgaaatgacagagcaggtacaggtactaacagaggtaaatcatatccctcaggcaaaatacaggctaatctttcatccctggataacaatgcagccaccaagggcttttgctctgggtgatggtaccacacctcaactccccatggttcctttgagtcctgtatctgtgccaaagtcacaggagagctcataataggccaaacagacagtacacatgtcccccagaggagagttccttccctggctgttcccgctgtaggggccatgtattgaacacccaaggagtgatatacgagtcatactgtaggccctccccccagggagctccgatggccaaccaccagcagtggggggcttggagggtccatggccacagccaggttttctgttcccctgccatcaggggtgttggggcagacaacaacaggttacctttcatccccatacctggttgaaggaggtcatccttggtatgtatctgcaactgcatgggggtggtggcttagtgtaacaaagcctccaccagggctgggccacctttccatggctgttcattcaaggtttggagcgccaggtccagcctggaactccagccccgcaaagacggtggtataacatgcaagcgtaacccatttttcaacagtccgttatattgctcagtcatacccgcagcttgtggtttgtatggcacgtggaatccccactttatgtccatttgttgtgtccattgttgtacctgttgtccagtgaaatgtgttcccctatcactctcaatggacagagggcaaccatacagggcatgtaagtgttgcaatgccccgatgatgtgctgttggtcagccaccctgcaagggtaggcaaacaacaggcctgtgtccttgtccatagctgttaatgaatgcatatactcttgtgacttcagcagcagcctgatgtagtctaccagccatctggtcaagggcactgaagcctccaccttctgggctcaagcaattctcctgtctcggcctcccaagtcctgggattacaggcctgtgccaccatacccggctaattttgtatttttagtagagatggggtttcaccatgttgaccaggctggtctcgaactcctgacctcaggtgatccacccgccttggcctcccaaagtgctgggattacaggcgtgagccaccatgcctggcctgtttcattcttgtagggcaaaagtacttgcatgttcccttacattcctacctccaaacaatttcagaatgccatgccccagtccacaaactccacccttccatctgtcaccaaaatctaagtattttgcagagttaagcataattcaaccccttatgaaatctgccccatttaacactgggcatgctaatcatatccaataatttctcctgtcaccgtttggtttcttttaccttctaaaagctttacttctgtgatatatgcctttctgatggaactataattactggaacattgaatttaatgtccagaaacaggaatagatattagcagattaatcagatattcatttaggttttattataaagaatcaattgattcaacaacaaaaacttacacatcttacacaaaaaaacacatctcctgttaatgcacctgtttccatggttcctgccctaagattgtacctggaaaaaagtagacaaacaggagtaagaacatgggttagaatggtttcagtgctatagttccaacaaagtgtgatatgtgtatgataaatattcaaaatgggattgtgaaaaaacacctcttccaatttattcttttctatttttttcatttttcttttctgtactagtagcatttactaaatgcagttagtaggaataacaattagttaaattaaccaagtcttaatgccttatatctgaatcatttatttgaatgacatcaagactgagagaataagttttaaaatttaaacacagtggtgcatccgctgtggaaaacagtttggtggttccttacagtattaaccacagaattactatatgatccagcaattctgctcctaggtctataccccaaagaattgaaggcagggatccaaacagatacttgtgtaccaatgctcatagcagcacaatagccaaaaggtggaaagaacccaagtggccatcaacatatttcacatttt

SEQ ID NO: 389 - DNA, 28759 bp, Homo sapiens
gcctgtaagaggcagagtcaggatttgaaccctgagccctccctgtactgcctggctgtgaccgccatcaccacagtgtgttctgctgggcttaactggtgtccaggcacttggcttccagcacagcactctttcccttcctccttctcgtattctctctcctttctcccttcctgtctgcctcctttcttcttcttctttttaattcttctccttaaatgccttctcactctgctctgggtgcagacttgacttttcctttggctcatttcttgccttttgtttcaggagtatacaccttaaatgataagaagcagtggataaataaggctgttggagataaacttcctgaatgtgaagcaggtgggtgctgagcactgagcacttaagagagcaggcaggcgtccagcggggaacgtcctagaggcacagccttccagtgcggcttcctctgagcacacaagagccaggaggagggatgtgggagaaccgcagctggccagggagagacttaagcagttaggtgatgactccctaaggatcaccagggtcttgttcattggggcctgaagggcactggctgaatccactgtcggcattgcccacagatcaggagagcctgtgcatacagagagcctgctagagagccctgggtctaaggagaagcaagctccagggagaacaagtcaagggataacataaaatcttaatccatggaagcctagcaggaggctggacatgggctggaactcctgcttctcgttattaggaggaactgttgctctctcctttccgtctcagaaccagaggcaaaggcccagcctcttctgctgtgagtggtgtggaactaccaacctgcctcgtattaactgcaacatctataaagtatgagctccagccaatgctgctctagattcctctttcttcagagatgatgaattattgtagctcctagccctttcttttttctttctttctttttttttttttttgagacagagttttgctctcgtcgcctaggctggagtgcagtggtgctaattcctgacctcaggtgatccaactgcctcagcctcccaaagtgctgggattacaggcgtgagccaccgcatctggcccctagccctttcaatgaatttcagggaattgtgaaaattcctttgttgagataattgtttaaatataatatagttcaccagccaggcctcaaaaaactcagtatttctcatttccttatttagaaatagagctttttgtaatgtaaacaattaaaaaaattattttaaaactgcaactattggaaatgagatcagcaggtggtaaggacaaagcatttaaatctttccagtttatgcagcagtgacagccgccaatgctttcacccctttctcagatggaaaggctcttgcacatttccactcacgagtgtcttgctctccttgacagtatgtgggaagcccaagaatccggcaaacccagtgcagcggatcctgggtggacacctggatgccaaaggcagctttccctggcaggctaagatggtttcccaccataatctcaccacaggggccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggtggttctacaccctaactaccaccaggtagatattgggctcatcaaactcaaacagaaggtgcttgttaatgagagagtgatgcccatctgcctaccttcaaagaattatgcagaagtagggcgtgtgggttacgtgtctggctggggacaaagtgacaactttaaacttactgaccatctgaagtatgtcatgctgcctgtggctgaccaatacgattgcataacgcattatgaaggcagcacatgccccaaatggaaggcaccgaagagccctgtaggggtgcagcccatactgaacgaacacaccttctgtgtcggcatgtctaagtaccaggaagacacctgctatggcgatgcgggcagtgcctttgccgttcacgacctggaggaggacacctggtacgcggctgggatcctaagctttgataagagctgtgctgtggctgagtatggtgtgtatgtgaaggtgacttccatccagcactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccatttctgtgttgtgttcagtcttgagtcttttttatttgctcctttatggtccagggtagtcagaaggtatagagtctactgggagtatggcagaaaacaccctaaacccactggaaatcccgaaggtgatacaaactcttccaccttagggaatcatgctcactgattgagtgcctattgaatgctaggtcccagaaagttaactgttgtccttgttttacagacaaggaaacagagactcagagatggtaagtgagttgcttaaggttacatagctatgaaacagggaagcagaactttgaacccaggtctgtttgatacaaactcagaggtcctttcactgcatgctgttgcctctttaaagcgaattaggagaaagggcatgggcctggtgaggaagaggctagctcaaaatgggatggggaaaaagtgttttaacacagacagtacttcagagtttgggatctaacctaccagcactccagaaaacaaaagatgatgatgtaaaggcaggatctctggacttgctgagtccaaatcatggcttggcccaaacatttgctaagtaatttaggcttcctggccattagttcctggtctcttccatgaaggacttgagccagggtaacgtccctatcagcaataagcttctgggactctgtaaagagtggggaggtagagtccctgcctcagtagaagctgcttttcctacttggaacaaacccacccttcaccaggaatcaaaagcaagctgtctgagcctcctctcctgatggcaggtcatgctattaagggtctcccagaagaaagcttctggagctctgagaaacagaagctcttctaacagaactttttcttgctataagctttcaataccaccaatcaccaatgtgccttcttctcatgcgaaaatacggcccctcctttgcagggtgtaaaatgacactgatgtcactctctctcaccagggtctggccatctctgtgaagctctcctcacaggcaccctgcagattcatcaataaacttcaacaggttagcgctagtaggccaataagacctatattctagaacctgtgaaagagataatagccagaaactggcaaacaccagtcaaactctttaaaaaaatgcctcttagaacacagtcacttacacattttcctagatctcttcagcaccaagtttcttggaagaacaaggcactctgcagttttcttaaagaattgtctgattgtattaagtggcttctggtaaaacaacagtaagagaaaagttctggcattctcttgatcactcatcttctctgccttcctccccagcaccacctcctggcctcagcctgtgggcttctgcaaagtcaggtatcaggactaattagctagcatcaaattcctgttaattccagaagcagggacaaacctgttggggagggacttaatgacaaaattaggtataggtctatacgttaatcaaggaaaattctctacttccttaaacttacttaccaccctagaggagagccaaatccactctgatgacgtttggtcataggaaggaaattggggaaaattacaagtttctccaatccatgtaaaattaagaaatcctggggaagttgtaaagagaaaacagtaccctattcccttgaaaggcagaataggtttataacttataatcgaaggtctccttcaggaaggacttcttgaaccccatatgtcctcttacaacactccaatattgcctgtaaaaaagtcggatgggtcatagcggctactgcgagaccttcgagccattaaccaaatagtccagaccacccaccctgtcattcctaacccttacaccattatcagcaagatccctcatgactgccagtggttcacagtaatagacctcaatgatgacttctgggcttgccccttagctgtggatagctgggacatatttgcttttgaatgggaagaccctcattccagttggaagcaatagtagtgatggacagttctaccccaagggtttacagactctccaaacctattagtcaaagtttggaacaagtcctagagaatttccctctttcatcatccttatgtctactccaatatgtggatgacctgctcatttccagaggcaccaaagaccaagtaaccgcaattttaattagctttctaaatttcctaagggaacaatggttacgggtctcaaaaagtaaactccagcttgtagaacctgaggtaaaacacatggggcacttaataagcaaaggtaagccgaagatagggcccgaacaaatggaagggatcatatccctgccactgcctgagacaaaacaagaacttagaaaattcttcaggctagctggaaattattgcctgtggattgactcttatgccttaaaaacaaaacctctatatctaaaacttacccaagaagggcctgacccccttctttggaccccacaagaagtccagcaagttgaggaactaaaacatctacttataactgcccctgtcttagctctgccatccttagaacagccatttcacttttttgttaatataagcaatggggcagctataggagtactcactcaaaagcatggggccattgccagcccacagcctttctgtcaaacattcttgacgtggtaacctgtgggtggcccgaatgtatccaatctacagcagcaactgttttattgacagaggaaagtagaaaaataacctttgggggaagtctcatcctaagcacaccccatcaggttaaaaccattcttagccaaaaagcagggagatggcttacagattcaagaatcctaaaatatgaagctatcctattagaaaaaggtgatttaaccctaaccactgacaatgtgctcaaccccgccaccttcctttttttttttttttttgagatggagtttcactcttattgcccatgctagagtgcaatggcacaatctcggctcaccgcaacctttgcctcctgggttcaagcaattctcctgcctcagcctaccaagtagctgggattacaggcatgccaccatgcctggctaatttttttgtatttttagtagagatggggtttctccatgttggtcaggctggtcttgaactcctgtcctcaggtgatctgcctgccttggcctcccaaagtgttgggattacaggcgtgagccactgtgcccggcctaccccgccaccttcctgacaggaaatccaaacgctggagaccccaagcacaaatgtttagacttaatcatcaaactaaagtaaggcctgatctaagtgagacccctttaaaaacagggcaccatctctttgtagacagctcctctcgggtaattgaagagaaaaaacataatggctactcagtggttgatggagaaactctcacagaagtagaatcagggagacttcccaataactggtctaaccaaacatgtgagttgttcgcactaaatcaagccttaaaatagctgcagaatcaagaagggactatttacaccaattccaaatatgcttttggagtggcccatacctttgggaagatttggactgaacaaggccttattactagcaagggccaaaaccttgtccacaaagagttaatcatgcaagtattagaaaaccttcagctaccagaggacatagccattgttcatgtcccaggacaccataaaggtctctctttcaagagttacttcccaagaagcacccattttccactgaaccccttgtctcccttccccatctgcaacccccatcttctcccaagcagacaaagaaaaattaaagaaaataggggctaacaaaaactcagaagagaaacggatactgccagataacaaagaaatgttgtccaaacccctaatgacagaaatcttaacacaacttcaccaagggacccattggggtccccaagccatgtgtgatgcagtccttagaacctatgggtgtacagggatttataccctcaccaggcaagtcacagacagttgtatggtatgcagaaaaaccaataaacaaactttaagaaaactgcccttcggcggaagaaatcctgggctaaggccattccaaagtgtccaaattgacttataccgaaatgccccaaataggctgcctcaaatgtttgtcagttatagtggaccatctcactcactgggtggaagccattcacctgccaagtgcaactgccaataatgtagttaaagtactaatagaagataccatacccagattcagattaatagagaacattgactcagacaatggaacccattttactgcacaggtcattaaaggattaacccagacactagagataaaatgggaatatcatactccctggcacccaccctcatcaggaaaagcagaaagaatgaatcaaaataaataaatcacctaactaaactaatcttggaaacccgactgccatgaactaagtacctccctgtcgccttactaagaattcgtatcgccccttgaaaagatatcggcctgtccccttatgaaacgctctacagattgccatgcttaaattccaccactgacatccctacatttgaaacaaaacatcaatttcttaaaaactatatacgtggtctatcttccacccttttttccctcaggacccaaggcctcttagcacaaatgccgcctctagagtttccagtacacccacatcagcctggggattatgtgctcatcaaaagctggagggaggaaaactcgaaccatcgtgggaaggaccctatctaatactcctaacaactgaaacagcagcccgaacggctgaacaggggtggactcatcacacttgggtaaaaaggaccccaccccttatggaatcatggaccatcactccaggaccaactccctcaaaattaacattcaaaaaggtctaatttgtctcttcttccccctaattgcccaggggcatttcatttttttttttttttgagatggagtctcgctctgttgcccaggctggagtgcagtggcaagatctccactcactgcaagctctgcctcctgggttcacaccattctcctgcctcagcctcccgagtagctgggactacaggtgcctgccaccatgcccggctaattttttgtatttttagtagagacggggtttcacagtgttagccaggatggttgatctcctgaccttgtgaactgcccgcctcggcctcccaaagtcctgggattacaggcatgagtcaccgtgcccagcccgcatttcattgttaatgtaaccaggtcagcctcccctcaagctgttgtgtttgatgcttgcctagtcataccttgcagagacctacaaagtcaaaggcaactagcctcttcagaaaagtatctttgcccttggtactcaccccaccctcaatctgatccttgcaagattccctataattggctaccttgccattcctggtacgatattctctggaccactcagtcccaaggctggacttcttcagcaggctgcacctccctaaaaccttatatccattttactaaacaaaataactcctctaactgccaacacctccgatgtaacctggtgcatatttctattactacttcaacctccactaaccatattcccaccctaagtcgcttttatggtatggggcagatgttagcgggaaagaccccatagggtcctttgagattcgttttgtcgcccctccagcaccccttccttcccgaagatctcctccaaatgaaacaactatcttgccactacctaatgacaaaactaaagtgcacatagtggaagtcaaagacctaaaacaaaccctggccatcgagaccggacaccaagaaatgaatgcctggctgaaatggatcaaatattcagtttgcactttaaataaaagcgactgttatgcctgtgcaatgggcaggccagaaatccaaatagttcccttcctgcttggatggtctaaccaaccgggcatggactgtacagtagctctcttccagcaccccacagcctggggtaataagtcatgcaccagtctctcactgcttttcccaaaagtcaaagacttccctgtgggtcagcccccaagggccatctggctcctggcctctgatgccaattttacctcttgtctctcatgacggggaaaacttacatctttcaggaatctaacgggatgcagtgaatccgagccttttcgagagctcaccaatcagactgcccttgtctatccacaagcagatgtttggtggtattgtggaggacctctactgggtatgctgccaaataattggagcagcacttgcactctaatccaactggccatctctttcaccctggcatttcatcagtccgacaaaaagtcaccctcttgggaagaaagagaagctcctcaagggtcttttgacccccatgtctatatagaggcaattggagtaccacgagtagccgccaatgaatttaaagctcgaaatcaaatagctgccaggtttgagtcagtcttattttggtggtctactataaacaaaaacgtagactggataaactatatatattacaatcaacaaggatttgttaattataccagagataccatttggggatagccgagcaatttggtcccaccagccaaatggcctgggaaaacaggatagctcttgacatgacattagcagaaaacggcagagtttgtgtaatcatcagagcccaatgttgtactttgatcccaaataacacagctcccgatggaaccactaccaaggctctacaaggcctcaccaccctagcaaatgagctggctgaaaattctggaatagatgaccccttcacaggtttaaccaaaagatggtttggtaaatggaaaggacttatggcctctatcctcacttcccttgccattgttacaagtgcactcatccttgtaggctgttgcatcacaccttgtgtttgtgggttagttcaaagactcatagaaatggcttgcactaaaaccttctctgtctctccccctccatattcagaccaacttttactcctagacaatcaagaagagcaacaaagccaaatcttactaaaataatttgaagaggaagaattataacaacaaaaagggggaaattgtcagaataaaagaaaggttcctcttcaaagatccaactttcttgtcataggctgtaaaccgccttgctccaaaccttaacctgtaacctttaccctctgccttatttgagaaagattcaagcgcatagccaattggagtcagcctagactgtgcggtccaaccccagccaatgggggaaagacaaagaagcaggaactgcgttagggttagaaacctgttctcctttgttaggtgtgcttttgcgactgctataggcgcgggcagcacccttctgcagaagtaaactttgccttgctgagaaacttttcttctgagtgctcctcttcctctgcggcactcagaaataagagaacttatttctaacaggaggaagaagacatgataattttgcacacgcaggttctgagttttggctggtgcgctgagtgcttaccataccgcaaatactgtgtgatctgggctgaagaacagaaaacccaactaacagtgacttaggcaaaaagaaattttattctttcacagaagtctgaggcaggcaggtccagagttcatgcaggagctcaataacatcagagattgggctctttttgttcttcttagcatatcgatgttttacgtgatgctgggcacctcggggacctaagatggctgttgtagctccatgcatcatgattaaaccagagacaggaagtgtacgatggaagaggccagaggtgatggcctcctcctctccttttgtcttattcctggagtgactccctcctcttatcagcagggatacaagcagtgcctggcagccttccctctctcctgtatgagccaaaagcaagactcatggcacccctccctgcaggaaaggggtggaatggagcccctggcaaagggggctggacttgcagtgacagtgctgctctgaacaggactaggcttctgttggagaggtggtcagcggctgctaggcaggtcacaagctgcctcacccatggctctccagctctgcacctaccctctccttctaataaatctgtttcaataaccaccacgaggtttaaagaggagcagtaacttgcccacggttgcgccaggcacccctagaagagcaagaattccttacaaagttattaaaacaggcaaatcccatataggtgacatttctatccaacaatgctgacatctcttttagttttgagccttagtaatccaattttctgcctcaggaagaggcagcagcttctgggaaaaatctgctcctgctaaggtggctcattcattgttttacctgaatagagtggtggatggtgaaggttcaaattctcactttccatattaaattttataacataaaaaataattaaatggggtgcgcgcggtggctcacgcctataatcccagcacctgggaggctgaggagggcagatcacgaggtcaggagatcgagaccatcttggctaacacggtgaaactgcgcctctataaaaatacaaaaaattagctgggcatggtggcgggcgcctgtagtcccagctactcaggaggctgaagcaggaaaatggcatgaacccaggaggtggagcttgcagtgagccgagatcgcgccactgcactccagcctgggtgacaagagtgactcggtctcaaaaaaaaaaaaaaaaattaaatgagccaaccaggacaatgtttaaaagccagagccaaaaaggctccaaaataaaacaaacttgtctgctcaattaattatttgaagagaacctacagtaatacagactggagatgggaaagcacgagggatgtatgagtcgaggaaccggcaaaggggtgtgggggtgtgtgtgtgtgtgtgtgtgcacacacatgcacccagctagggtagaaaataagtacttttgcttctatgggaagtgactttccagttcacttgtgtatcaaatgaacatgatgaaatcaagttgtactagccaatgtttgggagggttctgtattaaagggataaagaaaaacattagaaagagaagttacaaaaatcactgtggggaaaatgaacaccaatgacttggctgctctgaggcttgcagggagtagacagttaggcatcccaggtcatcagagaaccagtggggtcttttcctcaggggccgggttttctacacgcaagtcaaacctcttctcctctgggacacatgtttccaaaggactccagaaacacagcacagctggattcaggtactgtgtcaagatgtgccttcttcttcatctttgacagcaattaatgtactaaatgtcttgatagagaaggtcatatttgggaatattcttgggatcaataggactttggacaataagcttccccctcattgctcctcgatagattacttcaatcaaatctatgaagtcttgtttggttttgaagcttcccacaaacttagtgtgatctggagatctagacagcatagaagagaaacaactgctctaagaactttgagtaatcacttgttgaagactttcaggataaacaaaatgaaaaacagctttgttattttcttcttgtcaatgagacttcagaaataaagcccaacattaatttttcaatcatttttttccatttagtaaatgactcaacccagtgctgtgggccactagcatgaaagctctgtcatgtgcaaagctttagcttcaaaagctattgtaatcacaaaatctatttttatcacttctcaaatcatcaagcagatttcaccaagtgttggagtgcacattgtttcttcgtttgctgttgttgcttttgcctgggcattgtgcaaagcccattcaatattcatggccttttgagtggtaggtattaaaaaattgattttttagaaaagtatctcaaacaccaggtatgttactgtaaaaattttaaagaaataaataaaatcacggatgaggccagaggtcacttttcagtgtctatccttccaatcttgtgtgtgtgtgtgtgtgtgtgtgtgtgtgtgtgtgtgtgtgtatgtgcagatacaaacttcttttttcccaacattgggaattatgtcatacaaattattcagtaatatgcttttttctagctgacatatatttctttcatttgttaaatgtgcatctgcaacatcatattaaagtcctggaagtgtaattactgggttaaaaagtttaaaaactttaaactatttgatacataatgttgaactggcccccataaaaggttgtaccaaattaatacttacatcaaatgtgttccagtagaataaacagctttaaaatacttttgtgttttttttttgttgttgttgttgttgttttgcgatggagccttgctctgtcaccagactggagtgtagtggtgcgttctctgctcactgcaacctccacctcctgggctcaagcgaatctcctgcctcagcctcctgagtagttgggattacaggcacccaccatcatgcctggctaatcttttttttgagacggcagctctgttgcccaggatggagtgcagtggcgcgctctcggctcactgcaagctccgcctcctgggttcatgccatttttctgcctcagcctccagagtagccgggactacatgcgcccgccaccacgcccagctaattttttgtatttttagtagagacagggtttcactgtgttagccaggatggtctcgatctgctgacctcataatctgcctgcctcggcttcccaaagtgctgggattacacgcgtgagccactgcgcctggccatgcctggctaatttttgtatttttagtagagatggggtttcactatgttggccatgctggttttgaactcctgacctcaaatgatccgcctgccttggcctcccaaagtgctgggattacaggcgtgagccactatgcccagcctaaaacactttaaaacagataatatttcacatactttcaaataaagacaaaaagggtacacagatctagataagtggacacatcaaccacagtaagaaatgatcagaatcatggatgcacccaatcatcaatattaagtattgagatggtaattggatggagtggaaggcactaaagaggacatcatgttacttattcttgacaggctttgttgaagaatgatttaaaattcaatggcgaaaagcaggaaactttgcaagagagaagcacatcttagtttgctagaaggaatgtttctttcataaatgccacttaccagtccaaaagcttaagaaaaactacatgttttgtttcaaatgaaattcctgggaaaattttaagagttctttatttagctaatatggctattttatattttatagacttatggatggtagtgctttgccacctgtactatttcttcatacttaagtcggaaattaaaatttgacaaaccatgtgtatgcactattaaaaaaataaataaaatttgacaatcataccagaagcactctcattttgtagcaaggttttgcataaaaaattagagagtgcgtcaattggggaaacagtactgatataagactcacagagccaacatcacatggaaataggcaagctactgaaaatgcttaccaaggaaacttacaaggttgcaattaacttcagatcaactgcacttacccataatccactttcatatgctgcccattgaagaaaaagacagtagatggaatataactgatgtcaaaatactgtgtataaactgcagtttggtccacatctaccaggtatatagcagccattttacttaagtcagaagaggtcttagaaagctgcaaatgacgagagagacaaaggttacaatatgagaggcagcttaatgtttcttctgtgaaacttgttactacaacagagtgttttgtttgaaaaaactcctgggccaacaatgcagcccatgtggctcccacattagacaaagcataaccccatcctccagagtctcattcactgcaacggggttaggagggaatcttggggaaaactgtatgaggttaggaagggaccttggggaaaactgtgtgaggttagaaggggaccttggggaaaactgtgtgagtttaggagggtgacagcatgggagtattcctgtctattcattgtggagagagacctaacccagaactaagacctctacccgccatttctactgctgccatcccgtgttaagagctgagcatacaaatccttggggaaaactgtgtgaatctatttcttcctttaatttctttctttgaatgcttttataaaagtagcccatgctcatttaaaacaacacaacttagaaatatgttatgtggatactgaaattccctaacgtctccttcctcccaatcctcccagaaatgaaaaccacgataattagtagcagacacttatataacattactatgtggtaactgtcctaagtgcttaacatttgttaactcatttaatccttacatcattcttataaggtatatgctatcagagtccccattttatagatagggaaactgaggcacaggaaggtaaagtaatttgccccaggtcacacagctcctgagcagtagggctggggtttgaactttggcagtgtggcttcagtgtctacatcactgacctctgtggtatttcctcctgcttatgactgagggtagaatcctctggtccttttttccccaagctaacacatcacaccctcattgtaaccacggaaatgaggatttgtacgctcagctcttacacgggatggtagcagtagaaatggcggtaagaggtcttagttctgggttaggtctctctctgcatcaggcacatactggaggcagcacactagaaaagattatttgcagctacagaaaactgagttcaaatctcaactctgcaatatagtggatctgcacctgtgggaaattacttgacctctctggttttttttttcctactgggaaatggggctactattatcccactattgcgagcactgaaaagatagtgttcacagatgcttgttaatagttttctgctcttccatcaccttgttggtgaaacagcattgacagcttctagtgggtaaggacatccaagacagattcagcacacacagatttgggggcttggttcagggcaggcacacaatcagctcttagtgaactaacaaatgaacagctatatacccaaccctgactactccctctcatgtactactcagatgctgaagtgagaatatacagattattaataaaaaccaattattttagacattcacttacaatatcatctagctgcagacagacaggatcttcatctctcccaaacctgagaaccaacaccttctcagcagtactttttatcgcctggtctacttcctttttgctagtcagcttgggcagtaggaagctcatcttgaaataacccaaatgtgaatcctcactgtcactcctgaaataaaggtgcaatgtttaaagacagtttagattaagtgcgtgagccctcattaaaaaaaattaattcacagagtagctaatgtattcacatggtatgaaagaaacatcatagaaaggtaacactgtggagtttccctctctttgtccctgctccttggaaccagttttcattgttccctcccccgggccagataactgctttcattagtttctcatgtatctttcagagttttgttatgcattcaccaaaaaatacaaatatgcgttccgatattttttttctctctctccccacccccaaaagatagcctattgtatcagtgttccagcaggaaagcgatgacactctcaactttggtaatttgaaggcagtttaattaaggcaggtgtagaaaaacaatacggtaaagtgtactactttggggctagtaacagcgggatgctgtacccatccctaggccatgggaggaagaagccacggtaggaagcagttataagaattgtgtggcagaaagaggtgagtggagaggacagtgtataggagggcagcctgctgttaggtgttgcagccactctcctccctccctctgacctttgctcatgcaaccaccggctgactccaactggaaccagagggcaggggcctgttgaggcaggcaaacctccctgtcccagagcagtctagaggaggatgaagaatggctgtggagggaccaatggcagatgttcagcacacacactttatctactcttcagcacttttcattatttcaaacctaacctatgaagattgccccatatctctatatagagaacatccatattctctgtcatggcagcatattatttcttgcatgtgttacactttttaaacagtcctttattgtatactttatattattacaagtcctggcttaaagattcttcgtgtgcaccttactaggtgcacctcattacacggcaaacagatcaattaagagtgtgtgtgaaaactacaataccataaacaaataataaaatactgaggtacaagggacctaatacaaccccgtcattttacaaactagcttgcttacagttgcactttctactacaatgacaaggactagaatacaggccaccaaatttctagtccaggggtccttctactacaataatctattttcatgattggtagaaatttcatttttgagaaactctttgacaaagaagcttagttttgtggtcatctataagagactccattgagatggtcggtattttgaattcagttccaaatatgaaaagggaggatttcttttcctattttttttgtcacaagtcacattttaagatacgaattaggccaggctcacccctgtaatcccagcactttgggaggccaaggagggtggatcacctatggccaggaattcgagaccagcctggccaacatggtgaaaccccgtctctactaaaaatacaaaaaattagccgggcgtggtggcagatgccacctgtaatccaagctactcaggaggctgaggcaggagaattgcttgaaccctggaggcggaggttgcagtgagctaggatcgctccactgcactccagcctgggcaaggcaacaagagcgaagctccgtctccaaaaaaaaaaaaaggaattatttaactaaaattcacataggaaataagattgttccagctataggtcatactttaaacagggacattgatggcccaaagggacgtcatcagatgtgagcagcagaacaaattaccaatgaaagggaaggtcaaagagaagacggatctgtcccactagaattcaaacaaacagcagttcctccgtgttactgatcgaaaggagaaagtaaggggagaacaaagttgttagtggtgaggctaggggtgcaactggacaaacgttggaagcaggagaggaaaactgagaccacatctaagaaaatgtccatagtaaatgatacccacagagaattcccaaaagaagacgtacaaatggacagtaaataaactaaaaagttaagctttaccagtaagcaaagaaaagcaaattaaaacatatgtttacaaagtcactgaattggcaaaaattaaacaagatagtggtaggggcaggcacagggagttcctgctggaatgcagacacaaaacctttctggaaagaaaactgacatactctttgaccaataactccactgctttcctctctccctctctttttctgaggcggggtttcgctatgttgcccaggctggtctcaactccccaggctcaagcaatcctcccgcctcagcctcccgagtagctggaacctcaggcgcgcgccacaactgcagaaacaccaaaaaaagaaaaaaagcttgaactcacttttgtacagaatcttactacaatgtattccagaaaaacaactggaaatcagtggtcatctctgcgtgtgaacgcatgggtgatttttatttacagccgggcgcgcatctccattttccaaaatatccgatatacatatttaaagtcacctgtgttgcgctgctcctggcccacaagcgctaagggaccccagcacttaccttactcgtccacgccgcctcactccctttcactttgtggctgtcagcaaccacttctcggaagagcccgggcgcggacagctcctttcatcagccccaagccggacaggaccctaagaccaagtcacccaggggctgttgcctagcaaccctcgtggccccgctagcgggaaggaaaccgaacagaaaacgcacaagcgcagaaaagaaactcctggccgtcggtcggcccccgctcaacagcccaataaacggaagagcttctagtcaccgcccaccttgctcggctctgaccggaagctaggcgtcacctccgcccgtattaaagatggtcgacctttttcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgaggtgagagtcccttcttccttcctggcctgcccttctgtaatcatggcggctctaggcggcggatattggtcccctgctcaggtccgggccccagtttggggagttcctctgtcgtccctgtcacccaccttgccttactcacctcagggatgctgcatccgtcctggccgccttggccttcctccttgctctggtcaaatcctgctgcctggagcggcctcgctgagatccagggatgctgcctggagtggccttggtccctctcccaggcctccgctttaacccaccccagactgtcaccgagcccgagtaggactccttgtgtcttcctctgctctctcacagtgtcatttataccaggcaatctggtgggcgatctcttctactagaatgtcagctccaggtgggcggggatttttgtcttgttctctgttgctatcgccgagaacagcaattggctcagggacaccctcagtgaataattgttgaatgaatgaatccaggttctttcttccctggctttctcgtacgccttgtagtttctttgccattaatccttctcaagaatcttgctctttagctccttatttgttcgtctcagcagctaatgaagttctctctggctgtctccttgtcctgtgttgctggaatcttcccttgctgtctccagaaatgtttgggttcctgtcctcctttaataagtttaaattaattcattttttaatttatcaaacgcttattttgctagacattgagctacagcagtcaacaacacatccagtgttctctcaactgcgtagaatggcagtccagggtacctttcctagtttagacaactattgagtagagcctgtatatctttaccttcttgtgtggatttcctcacatgcgcacagatgtcaccaatatgcagctttctttttttctgttctgcctgatggcattttcaaaatgtaactcttgtttctgcattaatattatgtgtccagtctgtttggcaatactctgtagagctgtgcatttaattagagtttggtaaacaattctggattctggtggcatctcctttgctttgctaacttgttggaatgagaggaattatccaagcatccagaactgatatatgttgatgagtggcagatgtgtagtgagaggtaaagaggagcttgttccaacttgagtgccagaagtcttgtagccacttaaatacttctcagtaacaccttttcctaacctggtgtttctcataaatatttttggtgaacatggattgttattaaactgattttggctgctgtgagtaaattgttttctgtaaaacgcagctaggccaagaaaagccactaaagtatggagaacatggacggtagccttctgccccatctctgtgctgctgtacctgttgtttaaagagaggaagaggtagaactcatgtaaaaaaatgggtgagggaccaacagtatataggaggatagcaaataatacaatgtagcagttacatttatgttaactgttatggttacataaagagctactctttatggtttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagactttttattgcctcttggatctttgtgggggctggggaggaatgtatggggtgtgtgtgtgtgtgtgtgtgtgtgtgtatctattttggtgtttattgggggttggaataggagaatctttggagataggcagtgacttgatggaaaggtcttggagagagggagcaaaagtagtcctggtcttaaggggagatggggaaggttaatcacctacatataaccataactgcatttattgtgggatatagtagagctgagccttctctagtaccaaatggtttgccttccttccagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacaggtaaaggccttagtatgggttagcccagagggaagcgaacggaggctggaaaataacagctcatgtttatctctcagttttcctgttggagatttagagctttatgattttattatgattctgtaatactgaaggtaggtaggaatttgtggggaaaaacaaaggtgaataaagacgagatggtagaggttagaaatgccttgggttgttgccatatgtgagcctgcgtcccagggagagaaagtggaaaaggacagatcacttgtttggacagccaaaggttttagggcagagtttttctcctatggaggggcctttaccagttgctctccctgtttcagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagaggtaaactgtccagcacagttcctattgtccattagcattcgaataaatgtgtcagcctttttcttgttgcaggagtttttgcaacacccatttgttagggagtcctatttgcatgatgtccgcctgagtggttttgaccctgctgggattgggaatactagtttaagaaaagagctgttgcctgtaacatagctgctctccttgagtgtgtggtcttcgttttattatgaaaattgatgataaaggagataatgggtaaatatgtataagagaccagcatttctaatagtattggtgatagagaaaggacagtgctatggaacaaagctagacaaaaaaatccaatgctgtccttgctcagtattaagttttatagctgatagaattgtaactattaaaaaaaatgattcactgtaaactcgcactagtattttttgaattcttgctggaaaataactgttactgtgggtttgaaattttctaggcagtaactatttttcccccttgggagaatggggataggtgagtttcaggagtccacggatcacattcgagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactctcgtcttcagtgagattgctgaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtggctcatacctgtaatcccagtactttgggaggctgaggcaggcagattacttgaggtcaggagttcgagaccagcctggccaacatggtgaaaccccatccctactaaaaatacaaaaattagcctggggtggtggtgggtacctataatcccagctattcggtaggctgaggcaggagaatcacttgtacccgggaggcagaggttgcagtgagccaagatcacaccactgtactccagcctgggcgacagagcaagactttgtctcaaaaaaagaaaaaaaggaaaaatacatcctggaccattaaaaattgagatatctttaaaaactgtcaaaaccgatcttaaccgttatagatacatgcaaggtttagaaatagtaaaaggagtaaatttggggaattgacttttggcaactggttctagaccatgtcatggttaagtgagatgtttcctgtggatgtgtcttttgtggcccagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtgatgttctgggcagagcagcccagtttcgctgggtgggcggtaaggagcctcggcagggagagcagatggtggccaggaggacgtggcttagctcagtgacagttttgtgatgctggtgctgctgttcccaggtctgtgaggggcaagtactcggatgacacgcctctgccaactccctcctacaaatataacgagtgggccgatgacagaagacacttggggtccaccccgcgtctgtccaggggccgaggtgaggcctgtggggcagcaggcagaagagcaggcttgcttgccctagcgaggatgagcaggggctgcccttctggagctgcatggccctgcagatctgtctggggccgctggggacaggccagggcatggactgacctgcttcctgtgctcctccaggaagacgtgaggagggcgaagaaggaatttcatttgacacggaggaggagcggcagcagtgggaagatgaccagagggtaaagttttatacctctgaggggctgatcggggctggtggccgtctgtagatgggtgaccctctagcaggactgggctttgatgagggtacacctgagccctgttcagacccaatgccctggagtctctttgcagaggcatagacggcacggtgaaccctgtcactcactgcagtaggctgacctaactgttctgttatgtgttggtgccaccatgtggtaaatctaagaagtgctatcgtgatgggctgccctccagtcctgtgtagttgcccactgtggttctcctccagatggcatgtgtctgcagggaggcctctcctgcacccctcacaagggtagctccactgcagtagtgacttcctaccaagcgtcccttcttctgttggccatgtctcgtgcataaacttgatctgtccctcactcccttgctttgcctcctgccctgcagcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggtgaggctgcctgcagaagttggagcagattcagagctggaggtagagcacgtggggaagcagcaggttatccccaagtgagggcagcacagcttgtcccctgattgccgagaagcccagatcctctggaggtggaagaggagtgggtgatgagccttttagtagcttaaggaaagccccggctcgtacttctctcttttgcagtacttccttgaggggaagtactgttgatgggaacaggtgcattgggacctgcctctgtggtctgtgttctttgtgtctctgatgtgggctagggacacttaccatttgtgtgtccctctagaggttctgatttagatgaaaggtgctgctgcttggaacaaactcctgcaggtgatttgggatcagcacctcttctgtctttggagctgtgggtagaggcctgtgacatctttgcagctaccagtggccttctgtcaggacttgatgtgtggacttacctcataacctttcaggacgacctttggggtggcaatttgagtgtggctcccattgtgtcctcacaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcaggtgaggctcctctgtggccagggacaagacagctcagagagacctgatgtgggccaggtgcagtggctcatgcctgtcatcccggcactttgggaggctgaggagggtggatcattggataccaggagttcaaggcctgcctgggcaatatagtgaaaccctgtctcaaaagtacaaaaattagccgggtgtggtggcaggcacctgtagtttcagctactcgggaggctgaggcaggagagttgcttgaacctgggaggcagaacctgcagtgagcagagatcacaccactgcactccagtctgggcgacagagcaagactctgtctcacacacaaaaaaggcctgatgtggagacagaaagaagagaagggagaaaatagccctgtaccatgagagggtagcagtccctttcacaagtagggatcttatgaacatggccttcttgctgattttaacgggcatcgctctttctccccactgctgcagccggagccggtgattccagtgaaggatgctacttctgacctggccatcattgctcggaaaggcagccagacagtgcggaagcacagggagcagaaggagcgcaagaaggttggtttcttggtttcgtggctgggaagtttatgtgtatttttttcttttttcttctcttcataagtcttactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagtctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgtgggcagttgcggcagaacccatcgactttgtggctcctgagtgggagactcttaggatacctctctgcatcttccattctctctggtcccttcctcctggtctcttcactgtcctccacttttcctatatgtgattcctcctccctcacactgcttcctctggtgctggtgttgtgagaggaaggaggcccagggaggttaagtaacttgtctgaggtcacccagcttgtcagtgagggagttaggatcagacccaggccgtctcacatcagagccactctgctgaagtacctcccaggtgttcagcatgggcagctgggttttagtcccttagatttgagttcactataagaactatttttaaaagaggttccaaaatagaaagggttatcttattggccagtgacttctctgctcatagaggcatctaagcagatgctgagttgggattcctgcattgggcaggtggctggacttatctgtcccttaagatcctcatccttcgaatgcccttatgttctactgaacggtcatctgagttaataattctctccactcctgtgtgaaatgtccatacgagaagttggtactattgatcagcccttattcttctctagttaacttaattcctcaggtattagttattgggtgaccaggagggactgggtgaaattagaaataggaagctcagcagagcatggggcggcacatcagacaggaagtctctggggagggggttggggaggggtgtgtggactgtgtggagcactgaactggtgtctttttgccaggcagccttgagaaagtgacagtgctctgcatctcgggtgtgtacatgtgtcagacattgagagctttcagtagaggttgcaggttactgtttagtggggctgttttcacagttctttgaaaacaaaaccgtacagactatgctttcctgctgtcctgccaagaggagggaggaagtttgacccatgtcccgtgctctgcacccttacctcctcacaaggcctgtgtggctattttagccctttagacgttgtgctgaaattgcccgagggtattttctacaagttagtgacctggggattgatttccactcctcttctgctcactctgttttggttagagggtttgctaatatggtgatctgtaaatcctccgatccatgttcagctagctctgttggaccctgtggtgtcgagtgtgttgtggatgatggattctcaagtagcagtttcagtcctgaggtcgatgagaaccatctcagattccctggctgctttggtgtctcagactcttgccgaagtcctcattcctgagcgtaggaaggagggcagcaacccaatcaggaaggacagcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctgcccatctttgcagtgcagcaggagctgctcactattatcaggtaacttcacccggggcccaggaatctagtgtcaagtcaggggtgcccttggtctcccatgtttacccaggagctctttttcttttgtgcattgcacccagtggagaagggaaatacttttttcctctgacctcatgcctggggtacactgcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtccttgtagagacaacagcatcg

SEQ ID NO: 390 - DNA, 234959 bp, Homo sapiens
tccactttgccagagttggcatccctggtgaccaggcccccaatatggccaaatctgttttttctggccttcaccttcaccatgttgtctcagggacacagctggcactgctcaagaagatgcggctgtcttgtcaaacaggagaagcagagacccagaataattatttaaatgatacattttatcttaagaattcaggtggatttttttccttctcaatccaacctgtgggttaattagcagattgtgttagagtctcttttcctttccattagaagtctgcagtcaggggccagaccctgtaagttgtcatcacaaaaagttcatgatcaatgaatgctatacctctattttaggggtagagtctcacataccatttaaactccatgatgtaaagataatatggaaaattggggaggattcaaaaacattagaatgaccaaagggttggaaagttacagaaatatttagtctggagtagaaaaggctgaaaggtgtttgcaaaattcacttcaaatagatgaataaaggaatcaagaggatattgagcagatgttttggttttgtggctgatggagcagatttggttaaggccattgcacagagcagctgcaagggactaaaactgaagatcctctgtaccagggatcagggctgcacccaacagtgggcaggttttagttggaagaatggatggcgcacaaagggagtggtttattaaaggaaacccacccagatggacacgtggacatcagaactatttaaaattagtgtcaggattccaccattcctgggcacattcctccctccttggagtcaagtttcctcgtgcagggtccacctgagtctcactctgtctccctgttgtgtttgcacagggcaaaccctcctaaacctgctggctcagaaaacccaagaggttattatgttgtgtctttttggacactggtgggggtactcattactgaataaattcccttctaaacaaatactccatccctagcaggcagaaggatataaacatttggcagatcagcgcaatgatctcactttaacatcttaaccaaccccagcttctacaaatagatgatatcattgtagcaatatagggcagactctgccagcagactttctgagactctcctggaacataatttgtcttacaacacttttggcaatcccttggccatgctagggggaggggtagaggggaaggagaagggtggggtccaggggtaagaggataaggagattaggcagcctcatttccttctttccactagaaggagcctctgtaaaagctgaggctgcacccacaacctgggaaaggtgcaaccggtcacacacccggtgacaggcgtgtcagcaaaccacagagcgtggcggagggggagggcagccaggctaagtgtccagtgtttgtaaagtctacacttctgcacagtaacatcctaagccttcacattcactcaccaatcactcgcctactcacccagagcaacttccagtcctgcaagctccatccatggtgatggacggtgatgggctatttccccaatgtagaaagcagattcaaaaacagattcaacaaaacatagcaaggcacctgccctctgcaggtggaccatttttaatcttttatatcatatttttactgcaccttttctgtgtttagatacacacatacttaccattgtgttacaattgcctacagcattcagtacaggcccatgttgtacaggtttatggcctggaagcaatgggttatatcatatagcctaggtgtgtggtaggctacaccctccaggtttgtgtaaatacactctgatgtttacatggtaacaaaaatgtcttgcctgggactagaggtaggagaatagggagattaggaaattcaggcttactgccttcttttcacctgtaggagatgctactggtgtcccaactgcattctctttgcccaccctggaagtagtacctagcacttcagtggcaattctcatataagcacccatgtctctctgcctgagggctttctctggatacaggggtgtgcttggcccatgcatagagcaggctgaaagtgcccaggggcttataacccccaggagaatctcctacttgtatctgaaacttttgtctcagagtctgcttttggagagacccaaattgaaacagatggcaataatatgaaatatttttaagaatctgagtgatgaagtttaatgaagttctaattcttttaaagtgtctcaaatgttctgttacattttgttactttgcagtaattgttccactgcactgaaatccttttcacccaaatatgcagctggaaatactataataaataacacagctcccattttaaaggagggcaaagctgggcacggtgactcacgcctgtagtcccagcctttaatcccagcactctggggggcctcagcaggaggatcactaagctcaggagtttgagaccagcgtgggcaaaatagtgagaccctgtctctacaacaaataagataattagctaggtgtgggagcatgcaccctgtagtcccagctacttgggaggctgaggcatgaggattgcttgagcccagcaggtcgggctgcagtgaaccatgatcatgcccctgcattccagcctaggtgacggagcgagaccctgtctaaatatatatatgtatatatcccacagttctggaggctgggaagtccaagatcaaggcaccagcaaagtcggtgtctggtgagggctggctctgtttccagctgtgccttcacatggtgggagcgcagaacaagtgccctcaggcctcttttataagggcactgatcctgttcatgagagctctgtcctcatgacctaatcaccttccagatgacccacctaccagcaccactgtactgtgggttccctttcaacatatgcattctgagggacacaagcattcagaccagagcaacatgtaaaatggaataggctccagacctgaaagaatacaaacaggcttttcacccacataataagcatgtggcaagatagtcaaaggtggttagaatcgagaacaatctggtttttgtgcagcattgtctgccactattggacctcatgtgatatctcccaattcattgtcgacaaccaaaaataccctatgaatttccaaactactccctgctgagtaaacatccaaagtgaaaactactggatcattgaaaagatttaactactcttttcaaagattccagacccactttctttcttttttatctttttcttagagaagggggtctcactctatgcccaggttggagtgcagtggtgtgattatggctcactgcagctttgaattcctgggctcaagcaatcctcctgcctcagccacccaagtagctgagactacaggtgcacacaaccatgcctggccagtttttgaaattttttatctgtagaggtgaggccttcctatggtttcccaggctggtctcaaactcctggcctcaagggatcctcctacctcagcctccaaaattgtgggattacaggtgttagccactgtgcccagccctgttttctagtattagtttatatgtattatatgttgaaagtggatttgaagcagtgcaaagtgcatctgaagcctattttatccaaggattgaccaccaaccctagtgattatctactgatttcccagaaggctgctgccgagaatctctggagattcggagatggatttctcagccacaaagtggaacaggatatcacctctatgctggggggacaggagataccgtttgtacacagctcgatactttggaagtttgtgattgtttgttgttttcggccttctccactacttagtaatttttaggaagaatttcagtctatctcagctattcagaaggagcactgtactaaaggcaggtgaaagcaaggggaaggtggttgttcgggatgcttggccaaccatcttccctcctgcctgaaaaagactctctcctttgaccaaaactccagtcaggcttctctgagtcctctgcttgactaggcccaatcttggacttttctctctgtccttgcagagcccagtgtgagcaagaatcctgctaagtgggtctagtgaaaagcctctactcttggttgaccacccttgttatctgatctccctggcctgccttcagcaggaatcctatcaggtctgtttagacagaaacccccttatccttggggcttcctcttagtaattttccatgcgctgctttccaccctgctccttgattataaatccccacctgtccttggtagagttggtgctgagttcaatttctccccactgcaaagccctgcagtgcccctctacctatcaccatggccccctggaataaagtctgctttaccatctgatatggtttggctgtgtcctcacccaaatctcatcttgaagtgtaatcccgaggtgtctagggagagacctggtgggaggtgactggagcatgggaacaaccatgctgttcccatgatagtgagttctcatgagatctgatggttttacaaggggctcttcccccttcactcggcacttctctctcctgacaccttgtgaaggacgtgtttgcttccctttctgccatggtcgtaagtttcctcaggcctccgcagccatgtggaactgtgagtcaattaaaactctttcctttataaattactcagtcttggccgggtgtggtggctcacacctgtaatcccagcactttggggggccgaggcgggtggatcacctgaggtcaggagttcgagaccagcctggtcaaaatagtgaaaccctgtctctacaaaaaatacaaaattagccagatgtggtggcgggcgcctgtaatcccagttactagggaggctgaggcaggagaatcacttgaacccggaaggcggaggttgcagtgagccgagatagcgccagtgtactccagcctgggcaacaagagtgagactccatctcaaaaaaatgaaaaataggccgggcgcggtggctcacacctgtaatcccagcactttgggaggctgaggcgggtggatcacgaggtcaggagatcgagaccatcctggctaacatggtgaaaccccgtctctactaaaaaatacaaaaaagaattagccgagcgtgatggcaggcgcctgtagtcccagctacttgggaggctgaggcaggagaatggcgtgaacctgggaggcgaagcttgcagtgagccgagattgcgccactgcactccagcctgggcaacagagccagactccgtctcaaaaaaaaaaaaaaaattaattaaaaaataaatcaataaaaaaattacccagtcttgggtatttatagcagtgtgagaagagactattgcaccacactgaacaagtgtcatgaataattttttctttaaccttacccacctggagattttcctgatgctaagacctcagaaatgctgttttattttattgaaggaggacaatggcttcacatcagaatgagcaggatacaacattttgaaagacacattccctgttttttatgggctcaccctttcacagtagaagacagaaacccaataacagagacaatggcataagtattataaagtaggcatgcatcaagtgtgatgacagcacgaaagaggggataactacttctgccattacagtctggaagaggtatcatttcagctgatattgtggcaaagtattttacccagcagagggagtatccactcaatgatgttcttaaagtacctaggtaggagtgctaggcagcaaatgattctcttaatgtgtatgtccacacattgttatgtgtaagtagccttattaatttggttgtaaataaaaggttgagtaataataaaaatgaaatcaccaaattctacaatttgacctcaaaatatgctgtaagttctgatattattcctactttacctgggaaggcagagcggttacctaggaaggtgaactgtggaagtccgctgtggattggggatacctgatctcatgatgagtcaggcttaccctgactccttctgggtctctctggtggagacagcccttcacctctgcaaagcttatccacgtgtctggtgatttccttatagcatacagagcttttaaggtttacaaacgtatacctatttccccaatgtagaaagcagattcaaaaacaggttcaacaaaacatagcaaggcaataggtgattcctagagaccaacagattgagttcttgtaataaaatctagaaaagagaaaaggtggaaatgtcagccagggcaacagaaatgatatgcaccaggagatccaggaattcatagtaaaggtcagatgagtttcacaggtgtagggtttcctctacctctgcactactgacaatccaggcggggtaattctttactgtgggcaggaggaggggggaggttggcccggtattgccagatgtttagcagcacccttggcctcagcccattagatgccagtagcaccctctccccagcacgttgtgacacccaaaaatgtctccagatattgtcccctggaggtcaaaattgtccccctgcgaatcactacactagtgcatctcagactctaaggtgcacacaaattacctggggtgtcttgttaaacgccagttctgctttaataggtctagggtagggcttggcactttctagtgcaaacaaaatcccaggtgaggctgaagctgcctgtccacagaccacacttgctccttagaagacaaatctgcagccaccagttagcatgttcaggtcctcaggatgcagagtagatgtacaatcaaggtatggatcactgcagatacttatgagcagagtctggatgccataccatcttgcatttagctgcaaagaatgtttatagaattgaacgtaagtgaagggtttatgttttttaagctttaaagcactttttaatgtcggttctcaaactttttggaatccctttattcttagaaattattaagaactacagatctttagtttatgtgggtttatacctatgagtatttaccatagtagaaattgaaactgagaaatgtaaaagatatatatgaagttcattaaaaaaaatacccattacatattaacatatctaacactttttaatgcaaaattactatactgtcccaagcaaaaaaatattggaagaatagcacggtttaacattttggcaaatgcatgcacgtatgtatgtatgtatgtatgtatttatttatttattttgagatggggtctctctctgtcccccaggttggagtgcagtggcacaaccttggctcactgcaacctctgcctttgggttcaagcgattctcatgcttcagcttcctgagaagctggaacttcaggtgtgcaccaccacacccagctattttttgtactttttgtagagacagggtttcgccacgttggctaggctggtctcaaactcttgacctcaagtgaaccgtctgcctcagcctcccaaagtgctggaattacaggcctaagccactgtgtctggcgggcaaatgtctttaatgtctggttcaatagaaaacagctgggtcctcatatatgcttctgctttcagtttgttgggatacattgctttggttgaagcatatgaggaaaacctggcttcacctagatacacccccacggttggaaaaggaagcattttaatagcctttcaggtgatacattattttttgatactatacgataacttagcaagtggtagtttcttaaaggttaattgcagtgaggaatctgaaaccatatgaatgaacattttggactgttacactaaagtttactggtgtattttatggttcaaattaatcttttacccacataagatttcataacattatgcatcggtcaactggaaaatccagttatgtagctctgtacagtggaaaatccagttacgtagctctgtacagttgtccaattgtacaatggaaaactccactatatacttgagagagtagaaaataaaactaatgtcttagcattattatgaaaatagttttggactttgcatccccttaatgggtcagggtgtagtccatcaacagcttctgcaaacataaaggaccttttgactgtcgttttcctgaaaaataactcgaacgaacctaaaggtaaatgtaaaatgtacttcaagactgtgaaaatgggctgggcccagaggctcacgcctgtaatcccaacactttgggaggccaaggcgggcggatcacgaggtcaggagttcgagaccagcctgaccaacatggtgaaacctcatctctactaaaaatacaaaaaatagccagggtggtgtcaggtgcctgtagtcccagctacttgggaggctgaggcaggagaatcgcttgaaccggggaggcagaggtatcagtgagccgagatcgcgccactgcactccagctggggagagcgagactccgtctcaaaacaaacgaacaaaacaagactgtgaaaatgaactttacgaataaagcctaaagaagcaaataaaagtcatacttttgccttctataatcagtgttaacattttggcccactggaacctctctttgagggtagggactgtgttgatctacgaatcacagatttagcacactggctggcacttatgagcactgaaaatgcttttttttttttagtactccatagcctatccctttcatttagctgggtagtgtggtcaattttccccataacatgcgttctcacataattgcatgtatttctggggtacagtgtgatggttccatacatatacacattgtgcaaccatctaatcagggtaattagcacatccatcaccaaaacacttgtcatttctttgtggtgagaatattcaaaatcctctcttctagctattttgaagttaacattatcgttgagtatagtcatccaaacgtgcaagagaataccaaaacttattccttctaactataactttgtgtctgttgaccaacctctccccatcttcctccccactaactctcctctgtacaagaataaccactcttttactccctactttcacgagatcaacttaaaaaaaaactttttaaaacgactgcatgatatgttttcaggctcacacatttaaaaaccgtgactttggcaaagagtaacttcattctgctggggaaaaaaatttaaatggcctgagtccggaagctcgccagggcagaagcgcagggtcgctccgccgggctcgccgggccggggaccccccagccacccgccaccacggcggggagggcagggtgctgactccagggaccacgacagtcggccccggtggtggggattccgcgcgggacccacgcgggaacaaagaggcggctggacggcccagctctccgcacccggaaggacctgttccacctctccggctcccgtacccctctatccgcatctgagtgaccagatcccactgcagtcaacagcccgcggggtagccagcttcgagggaccgcccggaaagacacaacgcgcgtggaaggcgccgggcgtccagtctcgggagagattagaagtggcgctcctgcccagcgccggcaatccaggggaatccgcggccatcgcggatccaccaggggtgaggcggcactgagcacaagtgtgaggctctcgggagctacgcctccgcttccccagtgccacccgtttttacctcaggcggttctgaccgccatcgtttcaacctggagaggtgagccctcccctaccgacgcacttcccttccccggcaggaaggagggcgctgacccagcgggcgcacgcccctgactgcgcatgcgccgggtgcgccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcaggtagggggcggagtatttttacagccagttaaacggcttttctcactgagtgtgtggaattgactttcggtaaggtagactgcgtgttaacagttaggcacgggtacagcaacggagaacagctctaattttgcaattgcttgtcactgttcatactccatgtgaagttaatgctgctggaggacagaaacatctgacatttccaaatattaaagatctgttggccgggcgcggtggctcacgcctgtaatcccagcactttgggaggccgaggtgggcggatcacgaggtcaggagatcgagaccatcctggctaacacggtgaaaccccgtctctctactaaaaacacaaaaaattagctgggcgtggtggcgggtgcctgtattcccagctactcgggaggctgaggcaggagaatggcgtgaacccgggaggcggagcttgcagcgagccgagattgcgccactgcactttggcctgggcgacaaagcgagactccatctcaaaaaaaaaaaaaaaaaaaaaagatctgttgggaatgtcatgaatcttctgagaatgtgtgtctcgtcttatagtctgacagtgagttagtatcagcgccacaggcataattttaaatcttcctcacttctcaacttctcaggttttgaagtggtttcaatatttatgatttcctttgtttcataattaatttgatttatggcatctttcatggattggtcccggagtatgttacaactactaagtaatcttccccaaactaccctttagataaagagcattaggactgtagctgaagctgacagttcaagaaggcaatgtggttttcctgggatcacacagtgagccaggaactactggttatgaaattaatggtggaattcttcaatttcaattgttctttagcattttgatctatccttgctggccaaagtacatataaaaaaataaagggcaagagaaatcttattggttgctgtactgtattagccatgagattatattggccaagtgtattcaaatttgatacagggcaactgtggggaagataatattttgttatctatggcacatggtggtgagtgttgaattctaggaaccaaactgttgcccagggagaggcgtaggtctggagcccctctgcagctgtcttggcctgtttctaaaattaagtgcttctgcagtgtaagagttgttgggatggccgttcctcagaaggctgtgtcttacatgctcattttacaaacattttgggcatctcctctgggcgatgaactgggctaggtgctgggaatgcagcaacgaacaggtcctggtctcagtgcttacagtgctgacggagcttaggcacagttttccaggactggtcattagaaaaggctgtgtgtcagctttaacatttttctctggagaagctacccactgagggagaagtgatttcctttgttttattttatttatttatttatttatttatttatttattgagatggagtctcactgttgcccaggctggagtgcagtggtggatctccgctcactgcaacctccgcctcccgagttcaagcgattctcccgcctcagcctcccaagtagctgggattacaggtgcccaccatcacacctggctatttttgtatttttagtagagacggggttttgccatgttgaccaggctggtcttgagctcctgacctcaagtggtcctcccgcctcggcctccaaaagtgctgggattacaggcgtgagccactgcctatgatttcctttagataagttgagggaccctttagcaaatcaaaattctgatcctgagcaagaatctgaaagaaggacgacacgtgtacctagccctacccccatgggtggtgaataacagtccctttccagggataaatccctgccattttctaccacctgcatgtttcccacgttttgtggttagtagataatagtattttagtgttaaacttgcctttctctctcatccattcaataagtgtctgttgggtacccatatcagccacacactgttgatatacagaggataaagtaataagcaggatcaaggagaccagcatcaaacaggctaacaagtcagtatgattcacatagtgataagtgacatgaagacaatgagagggtaactgcaaagaccgaagttatggtggaggaccactttagcatgcatggtcacggagggtagccgggaaggtgacattgagctgaggctcagatggtgtgaaggagcaagccatatcagagtttgttgaaaactcttcattttgaagaaaggggacagcaatacagtttcagacacaatgcagttgaaaacaccctgccatgcctgtttcaagtgcttgaaactatattgctgtctgcaattatgaccgggtaaaagtgcgtaggattagtgatcatgacttattttaggttccttacttgtagaccaatgctgtcactcagctctacgttgagtaatatgtgtatcattcactgcatttattaataagctcctatttacctcacagtatgtttactgtgtaatgatggactcagtcaacattaattgcatgcctaatattttccaggtatagttcccaccctcaaggagttcactgtctattggggcaaaactttttaaaaaagaacgtttgtcctcggtgctgtgggtttattgcagggggtaggctggttgtggggaggcacagttaaggaagacttcccaatgtagcaatatttgggctgacttttgagagtttggcaggcatcatagtgtggagaaggcctctgggagggacagagcctggacagggcttggcagagaggcaggaagcaatgaattaggggtggttatggctggagtgagcagttcgtaagagatgtgtggtgaagtctttcagaggacagtggaaggtgagacaagaactagggacagaacttgtgaacattttaaactttaaagagggagaagagtaggtgccagggaagaaaactgaggaatggccaaggaagtagggggacacccgggaggagacaatttcaggggagagtggctgatggcattacacgctgcagagattttcaaaacgggcctgaagcgcgacctgtgggaaagaaagaggcccccccagaacctttccagaaaagctcatccagtagttggggagagaagtgagattataattagctgaggaatgagtgaggagtgagtgggacataaatggagacagtgagcttggaaagtgctttcaagatctcggttctgagaatcaagagagtgagttgtggttagaggtggccgcaggtgtaagggggagtttcgtttcctttttttttttttttttttttgcgacggagtcttgctctgtcgccaggctggagtgcagcggtgtgatctcagctcactgcaacctctgcctcctgggttcaagcaattcttctgcctcagcatcctgagtagcagggactataggtgtgtgatgccacacccggctaatttttgtatttttgctagagacagggtttcaccatattggccaggttggtcttgatctcctgacctcgtgatccgcccgcctcggcctcccagagtgctgggattataggcgtgagccactgtgcccggttgggggagtttctttaagtggagaggaggcttagcttgtttaaaaggtgttgggaaaaacccagtgggaagggtgtggttgaagatacagacaggaatgagtgataggactgagttgtgaggaggtgaggatccggggcccagggcaggtatgcttctcattgctgtaggagggaagaggaggggttactcttggtcacggagcggtggttgtcaaacgctgctcctgtcccagctgcaaaaaaatcaatcacggtgttttctgaatgtacaccttcctgggtctcctccccagagggtcagattcagaagagctagcatgagtgtcagaaacctgttattttttgttttaagaaatgtgtatttttaaagtctccacatccccccaccccaggacattttaatggacaaacagattgagatggaggcaggagggcagccacaggcagggcagagagaacggagtctggtgcgctgatgagagaagatagaagatagaaggattcttggatgtgagggcgatctggctgtgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaagctctcaagatagaaggattctaaagatgtgtattctggtaggttgtgtcaataaagctgattggatctgcggcgagggaggagttgaagctgactctgctttactgcctgggcagctgggtggataggtaacgttcccagtcactagagagggaatgcagagaagcaggagctcatttcaggagaagatgagttcagctttggacctgtgcagtgttgaggggtttgcagagtccggtcagaggtactcgggacacttggggaaagaaatccagagctggactggattggacatgagtaggtgagagttaggttgtgggtgtgagtgaggactccagaggtggggggacagttggaagctgaggacagaccttcagcccattccagcatgtaagggatggatagagaaagaggaggcagaaagtaggcagagctgggggcttctgtaggaggagttgcgtctcttcccctagtccagcggatggatgtgccttcttccacggaatcacgcgtcccgcagccgcttccctggctttgctcaccaccatggctatgctcaccagcctctgatccctccttgtctccagtgtatcagcccatttgtggcatctctttcttcatatccagtctggaacctgtagttcattactggagccatggtctcatccagactctcggagacctggcacgtctgttctgtggtgctcatcgagcaaaaccctaactttgcattgatttatggggtcaagtctgggcccttggcaccgtttctcagctaagtttctggtattcatttctcagctaagtttctgggattcagtcatctccctatgctacctctattttgtcttcggctcaaggctattctcagtctctccccatctcttcacccaccatctcactcttcacccatccaaaaaatcggggccatcacctgggtgctccttccgcttcctgctccctctctctgacttgtttctgtccacactcagctttgttcctttcctccaatccagaagaatgaagcagccttctcctgaggcccaccctccaccgattctgaactctttcttccctgtcttttctagcaccactcttgctttttctttaccttcattctctctcctgcaggaatgagcctggcacgtggttacagctgatgctttctcctgcgggtgccttagtggcacccctccctgagttgggagtctttacctgctgctgcgttgacctgggggttgcatccttatttggtgagagggcagagtatagaggtgtagcacacaggcctggaagtgagactacctgtacttcagatgctttcttgatgggaaggaagatcagaaaagttagtatgtgtggagctcctagaattttgccatagtaactactcaggtttaagtagtattaactggatccttcttctgagcctattcttaaaaatgcaaaagtataacccatccaacaactctatcatgtaccttcccaactgctgaccaccttctttccagctcttaaaaggtgatcttcccttattttttccctgttctcatctcccttcactttttagccttgtgcaattagtctgctactcttcgatggcggggccctgttctgggctcattgtggcctgcttccgtcccgctataccattgagctactctgagtgaaactcttgtttgatccaaaacatttggtagggagccttgggccagatgcagttagagaagtttgatgagcctaaggtccactggtgtcagcctgtggtgtggacatttgtctcactgtagagctgggtgagccctcaggactggtggggtcatttgaggcctgcactctccaccttcgttccagcttaggatcctgccttcggaacctgaataccctgtcccctgcatactgctaaaatggacaccaacattgactcctgaggctcttttttttgtgttctcatgaaggagcaaaccgtgttcctactgacattctttcttaagtatgcattcagtgtgtgggagatgatgcaaataaatctttatttttgcctctcatcgtctctttttttttttttttttttttgaggtggagtttcgctcttgttgcccaggctggagtgcaatggcgtgatcttggctcactgcagcctctgcctcctgggtttgagcaattctcctgcctcagccccccaagtagctgggattacaggcgtgtaccaccacgcctggctaattttgtatttttagtagagacggggtttctccatgttggtcaggctggtcttgaactcctgacctcaggtgatccgccctcctctgcctcccaaagtcttgggattacaggcatgagccaccatgccccaccttcactgtctctttaaaatacactcagttggggagctgtttgcttttatgaaaagctgtcaggccttgtgacttaccctttatgctttaattaactgattcagcagatacttactgagcactcctgtgggccagccggtctcctaggttctcaggattcaataggaagtaaaaggccacataaggtgatgatcttaggtgatagaagtcttgaaatgtaggctccatttaaaaattaaaagtgtccagttcaatatattaacacttcagtcttcattcaaagattagactttcccccctttttttcccagttaagacttgtagttggcaaccatctctgtccgaaaaagcggtgtgacaggcttctggtgcgttcggctcctctctgtccctcagatttcttgtgtctgacttcactagtttctggattgagtggaataggaggaggaaggagaggtgaggctctcagattgttcttctgtggctccctgagcctcgcacgtagttaaagctgaccctgtgtcctgcaggtgcttcagtgggctcttcagagactcccgacttctatcccttttgcctccttgacctgggggtttgcatctttattttggtcgatttattttggccagtttattttggtgactcctcagcacctaggaacttagatccccctatagtttcctcctgctggagtccttttggcctgcctgggggcactgttgtttgaacctaagaccctctgctggctctcgcgcacagcctggctgggactgcgtgttccttgccctggctgtgcatgtgggtcccagtgctcagcacggcttttccagctctctagatttcccaggttggagatccactgtacccttgctggtcacagatttagcacatgaaataggccatcgagcccctacctcagcttggtatgaaggtgtggctgtactcacagcccctcaaggattcacttcacaaagccccctcctcctgtcctgtcttcacgggagggaaccctcacattccactgtctgtagccctgacctggctgagaggactgtgggaatcaggggactgccttgcaatcactcttggaaagttctgcattctgctatggagcctccctttggtggcagcagcccttctcttttggtaccttagtggaaattcctgtttgatcatcttgttttggttggttttctgtttgtgggccaggaactgtttggctctcttctttaaggcaggctttagtgtttatacttttctgctgtaaccaggcctgggttgcccaaacctgaacagctcgtttactcttggggacacactcttccccaccagtcttaagtttttgggggctgtattattgaaacttccaaggaatatactcttcataaattttagcggctgggcatagtggctcacgcctgtaatcccagcactttgggaggccaaggcgggtggatcatctgaggccaggagttcgagaccagcctggccaacatggtgaaaccctatctctactaaaaatacaaaattaactgggcgtggtggttggcgcctgtaatcccagctactcgggaggctgaggcagggagaatcagttgaacccaggaggcggaggttgcagtgagccgagatcatgccattccactgcactccagcctgggtgcgagactgtctcaaaaaacaaaacaaaaaacaaatttagctaaaaaggaaagctaggcattaactagggagggacaagcttaagagaggatgcttttagaaaatgtttcttttcatcgtaaaagtaacgttaaccacactataggaagtttggaaaatagaaaaaaaacggtcctagcatttcatttaatttattcgtcttttctttttctatacacttatgttcttgttttgaaataactgactttgttataaaatgagtacgtgttcatcagagacaattctgtgatgcaggaaaggagttcagtgcaatgtaggaaagcactaggaagaaataaaatggcatttattgatattttggtgtttctgctgtttttccagtacaaaaatgaatatctaaataataggtaaaaataaatttatctcaatactattttcttgccttttttccacccaagagaatcttttaaaatgtaatcataatgagcatgtatatgctccgcttttttctttttcttttcttttttttttttttttgagatggagtttcgctcttgttgcccatgctggagtgcaatggtgtgatctcggcttgctgcaacctccgcctcctgggttcaagtgattcttctgcctcagcctcctgagtagctgggattataggcatgcaccaccacgtccggctaattttgtgtttttagtagagacggggtttctccattttggtcaggctggtctcaaactcccgacctctggtgatctgcctgccttggcctcctaaagtgctgggattacaggcttgaaccaccacgcctgacctatttttatacttgtagtagagacggggtttcaccgtgttggccaggctggtcttgaactcttgacctcaggtgatccacccacctcggcctcacaaagtgctgggattacaggtgtgagccaccatgctgggccccgctttttccctttgtcataagcattcccctaggatgctgcagaattaggttgtttctcccctcctttattttagtaatgccaagagcatcttaactttcagatattcatagaagtgaaagaaggttaaatgaagtgtattctcgtataacttttagtacgtactgccaaattccaatcccaaagggtagtaccaatttaaactccaccagcaatttaagggagaaaagattgcttttcttaagttattacatttcgtattcacagcagccctatgaggataggtattgttatttttcccctccacaaacgagtcttttcacgctcagaaaatgatttgtcgaagaccacatagctagtagtatgtggaagagctgagatttgactccgatttgcctgcgtccaaagcctgtactttctactgtatcatacaatgaaaatttagtccctttagtggaaaatggcaatggcaatatgacttgttaagtgctaggacaaacatctgggaaaaagaatcattatttaaacaagggtgctacatgtctatatggttcttacaccttttcaatcaacgactaataagtgtgagttattattggttttaatgataaaatactacgtgttaggcactgttctaagcagtttacctatattgactcacttaattctcataacagccctgttaggtaggcacagttactcttcccaatttgcagatgaggagactgaggcacagacacttaagtaactttcctgctgaggagcaggtctaggatttgaacccagatggtctggctgcctgttctgtgttgctcactactgcttctcagccttaaagaagtttatctccgtgtgtctcccaaccactgggatcgtctcaggcgagtgatgttagtagctcaggttagtgtagagcttgagccctggtcattggaaactgcatcattgtgtcctggcagtgtgcttttccctcatccccttgggaccatggcagcctccttcctgggttctaccatgctccttctcctggctgccagtgcacaagtctgcctctccccacatcagaaccaagatccagtttacctttggtagacatgttttatgtcctgattaggatcttttgtagcagttagtgctctacagttgtttttatttgtgtatcctctgtttttctcttcccttaccaagtcatcttccttttccaactttttccgttctcaacctgtctcaatatcagttttagtaatataggtggaacctatcttacatcaagcaattttaaaattggcatttttatagcattttaataagcaaaacttgctaaagcatatctcatcaataatttagcatttttgaagtgtgctttgtgaaatggtactatgaggagctcctgaagttttaaccctcatttaaattatgagtgtaaatgagaattataaagtaatccttatttaaatcatgattttccccccagatttttccctaaggctttctaagttacattgccattgtttcagtcatttcccagaatttagtcccttcagtggacgtgatacaatgggaagagcatgacactaatctttggaaagggttctgtagccaagttaggttgggaatgttgttggccatattgttttttgacattgacgatgcagattaacacttcaaagatcctttgcagccgtacaacagagaaatctgtttgactttattaactctgtttctaagatttattgggggacataaaatatagggaaaaaaacataaatttccatttcattatactgcccagatttgatcattatttctatattgctcttgtataaatttttttctcctttatgtgtgcatataaatacacatttttaaaggaaaggtcagcctatctacagtttcatattctgcttttttcatttactcttcttgaatgaattcactccatgtcattaagtaatcttcaaagccaacttttaccattatctttgttttgccttattacaaaactgaaacatgctgaaaaagttcaaaaattatacaaatattttatgtagtgtagaagggattagtcccacataatgattcccacgcccacgtaaccattgttggtagtctagtggtcattcttttagactttttctgtgtacctgcttatctatgcattctttttttttctgacgcatgtatatacatatacatatacctatacatttgattttatacagaaatggcattcaaatacacatttgatgttcttccaacatctcagatattaaaaaacgtgagttagaatgattataactttttttttcaattttttttttttatttaagatgggatttcgccatttgggccaggctggtctcgaactcctaacctcaggtgatctgcctttcttggcctcccaagttgctgggattataggcatgagccaccacgccctatccataactttttttttgttttttttgagacaaggtcttgctctgtcgtccagcctggagtgcaatggtgtgatctcggcttactgcaactgctgcctcccgggttcaagtgattctcctgcctcagcctcccgagtagttgggattacaggcacctgccatcatgcccagctaatttttgtatttttgtagagacagggttttaccatgttggccaggctggtcttgaacttctgacctcaggtgatccgcacgactcagcctcccagagtgctgggattacaggcattagtcactgcacccggtcgattataacattttatcgtactaaaataagttttttttgcagtattttcccgttagaaacacttagaacatctttgtaactaagttattgattgcatctttaaccccattttaaagaaataatcataaatgttgaattatagaatcaaaagataagaatattttattttattttattgtagacagagtcttgctttgtcgctcaggctggagtatagtggcgtgatctcagctcactgcaagctctgcctcccaggttcaagcgattctcctgtctcagccttctagtagctgggattacaggtgtgcaccaccacacctggctaatttttgtatttttaatagagatggggtttcaccatgttggccaggctggtctcgaactcccaacctcaagtgatctgcctgcctcatcctcccaaagtgctgggattacaggcgtgagccaccgcacctggcctgattgtgtatttattgtagagccagggttagaacttaggtcagaaaacctgtcctgctgtttcttcaatcttgtatcattttttgccttggcatctttggtttgtttttttttttttttttcctggaatccctcctggagtaaatttttttcgtgtaaggacacgagtggtgaacttctggatcttgcttggccgttcttgtgcagtcctgaatgactggattcctaagtacctagtgtgggtttcctctttgtttgtgggtacagccttttcccgcaagaggctcaaacttgaaatggcagggctgactctaggttctcttctagtatgcaaggaatatgaataggctggtttgcatataggttgcagaggtggggagtaggtggtggtgggggaagcaggactgtgagaaccccctgcagtcgtcaaagggtggctcattgctttctgtggcttttactcctgagtgaagctgcctttcttattaccctccttgtccgttccccgtcacctgtgctgtgatctggtttggaagtttgaagttaccccaagctctcttctacttttttgcagacctccaaccccctcattgttctccttaagcagattgtcccccaccccaccctttttggagagtttctaggattttattttgggggaataaataaatttctttccaactgggatggtggtgaaaaggctgtttgtagactgtgggtggggaagggtttgaggccccactgctgtcatgcttgttcggtggcatttgcaccactggagatgattttagacagggtgtcagcccagcagtaaacatcattgaaatagaagtcaggtcatgactcccttttcagttcttttctttttgttttttttttttcttgggggatatgacctttattgagcttatccaccacagtggaaataatgtctgtacaaagccaaatgtttgttactataacttctgcattacaattaaaatccaaacagttttttaaaaacagtcagctcaatcaaagcccagtacttcagaatcaatagcttccttgaagccacagtatcacttaaatatggttaagactcaaatgcagaaatttggttggaaagctaattaaacttccaacttgcccaaatagaattacaaaaagacaaaattgtgtttttcacagaaatatagtccactggcatcaccaacactggacagctgttcttttatttagagtcctgagataacaaggaatccaggcatacattagacagtcttctgttgtcctttcttcccaatcagagatttgtggatgtgtggaatgacaccaccaccagcaattgtagccttgatgagaatccaattcttcatctgcacgaatagcaagttgcaagtgacgaggggtaatatacactttacctttaagtcttttgatgcatttcctgccagttcaagtccctctgcggtgaggtactccaggatggctgcgctgtacacagcggcagttgcacccacatgtctgtgacccgtcgtcctagatttcaggtgttgatgaatacagccctctgggaactgcaagccggctctctgcgagcgggaaaccgcctttgtcttggcctttccggagtccttcccagccttaccgtcagccatttcgagttctgctgaagctcaagcaaggcagagaaagggctaatcagacccgtggtgagatcccaccatctactccttcatcgcaccgtgattcaaactgcccttttcagttcttactattcctgatcggatcaaagagaaaatcttgatgtggtgctagtctgaaagacctctctaataaaggctattttcctattgtaacaaaaagagcaggaagtaatattagtctttaataactttgttttgttataggttggtgcaaaagtaattgcggtttttgccattaaaggtaaaatggcaattacttttgtaccaacctatatttgtgtgtgtgtgtgtgtgtgtgtgtgtgtgtatttttgagacacagtctcactctgacgcctcagctggagtgcagtggtgcaatctcggctcactgcaacctctgcctccctggttcaaggggttctcattcctcagcctccgaagtagtagctaggattatagatgcccgccaccacacctggctaatttttgtatttttagtagaaacaggttttcaccatgttggccaggctggtctcaaactcctgaactcaggtgatccgctcaccttggcctcccaaagtgctgggattacaggtgtgagccaccgtgcccggcccagtgtgtttatttttatagttaccacctattaatgagaaagcaacacttgttttccatttaccgtagtgatatcaaatttcgtttaaaatatttatgtaaatcataggtgatttaaagaaaaatattaataacaggatcagggcaggcagaaactggtgctgtagtggtaatgcctgcagtttgagaaatgccctcaattctcccgaagattgttcatattcctccccaggtcttggtatttgttgattctttctctggactcagttgaaaggacacatttcgctggtgttttgagggttcttttattttgaaacaactttggaagggcgggaacgtggacaggtgtcctgggtctgctgtcttagactggaattttacctggtggtcttcttggttttgtcgtttttgttggactcttttcttttttctttttttttttttgagacgaagtcttgcccttgtcccccaggctggagtgcagtggtgcgatcttggctcactgcaaactctgcctcttgggttcaagtgattctcctgcctcagcctcccgagtagctgggattacaggcgcctgccaccatgaccggctaatttttgtatttttagtagaaacggggtttcaccatgttggccaggctggtctcgaacacctgaccttgggtgatctgcctgcctcggcctcccaaagtgctgggatcacaggcgtgagccacggcgcctggcctctttcctcgttttcgaattaattttagtgtttggggttttagtggggcttgttccccacttcagctaggccgttgctcagcgtcagtggctggagatgttggcagagtcagtccctccatccattaggtgctgaagggccactcagaagcccaaacttgcaagggtttttctgctcggatctcttacgcttttctcccagggagaggtcccgtggctcatcagagctttaaaaaccagacttgggtttctccaccatgcaggcgtgtgttctgcctgccctctttctccaacccagacccacgtaggctatgctgaaactctgtggaggcagaccctcttgtgtggcctggggacgttccagcaccatctttgtagctcgggcagccttacttgtcaccctgtttggttgagtccgacttcttgggtccttgaacacagggaggcaccccggcttggggccagctgttacccgcgctcgccctggcatgcagccctctggtgtctcagctgcgctgatgggtgcccaccccgcggtgcttctccaggccccaggcgtttcctttggtctctgtggaggttgtggggggcaggttggagaggagagttacttgccagcactttaaaattggcttatttcagacctaaattcaaggtgtctgtgatgtcctgaggcggatgatctggcagcctcagggccgagttgttaggtgggtggcagcgtccaccgagctcgtgcccaccttcttgccatcgactcccccatttcactgcctgcctggcctctgtaggcacttgaatttacaacacgttttcttgccactaaccacgcatttccccacttgaaaagtattatttcttctctcttacagtttatcacatggtccagaactttctgtaagcgtcctgatttactttatttagagttattccaactgttaactgatttatcccatatttgtgtgttacagtcataattttttaaacttattttggcttttaaaattattatttcattataattacatttcttgtctaattagtacttttagtaattactgctttttacatttaatcatagtgttaatgtttgtataaaatctccctaagaagtataaacccaactggtggccaccacagtggtgggaccaaaatgaacatttaggtgcccagtgcctttgctgacttgcagatttgaaacacttttctctggcatgcaggcctctgtgtttggtgctgtttcaggactaggattttaaattttacagctcactctttcctcccctctaattcacactgtttaagtattttagatgtggagcacattttttgtatctagagggtaagtccttctctttcctgacctttttttttttttccctggaaacttcttagcactttctcctgcttattttcctgataaactgtataactcttgcttcgataacaagtgtttattggctgctgtcctgagccaggcactctgcccggttgtctggggacctgtatgaggagcggtcagtgtggcaggtgtccagtgtcattgaattctcctcaatgcattagggacaggagctgattgatggatggcttccagtgttttacttctaaacactgtagggaaacagctgtaacaaaaataaacctggaaccttttgatccctggacagtctttgttgagacgatcaccaggaggcactcattcctccttaacgtggtcaccgaatctaagtttcattaagttttcttttaggaagtccagagacttgaggaataaatcatagtggaagtgcaaggtgtctcttgcaaggcatgggtttactgtgcttttgtggatttctgcccttagttttggtttagctcctttctgatgaaaaactttatgagaaagttactttatgagacaccaagtcaccccattcttgtgagaaccctgagaagtttaccaaatagttaagtagtcagacataggaaaaccaatgttgtggtaggatatggcggctcctcctctcaagggtgtgaaccatacagggctttttgatgtgtgtatttttacatgcgtgacttgtggaggcaggcagagtttctgggttgctcccctacctgtctgtcttcagctagaatgcttctgtaacagcccacaggactaagctttgcaaggcctgtggttagtgtctccagtacccaaaagatacatatttttattcagttaaaattggccattttaaccatttaaaaatgttcacttattgacttccagtacatttacattgttgtgcaattaacagcaaccacaatttaattgcagaacattttatcacgccagaaagaaacggagtgcccattaagccaggcttgtccaccctgcagcccatgggccatatgcgacccaagacagctttgaatgcagcccaacacaaatttgtaaactttcttaaaacattctgagatttttttcaatttttttaagcttatcaactattgttagtgttagtgtactttatgtgtggcccaagataattcttcttttccagtgtggcccagggaaaccaaaagattagacatccctgtattaagccgtcatgccctattaccttctcccaactgtccctgacaaacactaatctgctttcagtctgtatggatttttaaattctggacatttcatataagtggagtcatatagtacataactttatatgactggctttttttcacttagcataatgtttttgaggttcatctatgttgtagcatgtatcaggatccattcctcttatgactgaataatattctattgtatggatatacattttgttcatttgttgatggacattggtttgtatccactttttgtgttatgataatgctactatgaacatttgtatgtaggtttttgtggaaaaaaaaatcctgtgttttcagttttcttgggtatattcctcagagtggaattgctaggtcatgtcataattctgtgcttgacgttttgtggaaccaaaaagatatatcttaagtattaaaatagtacacatataaagttatcatagttccttcttatatattagaaagaaatggtttctttatagtcaggcagaaccaagttcaaatcccagcccctctactaactagctgtgaccttcagtgagttatttagcctttcttagtttatttcttcacctagagaatgctgataattaattcgtgcttcagggctattatagtaattcactgagatggtattacatgtaaagtgcttttattagcacagtgcctggcataaaataatccacatatactgtaatatttattttaggataatacgtagtcacccaagcctgattagtatttattgcctcaaagaaatgactatgtacttaggtcaaaccaaagagaaatcagacccaaaaggaattcttaaactttatatttttatattatctttgccagagaggtattttgcatttttacttttagattaatgcgttgtctgttattctcaaaatttgtagcatccctgttttcaaaggtaaaaggatctcctgcagagaagtgactttttcttaaccttctgtttgatctctgcttgggttctgtgcgtatgaaccacttcctggctctgctcacagagaggccgaagattactagtgacttgccccatctcagtgcataaggattcaccatatggatctttttcttgaattagtaactagttacaaattattttttctaattgtcaaaatcgatttttttttggtaaaaaattaagatctcccatgaacagaccagagattatctctgttaatattttggtagatgcttttttaaaaaaagtatttatatattatttttgtataataataccactagaatattttgcgcttactatttaggaacatctttccaaggtacaaaatatttttctacaacctattgcttaatgttgaatattatcccatttttatggatagaacataatttacccatttcccaattagatattcatattgtttctggtcttttcactattataaacagtgctgcgatgaacattgttgtagcagaatctttgtgcacatttatgataattactttgggctaaattcctagaaatggatttcttggatctgtgttgcaacctccacaaactgcagtctttttatatttcgttcacaattacatttacttttgttacacagggcactactttgatttctattagtgctgtttgtgattgtgtatgtctttcacttgaaatccaccatgaaggtgaaaatttgtttgaaccgtggcactatatggcagtgcagtgtagtcagttgtgtttgtagtccggattatcagagcttgaattctggttctgctgctcactagcttcttcttgcacactgtttcagtgtactcagcctcaccttttattttatttctacagagtcccatttggtgtgtaagctggttttttgttcctatttctgtgttcctcccatggggcttcttttctatggccactctagaccattgaggatggaagctgatggataaaaatgctgccctgttccacctgggatggtagttgagacacattcacaaggcttctcggaaagtcctgcaggttccagcacctgtcagaaacatctgtcactcatggtgatcgcctacttgacagtgcccttctttggactcttcctctgtttcgctccccgtgtccttcactactgctccctgggatcacattccaaaataaagtccctgcctggaagcctttgtctcaccttttactcttagaggaaccccggctaagacattttctagtcatggataggtaatgtactctccgagtcacagttttgtcttctgtataaatctgagaagagtgatgtctgcctcatagggttattttgaggtttaaaccgtgtaagtaattcattcaccacatagttactgaaaggcaactgtgtgctaagtggtggcattctggctatggggatatggcagtgagcaagacaactaggaccctgtcttcacagggtttacattctgatgaaggagacggacaaagaagcaaacaaagaatttcaagtagtaaagaatgccacagagtaaattaaccaggatgatgcactcaaaagcaaaaaatcacgatggaaggccactctgaggaggtgctcttagaaatgaggactcaatggtgagaataagctggacgtgggaagaacattttgggtagagagagtaacaggcacataggccctgtagtgggagtggcaggagcaaagtagcacacataaagtgtgatgctaatacctccacttcctaagtgcttaataaatgttggttggtattagtagttactagttggttatattagtaattaataattgaggttagatcaaaggggtagcccattggtaattacatagcagtaagtggtcagtttagccttatggattgatgacaaattggtttcatagaataagcagtaattgggcaggatgagaatggtttcatagtatactttaacttgttgatatggtaaattacattgatttgctttgcattcccaggataagcattatttggtcatgatgtattctttttatataatgctaggtttgatttactgatgttttgttgagaattttgcatctgttaatacgttcataaagtatattggtctattttttgccttttaatatctttgcatggctttgctaacagtgtaacactggcttcataacatgagttggaaagtgttctctatttttctgtgttgtaacagagtttgtatagaattggtatttaaatgcttggtagaattctcccctgaagccatcagacttggagttttctttgttggaagtcttttaactataaattcaatttcataatatctgtaggactatttaagttacccatttcttcttgaatgagctttggtaggttgtgtcttccaaggagtttgcctgtttcatctaagttatcaaatttatgggcgtaaagtatttcctaacattccctttcaaaaaaaaatttagttgtgataagacattttagtagtgataagaaatacataacataaaacttactgttttaactatttttaagtgtacagttcagtgacattaagtacattcacattgttgtgcaacttcttactatccttttaatgtctctggggtcagtagtgatgcctcctctttattcctgatactgataattgtgtcttctctctttttgtcctgatcatttctgctagaagtgtatcagttttattgatctcaagaaccagctttgagtttcattgatttgtctctattatagtttgttttttccatttcattgatttctactcttaattatttctttatatctgcttgcttaggttttaatttgctcttctttctctttttctgttttttttttttttttttttttttaagattgtaacctacaccattatgtgagaccttttttcttcctaatataagcatttttatgctacattttcccctctaagcattgctctatctgcagtccacaaattttgcttggttgtgcttcatttttttattctgttttaaatatactctaatttcctttgtgacttcctctttgacccagatattgtttagaaatgtgttgttgagttttcacatatttgggggattttccatctttctgctgttggcttctgatttttttgtggccaaggaacatgctttatatgattttaattcctttaaatttttttgaggactcttttatgcccagaatatagtctattttggtgaatgctccatatgcacttgaaaaaatgtgtaacttgccgttgttgggtggagtgttctataaatgtcaatcaggccaaattggttgataatgtttttcaggtcttgtgtatccttactgattttactggtcagcttgggctgccataacaaaataccacagactgggtggcttaaggaacagaaattaattttcttacagacccagaagctagaagtccaagctcagggttttggcgggtttggtttctcctggggccttgcaggagcctgctggcttctagctgtgtcatcacatggtctttcctttgtgtgtgcaagcatccctgggtccctcccttttcttaaaagacatgtcacattgaattagggctccatctatccttatgacctcacttaaccttaattacctctttaaagggcctatctccaaacttagtcagcatagagcttcaacatacaaattttaggaggaaacgttcagtccataacagtgattttctgtttgcttgtattatcgattactgtgagaagagtgctgaattctccaactatatttgtggatttatctacgtcccatttcagttctattaatttttgcttcattgaaatcctttctcagctctcagattctatgattcactgtgcacctcccacccaatgttttaattatgaaaaatttcaaacatgccacaaagtagaaagaggggtacactgaacacccatatacccaccacctagattctacacaattaacattttactatgttggctttagcaaatatcaatccctttatttatttgatcagtaccatatgatttttaaaaatgcatttcaaagtagattatagtcacattttctctaaacacttaaatgtgcattgttattccctagagtttaataataactatttaaaggtttttgagttaaaatttttacgtagtaaaagtacaaatcttgagttgatgagcgaatcttgttgtctataatgatactatatacttatcctgtgatgtgcaactgtttggatatttgtgtattattgctttccacataggtttctgagatgtgatttttgctcattttgagaggaatacttaatggtaattatcagatctgtatttttaggggtttgtttggtcctggacagaattaaaatggctgtgtaaatagggtcagttattagttcagtaaatatttgcttatatttagttttaatttttaattgtggtaaaatgtacataatataaaatgtacaatcttaactatttttgtgtatagtccagtagtattaagtacgttcatattgtgcaaccgatgtctataactcttctcatcttgcagaaatgaaactctgtatccattaaacaacttcccatttcccccttcctccgcccactgtaccctgcctctggcaaccacttttctactttctgcctctgtgaattttactactctaggtactgcaaataagtggaatcatataatatttatctttttgtgaccggcttatttcacatagcataatgtcctcaaggttcatgcatgttgttccatgtgccagtttccttcctttttaaggctgaattaaattccattatatgtgtatgccacattttgtttacccgtttatgcattcatctgccagtggacacttgggttcctcccgccagtatgtgagcacctccttcacatcactccccttttgtttaacaaacactcttgactgcctttatgtgtcaggtcctattggaggcatgagggatgctgcaacaaggaatgtaccagacaaagctgatgccctaagtaagcttgtgttctagtggagactgaagatgggcggatggacaatagaccaataaacatatttccttgattctaaaatgcattaggtcccacgttttaatgattctaaaattggaacgtgccttgtaattgatgacgtcttagaattatatttggcagcgtttattttttagtggcactaaaaataatggtgtatcagtttgaatcatagagttgatggatcactattaaatccactgttaagtgctatgaaaaaagcaggacaaaggataaggtaacatttgagcacagcacatgtttagttgatatgttttcatagcaggacttcatccctgaaggaggcagtatgttgattcacatttggcacaaactctgaccccactgtgagctggtagcactttgcagactggttattttgagtggcactggtagagaggagagagagacctggcaggtgaaggcttgggggagcatattgcaagatgggcccagatcttgtaggtaggaaagacaacatgtcagtaaacttagtcagggccatctcagtaactgccaacagttcttccagttgtccagaacaaaacttaattttattcttgacttctccatctgcccatgcacccggttagtcagcatatcctgcctgcagtaccttcacaacatatcccagtttcaacctccctcttcatctacacctccaccctgctggtttgaacatcctcctttcttccctggattccctaacagccttctaactggtttactatcttccaccattgccttactgtaatttcttctcaatttagcaaccaaagtgatcattcaaaaacatgtccaatcatgttattcctctacttagacctccccaaagcaccctgtcacatccagaggaaaggttaaagtcctcataatggcctgtagggctctggaccattcccctcatcaccacttgtttgacgttagctccctccctgtctgccttgtgctcattctgcttttgccagttggcagccttatcatctcttaatcatgttgagcatgttttcatctcaaagcatgtgtacttgcttttttttcctccagaatcacccttccctcagatatctgcaaggcctacatcttcaggtctctgctcaaatccacattacaagaaggttttccctaaccaggttggataagaccggcaccccttggctgggcgcggtggctcatgcctgtaatcccagcactttgggaggccaaggagggtggatcacctgaggccaggagttcaagaccagcctgaccaacatggagaaactcagtctctaataaaaatacaaaattagccagttgtggtggtgcatgcctgtaatcccagctactcgggaggctgagacaggagaatcgcttgaacccaggaggcagaggttgcaatgagccgagattgtgccattgcactccagcccggacaacaagagcgaaactccatctcaaaaaaaaaaaaacaacaaaaaaagacggcacccctccttccccggttatgctgcagtagcaaacaactctgaaatatcaggaacccgagacaaggcttgcatctcactggtgttccatctccactgcaagttacctaggaggggtccactccacactgtcgtcagccccgggagctggctgatagagtaaccaccatcttgcacgttggcaggtgaaaagaacaagaatgattccctggctcttaaagggtcctcctggaagtgacatagctttcatttacttggccagagcaagtcacactgccatgcctcacttcatttgggagtgggggtggggagcagtcctaccatgtgtttgggaagagacgggaaatatgtggtgaataacaaagccacaggttttattttccctagttcatttctcataggatttatttccatctgacataatgtatatctaccttgttttgtttgttgttgtttttctgtcctgtctacactccaaaccacaaggctagggactttgtccacagtttattgctgtgcctcaggacctagaataatgcatggtacagcgtggatgcctactcatatttagagaatgattgagaataccaaagcaaaccgttcatttattcatttggtgcatgtgttgggagtttggtattcaagttgggagtgtgaattagggaggtttgaggagagaggaagagatagtgtgaggtaagaagttgtagagcagatatactagagaaaatcagtggaaatgctggtcagtggagagtgtcaccttgagacttgagaccaagaatttatggtgaaatcttgtagctcagatgggtgacttttttgagtcatgttgagttgctcagaagctggcaaggaagaggaaggactgacggggcccattgcacaaggacaggtggaaacccaagttgaaggaaacatggatcaagctgcccgttgcacttacatcacccctgctccatctgcagtcctgtcagagtcacaaaggagcttgcctttaatgggggaagcccggggtgttgtgatggtgctggtggtaggagcaatattctctatattcattcattttttttttttttgatacggaatctcgctttgttgcccaggctggagtgcaatggcacaatctcggctcactgcaacctccacctcctgggttcaagcgattctcctgcctcagcctcctgaatagctgggattacaggctcccccgcaccccaccacgcccggctaatttttgtatttttagtagtgacggggcttcacgatgttggccaggctagtctcaaactcctgacctcaagcgatctgcccgacttggcctctcaaagtgctgggattataggcatgagccactgtgcccagcccctatatttattcttttatttcattttcttctcgtaacacttttgaggtaggttctcatctccattttacaggtgaggaaaattgaggctgaaatggctcgagaaaggatttaggttggttaggcttatagtcatggtgctctcctctacttttgaattacgaggcaatgaggaactcggttagattttagattccgtggagccttgtttgcattttggtcatgaagaaagtatgcaaccactttactaatggttctagtttagatgctcacaagaccttaccagagaggaaatagttgggctatttttatatgcttagacaagtacaataaccacagtgtcaactgtaactggtaaattcgcccccagggaatttcttatgaataagatgaaggtgcatctcacagaatctgagaatgtccccatcagtgaggcttttctgtgatcttggctgttaatgatctggacgtttcatctgtgcaagggacggtgctaggctttatggtggatgtagcgaagggtaaggcatgtggcctcccttcaggaatctttattgtggttgggatagcaaaactgtacaaaccctggctgctcatagtagtgtgtgggaacgagggtgcagagtgggggaaaagcccttcaggctaaaatggttcactcaggctgatggaggaaagtagaaacaactgtaatttgaaggctgcataagatttagataagggagtatctgtgctaataaggaaggcattgatgatatttggggatttaagtctggaaaaattttccaaaggcattgaaacagaaagcaacatgttcaggaggtagtgagctgtgcggtttgattgcagcaaaggctcctgagaacaaagcaatggatgttgtgctggagaggcaggaggcccagaatgtagggaggtctggacaaccagggacagtgacttgtcatttgagcttgaaggtcataccaaagtgaccacattgcagcctcgttttaggaaagagtatatacaaacacacacagatagtccttgctttgcaaggtgatgcaggaccgtaaaaatgaccgtgcaagttgaaaccgggcaaagctattttaataatcaatggggaaaatttggattgttctgtgacttttaaaaatcttcgttgaaagaatgctttgttaaaactttagactttctcttataaatgtatagttataaatgcatagggaaatgaaaaaatagtaaaacagtatactgtaatttattaaaaacttcagcgacattgagaattaaagggttttatttctttgtaagaaacttaccaggagcagtttgaacagtgtttgccttcttcctgttgtgtaacttatggggagtatctatcttaaaccttgtgaattgtcatacacctttctgagtttggctgagtttccattattttattctctctgctttcaatgtgacaaaatatccctgagagtttccttaatatgtagatttttgccagcatcacttcctcagggacatgataatcactattttagtgtactgttgcttctctaacaaattatcacaaacgtggtggtttaaaacaaaagaaatatggccaggcacagtggctcatgcctgtaatcatagcactttgggaggctgaggtgggcagattgcctgatctcaggagttcgagaccagcctgggcaacatggcaaaaccctgtctttactaaaaatacaaaaacatgagctgggcatggtggcaagcgcctgtagtcccagctgcttgggaggctgagggacgagaattgcttgaacctgggaggcgtcagaggttgcagtgagctgagatcacgccactgcactccagcctgggcaacagagcaagactctgtctcctcaataaataaataaataaaacaaaataaatttattatcctacagtttggaggccagaagtccaaaatggatctcactgggataaaatcaaggtgtcagcagggctgcatttcttttggaagctctgagaaggaatctgtttcttcgccttttgtagctttctgaggcagctcacatttcttgactcatgacccaattttatcttcgaagccaagggtgactggtggactctttcttacacattgtcactctgaaacttactctcctgcctccctcttgcacttaaaaggactcttgtgggccggttgcagcggctcacgcttgtaatcctagcgctttgggaggccgaggcgggtggatcatgaggtcaggagtctgagaccagcctggccaatatggtgaaatcccatttctagtaaaaatacaaaaattagctggatgtggtggcacgtgcctgtagtcccagctactcagggggctgaggcaggagaatcgctaaacccggtaggcggaggttgcagtgagctgagattgtgccactgtactccagcctgggcgacagagggagactccgtctcaaaaaaaaaaggactcttgtgattgcatagaatccagctggatatcttaggtagtctcatctcaaggacatctgattagcaacctcaattctgtctgcaaccttaactcccccttgctgtgtaacccaacatagtcacaggttctggggattaggacgtggacctccttggggagccagtattctatcacagtcaccttcctgttgataagttcaccttcactgagtttctctagctgcccaccttgaatggtggcagtgtcaacattcctgtggtttgatatttcttttataacctgataacatttgattcacatttcacttccagcactattactttttgttgctttgctgtatacattttttttttttttttttttttttgagatggagtttctccctgtcgtccaggctggagtacaatggtgtgatctcggctcactgcagtctctgtctcctgggttcaagtgagtctcccacctcagcctcccgagtagctgggactacaggcgtgccaccacgcccagctactttttatatttttagtagagacggggttttgccatgttgaccaggctggtctcaaactcctgaccttaagtgatctacccgtctcggcctcccaaagtgctgggattatagatgtgagccaccacgcctggctctctttttgtatactttcatgtgtattgactagttccctcttttgatgatctatttttgtaaaatgtcacatgaatttatcattggaagatgaggcaacacaactacatactttactgtctgtgcatgaatggaataacagctgcccagtgaccagtcactgacagacttagaaagaagtgacatacatgattggttgctgatcataatgcacgtcttactgacataatgatctatgtactgaagagctggtgttgttttaccaaatcatggtaactgaagtctgtgcctatcagagctatgcagaaatgaggaactgccagtgtgtgtatttttgtaccatgtctacatgtgtatttatataggttaatgtgtgttacttgttttttaaaaaagaaaattgggagttaagctagaaactattagaagtgtgtatctatgggagtgggtttgggggtatgggatagaggggataaataactgaagtgaaagtaaacctttgtttttcctggttttggtttttgaacaatgtaaatatttaacatattcaaaaattttaactgagaaaggagcaaactttaatattgaatgtaaacagaaataaacaaatctctgtgttataaccactagggaaaataattctttcaagtagcttttgaacacaagaccctgtccatccttagttgagagatatagatatatatatatatattcacacacacatactctaaggaccaaaagaaaaaaaaaaatcttcaaaggtatcttaaacttcgcccagtgggcttaataagtagtttattgtttgtaatgatactgatactgtaatattaaaattttatgtataacctaggataaagcaagcagctaactattaatatttaagagagaaacgacagaaatgcaaagtccttaggaaaaagcactgtaggccaggcatggtggctcacagctgtaatcccagcactttgggaggccgaggcgggcagatcgcttgagctcaggagttcaagaccagcctgggccacatggcaaaaccctgtctctacacacacaaaaaaacaaaaacaacgaaaaaaaaacctggccggtcatggggccttgcccctgtaatcccagctacttgggaggctgaagcaggaggattgcttgagcctaggaggtggaggttgcagtcagctgagatcacgccactgcactctagcctgggcaacacaaggagaccctgtctcaaaaaaagaaaagaaaaatagcactgtagtgttaaattgttaaatttgaattggaaatatcattatgaatcatgatttcaaaaatatattttctagctctgattactgaaagagctagaagcattgggacccagaaaattacagtgagcacatctaatgcccagatttggtttctttttttttttttctgagacgaagtcttactctgttgccccagctggagtgcagtggcgtgatctcggctcactgcaacctccactacccgggttcaagtgattctcctgcctcagcctcccaagtagctgggactgcaggcacgcaccaccatgcccagctaatttttgtatttttagtagagacagggtttcactatgttggccaggctggtcttgaactcctgacctcatgatctgctctcctcggtctcccaaagtgctgggattataggcatgagccactgcacccggcctcagatttggtttctaaagaccatttcccaacattccctaacagggatccttagagaaattctaggtcttgggcagggcgggtataggtgagcctaaagcaaggaagatgagtgggtaggtggagcagccagagcaggcgttgagggccctggttgaaaggccgcaggagctggtcagagggcttccacctggaccatctgaacgttggaaaaagaatgcaactgattgtgacacattgactaagtaaaaatccatgagtgtagagtgataccgagatacaaggagaatgaagacagaaggccagctaagaaatagaaaagtaatgacagaattatcaaaattatcattatgtaaaccctagtgtaagtcttaattgtaaactttttcacggtaaaaggatgggagaaaaaaaaaggcagtgtttttggttcccgatgaagcgtaagtatttcattatttgatggaaatctcagccatgtttttgtaaccaaatctgctggtaccacttgagttctcaagactagtcttttgatactatgaatattacagggttattattttattattattattattcttattttcagttgcaagatttaatagagtgaaaacagagctcccatacaaagggaggtacagggttattatataaagtaattatttccaaggaaagcatgttatttcagcggttttcctagattgagatgcactttatttttctgagtctccatcatgggccggacattgtgctagccgtttctttttttttttttttttttttttttttttgagatggagtctcactctgtcgcccaggctggagtgcagtggcacaatctcggctcactgcaaccaccaccttccaggttcaagcgattcaagtgattctcccgcctcagcttcccaagtgggattataggcgcttgccaccacgcccgggtaatttttttgtatttttagtagagatggggtttcgccatgttggccaggctggtctcaaactcctgacctcaggtgatccgcccgcctcagcctcccaaagtgctgggattacaggcgtgagccactgcgccctgcctgtgctagccatttctacatgcattacctcacttcattcttagcataaccctgagaattaggtcagatgaagtgactgaagctcagagaggtcagatactgtgtccaatgacaagcatcagtaagtgtgaaaatgaaggttcaaggccaagtcttctgggccccaggtcctttcccttctcatagctcttgttctttcccatggattagctcagcaagtagcttcaggggcttgttttcaggatctatgagagaggaaggcatgaaaacacaaaggtggaaccaaggaagaccagagggagagaagaggctacctagatgtctcacaatagtgtgcattttgattaaatgacatacttgggggaaatgttcctgagtaggtgaaagctgatattttgttctattgggaaaaaaagtgagcttgaagaaaacataatttgcttctttttttctctcatatcagagggaagagagaagacatttatagtttctaaaataccctcagtagtataattctgtcatacttaatatgtaaatgactagatcaaggaggaagaggggcgtgactgcttttagtacaaggcagaggtcacactagtctctcctggaaaactgacctgggctccagttgtactcatggtggaaaatctcagggggccactacagtcagcagtgttaacacttttagcctcttttaattttttaaaaacaaaacacccaggaatcaattaaccaaagatgtgcaatatatgtgcaaggaaaactatcaaacactgatgaaagaacttgaagaggacataaaaaaatgaaagggtattccatgcttatggtttggaagaatcagtattgttaaaatggcaatactacccaaagcaatttacagattcaatgcaatcctctcaaaatatcaatgacattcttcacagaaatagaaaaaaaaatcctaagatttatatggaaacacaaaagattctgagtagccaaaataatcctgagcaaaaagaacaaggtgaagtatcatactgcctgacttcaaaatatactacagagtaaccaaatcagcaggatactcacataaaaacagacacatagaccagtggagcagattagaagaccaagatacaaatccatgcatttgcagccaaaaaaggtggcaagaacatacaatggagaaacgacagtcccttcaaaaaaattgtgctggggccgggtgcagtggctcatgcctatcatcctaaccctttgggaggctgaggcgagaggatcacttgaggctaggagtttgagaccagcctgatcaacatggcaagactatttctccaaaaaaaaattagccaggtgtggtggcttgtgcctgtagtcccagctactagggaggctgaggtgggaggatcacttgagcccaggagttcaaggctgcagtgagctgtgatcatgctgctggactccagcttgggcaatagagtgagaccctgtctcaaaaaaaaaattgtgctggtaaaacgggttaaccatatgcacaaaaatgaaagacccatatttcttactatacataaaaatcaaatcgaaatggattaaagacttaagtctaagacctgaaactatgaaactactagcagaaaatgttggagaaatgctccaggacgttggtctgggcaaagactttttgtgtaagatctcaaaagcacagacagccaaaggaaaaatagacaagtgggattaaatcaaactaaaaagctccagttgcacagcaaaagaaacagtcaacaaagagataacccacagaatgggagaaaatacttgcaatacttgcagattaatccatctgacaagggattagtaaccagaatttgtaaggagctcaaacaactcaatagcaaaaacccaaatagtccattttaaaagtgggcaaaagatctgaatagacattctcaaaagaagacatacaaatggccaacaggcatatgaaaatgtgctcaacattattgatcatcagagaaatgcaaatcaaaaccacaatgagatacttcacccgagttagaatggcttttatcaaaaagacaggaataacagaggctggctgctgggcacggtggctcatgcctgtaatcctagtactttgggaggccgaggtgggtatcacctgaggtcaggagttcaagaccagcctggccaacttggtgaaaccccgtctctactaaaaatacagaaattagctgggcatggtggtgggtgcctgtaatcccaggtacttggtaggctgaggcaggagaatcacttgaatccggggggcagaggttgcagtgagccgagatggcaccacttcactccagcctgggcgaaagagcaaaactctgtctcaaaaacggcaacaactaccaaacaaaacagaggctggccaggatgtggagaaaggagaaccctggtacactgttggtgggaatgtaaattagtacagtcacgatggaaaacagtatggaggttcttaaaaaaaaaaaataaaactaccatatgatccactactggatatatattcaaaagaaaggaaatcagtatttcaaggacatatctgcacttccatgcttattgcagcactattcacaatagccaaaatgtggaatcaactgaagtgtccatcaatgcagatgtgagccatcaggcccggccttctttgttgtatacttccatctttattgactagttccctcttttgagtttccaatgaatgggaaaaaaatggatgatagataaagaaaattttatgcgtatatatatatatatatacacacacacacacacacacacacacagtggaatattattcagctataaaaagaatgaaatcctgtcatttgcagccacatggatggaactagaagacatgtaagtgaaataagaacaaaaagacaaagattgcatgttctcacacgtggaagctaaaatagtggatctcatgaagacagagagtaggttggtggttatcagaggctgggaagggtaggagggagagggggataaaaagaggttgattaatgggtacaaatatacacttagaagaaataagacggtgttcagtaggtcaggagcgtgtctgtagttgacactaatctatcgtacgtttcaaaatagctagaagagaataattcagcctaaagaaaagagagatatttaagataattacccgggctgggtgccgtggcccatgcctgtaatcccagcactttgggaggccaaggcagaaggatcgcttgagcccaggagtttgagaccagtctggccaacatggtgaaacatggtctctactaagaatacaaaaattagccaggcatggtggcacgtgcctgtaatcccagctactcaggaggctgaggcaggagaatcgcttgaacctgggaggtggaggttgcagtgagccgagattgcgccactgcactccagtttgggcgacaaagtgagactctctctggatatgattatatgaatgtatcagattatcatatgtactcccaaaatgtgttccctaatatgtatcaattaaaaaatgaaattaaaaatgtatttttatatatgtatgagttttgtgcatgctcaggagctaactggctgatttgatagaaacacacttctctatttctttacacttgggtagccattttctgaaaggtgttctatggaagttctggctgtaaacttggtctcatttaagagccaactggcaatgaagccctgctagggcattctgcttgtttccagtgtcttttgatcacttacatccccaggtcgatgttttgaaagtggatattagaaccaaatttcagagtttctggactttgtcttcattctgatttaaaagaagtgaattctcttgcttttcacgcatgtggttttttaaatcttaggaacaatcattctgaaagtgctttcctttttccctccagacaaggcgcctctgtcgaagagccttctgctggtccccagtgccctctccctcctgctcgccctcctcctgcctcactgccagaagctctttgtgtatgaccttcacgcagtcaagaacgacttccaggtaagctctgcctcattggcccctgagaggagagcggacagttttttttttttctttctagatttgctttttcttcctgctgttagtccctcaaagcccccaatttgtaagaaatatttattattaatatttcattaagtaacttttctagttattgatttttcagcaaaacagataataatgaagcaatggcagtatttccttttattaggcacatttgttttcagtttcactttttactcagagaagtgtaatttataacttcaagggaattaaaaacaatgtttaatctttttttaatgcccagtaggcatacttagctttgccaaaaccttgtctcaatttgaatatttgattagaggagctaggctctgtcagctgtatcagattatgaatttttgataacttttacagtggtggttaaacgaagtaagaaatttctcttgagtttctgctgtgggaaagagcagaagtgcttttcaaggtttctggactgatcttgttgaaaatgctagtactgggttcttgtctatgaattggagtgttcatgcaaattctggtatatgactgctaccctttctttgctaagcacttggttagcccattttaagcataataatccatttcttgaacactgacaccttttcttcatagtgatataattaataccattgctcagattggcttcaccaacttactgtgcaggtcttttagttatttatccgtattactgatttgtcagaagatagtgtagcttctgtattatttcagttgctataatgcagtccttctcaaccccggacacacattagaatcacctgaaaaaacttcaaagatctgtctccatatctatacttacgtgaaggtataatttatacctagatttatataaacacagtatctcgccccagaacaactgagtcacagagtctggtggtggcgcctgggcattgctgtacatttaaaaacaacccctaggggattctagtgtatggctggctttgaggaccactaatgtaagggcccccgggccttgggttgataccttcctaatttctggagttaatttggttcgtttggctaagcccactctgtgggcatctgtgctttaaaggtggtgacctgcttggatggaagaagaccactcttctgtccaggaatgggaatagccacatccagattaacacttaaaacacctaagaggctctcagtgtgtattcatgagagatatgggagttgcagttctgccttgggaaatctaaacacacgcatacacataagaacgtgatctgtaggtcacaggtgtacatgacatccttggggggtgatcaaggaaatagggaccagtattgggggcctacctctggagagtcttaggggtgtgagccttcagtttggtccaaaaagaagggatgactgttaattagcaatgaagagagggaagggcattttacttcaggaagtaacatgaatttcagacccttaggagtgtggtacaggaagcgtgctttgaggcaaacccaggcttagattggagaagtccaggagggctcagttgatgaagggctttattttgtaagttctgaacctccagattttggcagtgaatgcagaggtacagtcagttttctttaggttgagttgcagaagcagtgctttgctgagtgcaagccggtagccagttaccagtctttaggggacattcacctgtataataatatgcagtggtttattcttataccagctctcatagttttgtgtccttgagtatgattgcaacacataaattatttaaaactgtagctagcagctttattttcattaactgaaaaaatggggttctagaaatgcagtttgttatatcttagtaattacaaactctccatttccttaatcctcagattttcttagtggctctcagagcttatccctgagtagagtattttcattgtaatattaaatgtggggatagaggacttggagctgcctcttatggtttttgaatctggtgttctgaggagatgacagtcatcatcatcggacattggtaaagtccttggcagtttcctatgtgctctcgtgtactgcctcattgatcatattgatggaggtatatgctgcctaaagtttcagtgtgactccggtactgtttctccttgagcccagctatggcctcaacacagccttagaggcagccatcccagttcagctgggctggcaggtgaggtgaactctggtggccagtacagtcatgacaaagactctgcctggtgtcttgcttggagtagagacatatgtgacaggttttgacagttgatatgctcagacttctcatttgtattcttatttctgttggcaagagcacaggttgtatgactttacaaactttagtttctctgtgcctctttttccttaagacagttggctgggtgtggtggctcacacctgtcatttcagcaccttgggaggccaacgtttgtggatggattgcttgagcccaggagttcaagaccagcctgggcaacatggcaaaacaccatctctacaaaaaatacaaaaattagacgggtgtggtggtgcacacctgtagtcccagctactcaggaggctgagctgcgagtattgattcagtctcagagggttgagcctgcagtgagatgtgatcacatcactgcactacagcctgggcaacagagtgagaccctgtctcaaaaaaaaaaaaaaaaaaagaaaagagttactattaccaatgttcgcagcagcattattcacaatagcaaaaaggcagaaacccaaatgtctattaacagatacatggataaacaaaatgtggtgtatacataccatagaatattattcaactataaatgagaatgagattgatacatgctttaccatgaaccttgaaaatattatgcaaagtgaaatgagcaaatgcaaaaggacaaataaatgatcttacttacatgaggtatctaatataagcaaattcatagagacattaagtagaatagtgtttcctggggctaaggggagagggaacaggaagttagcatggcatttctgtctaggatgatgaagagttctggaaatagatagtggtgatgggtgtacaatattgtgaatttgcttaataccactgaattgtatactcaatagttaaaattttaactttttttttttttcaactttttttttttttattgatcattcttgggtgtttctcgcacagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagagacggcaaccatccgatttctcaatcttttccccacctttcccccccttctattccacaaaaccgccattgtcatcatggcccgttctcaatgagctgctgggcacacctcccagacggggtggtggccgggcagaggtgcccctcacctcccggacggggcggctggccgggcggggggctgacccccccacctccctcccggacggggcggctgtccgggcagaggggctcctcacttcccagtaggggcggccgggcagaggcgcccctcacctcccagacggggcggctggccgggcggggggctgacccccccacctccctccccgacggggcggctggccgggcggggggctgccccccccacctccctcccggacggggcggctgtccgggcagaggggctcctcacttcccagtaggggcggccgggcagaggcgcccctcacctcccagacggggtggctggccaggcggggggctgacccccccacctccctcccggacggggcggctggccgggcggggggctgaccccccccacctccctccccgacggggcggctggcctggccggggctgacccccacctctctcccggacggggtggctgccgggcggagacgctcctcacttcccagacggggtggctgccgggcggaggggctcctcacttctcagacggggcggccgggcagagacgctcctcacctcccagacggggcggcggggcagaggtgctccccacatctcagacgatgggcggccgggtagagacgctcctcacttcctagatgggatggcggccgggaagaggcgctcctcacttcctagatgggatggcggccgggcagagacgctcctcactttccagactgggcagccagcaaaattttaacttttatatctgttttaccacaataaaaatacaaagaaaagttggaattaatatttgttttacctatctcataaggtcattgtgaaggggaaataagattaggatgtttgagatgtcattgggattatctttaaaaatctgaaaaatgtttaagcagactcaaaaataggcctttgagtagctcttttttttttttttttttttttgtatgtccccttatatgttttttatgcagccagaagttgggtgaaacaatgatttaaataaactaatatttcaaacctagtcatatttagcagcagttgccataaattactttgcatagttgctatgaagtaagttgatgattaaaattaagctcagaaatgcatatttttgagtttatacctaagttgtttttcagttacaactttgtcttattcaataacataaaaatgaacatttgttagcctttcattctagtttacgtatataattttaaaaaatcttactaaacgtgatcctgaaatttcttataggcagttttctgttatcttaatgagaatatgttttcttataagcacaaaaaaattcaagtacctttcgtgccactgttgggaggaatttttactatgagagacttgagctcagagaacatacatatatagttttcctttggtgtgtgcattatgattttgtttaggacattaaaaataggcagtgtaaacataacaaatttgctaaggaagagacccgaacaaattttactcttgtttattgttcttttttaaatccccatctagatttggaggttgatatgtggaagaataatttgccttgatttgaaagatactttctgcagtagtctgcttatttataattttaggatatttgaaagaagatatggaagcagaaaatttgcagtaagtttttatgtattttgtctttgctacttaggctgtagaaaaaaattttgtttaaatggattttattttgttaaacttggtgttgttatttacagttatctttttaattacactattctgtatctgatttgaggcacatggacattaaccaaagaaaattttaaaatgtaagacattagcataataataatagtgataatgataatatgtagtattagttgtgaacactaatacaaattttaatactttgactttaataaaattataatttattttgcttagtggtttgtgttttacttgttaaaaatatatcttcaacatacttaaaaattatggctgttaatacatttgagcaatatgggtttaccccgcccattttctaaagtctattttaataaaaacaaataatttcaaatatatatacacacatatgcatgtgtgtatatacacacacacacatacatatgaatacacacctctgagctgattctagctgaataaatgttagtttatttttaggagactcatctctatcatttttctgctgttttattttgtagtcctttttgctgggttcctgggttttgtcagccttatttgactttctcctcattgaagctatgcagtatttctttggcatcactgcagctagtaatttgccttctggattgtaagtagcacttaaagattgacttaatttagaactacttgaatctgatttaaagtgttattattattatgtgaaagtcagtaaaataatattttaaacttctagatatagttaaattgattttatatgtaaaaagtctaatctatgcctacatttttattatgttcttgaaatagaatcaattttatattctttctttaaaatttattttactttttttttttttgagacggagtctcgctctgtcacccaggctggagtgcattggcacgatctcggctcactacaacctccgcctcccgggttcaagcgattctcctgcctcagcctcccaagtagctgggactacaggcacgtgccaccatgcctggctaatttttgtattttttagtagagacagggtttcaccatgttggccaggctggtcttgaactcctgacctcaggtgatccacccgcctcggcctcccaaagtgcttgagccactgtgtgagccaccttgcccaggcaccttctttttttagctttgaaagtttgtgttttagagaattttaagtgaatttcctattctgatcctgatagaattagttttgtgtgtttttatagtgaaatttgtctttgtaattttatgaactaaacacaaaaatatagtttaattagattaggaaacaaaattaatttgtacgaagttaagcttctgaagaataattttttaaaagctgataatgtttaaacacttccatcaaacataaaacaaagccggtgtataggttataactttgtagacaacctgccgtggccaaccccactcagaatttgtatgctttcatattgcgttgatcttctttaaaaaaaacaaaaaccatgtattagtgtgtgaaataactagaatctaggagtagagttgacagaacgagactccatctcaaacaaacaaacaaaaaaacaggccgggcgcggtggctcatgccacctttgggaggccgaggtgggcggatcacgaggtcaggagttcaagaccagcctggtcaatatggtgaaaccccatctctactagaaatacaaaaattagttgggcgtggtggcacgtagtcccagctgctcaggaggctgaggcagaagaatcacttgaacccgggaggcagaggttgcagtgagcggagatcgctccactgcacttcagcctgggtgacagagtgagactccgcctcaaaaaacaaacaaaatacccccaaaaaaccatgtattagtgtgtgaaataattagaatctaggagcagagttgttagcacatgtaaatgacctccaagcatctgaatgaagtatctgagacactatttgggaaatgagatagtatgaaatatagataccagatatttaaaattctgtgtgtactatcttcagtctccttttaattttaaatatatgttttgagaactattaagctactgtatgtatcttgattcaaattcactttggatccctattttaaaattatagttagtgttctaatagctttcgtacctgcattgttaatgtttacagtgtagctgccttttgtgaattatagttggtgtgaatatccatgaatgttgacctttagctcttttaataatgtatgattctgaataatgtttgaatggaggcataaagttctgtgtcataattagcatgcagtttgaattccacaggtggtcattgtaattagactgagaagttaaagttgagtattctgttattggggaaaatagtgtagtcatcaggaatgattccacattgactcaggaaagcagcagcattgccaaatcatcagttttccccaaaacatctcctatcaggccagttctttttggttcctgtatagcctactgagtgatgggaggtatgtgtgtctgtgttagaatgaactttggagatggatagtaacttagcattattcttatttacactgtctccttgtcttctttttcctgctgcacatggaatcgaatgacagtagaactttcatattcatttatttaattttggaatcccattaactagtacataaaaagattgattcaattttgaagttggtgggaatacttttgcttactctcagaagagggaagggatttacctatttaaatctcagtttgtagcaagagttacaaacttgaataaattgaaaagttgtagcatcccctttgaaagacactataaatgttaattcagccatctcctgaatgaaaatatatttctcttccttttcaagtcacaaaacattatatagtatgacttttttaaatcttcaggctttctcaaacatagactttttggaacacaattagttcaacaagtaaactttgtgtaatgtaaatatatctcttaaaaacatttttattattatttttggtagagaaaaggttttgctatgttgtctaggctggtcttgaattcctgggctcaagtgatcctcctttcttggcctcccaaagtgctggaattgcaggtgtgagccactgcacccagccacaaatatatcttttattgatggtagcaaagcttcaaaaactaaagagagaaaactactgtttttttttttttgttttgttttgttttgtttttcttgagacggagtctcgctctgtcgcccaggctggagtgcagtggcgcgatctcggctcactgcaagctccgcctccccggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctgtgttgtttttttttaaatcaatgtacttcatggacacagggaggggaacgtcacacactggggctgtctatgggtaaggggcaaggggagggagagcattaggacaaatacctaatgcatatgaggcttaaaacctagatgatgggtcgatacgtgcagcaaaccaccatggcacatatatacctctgtaacaaacctgcacgttctgcacatgtatccccggaacttaaaataaaaatatgtgctttacagctttcagtgttttgcacctaacatctaatatttttctttcccatcagtaccaaatttatctgcactctctatagttctttacttcctatttaattctctctctctctttttttttttacctcaccactatataggaacttctcttataaaggtcaccagtggccacctaatttctaaagccactggccatcctctttaacctttcagtagcaaattaaatgcttttaacctctcgttgtttcatgaaaccacctgctctcttgagtcccacacactactccctcctaattctttctgacttagttactgcgtgcagctcttttctcaagctttttgggctatcttgcccactttcttgatttcaactacagtgaacgtgtattgtttgcttcccagctgtctatttccaacccacactactctcctgatatttcttgagtcttatttcctttctttcttttattttatttttagaaatgaggtcttattcagttgcccaggcctagagtacagtggtgagatcatagctcactgtcacctcaaactcctgggttcaagcagtcctcccagctcagcctcctgagtagctgtgactatagatgtgccaccatgcccacctaattttttttttttttttttttgagacagattttcactcttgccgcccaggctgcagtgcaatggcgtgatttctgctcactgcaacctctgcctccctggttcaagcgattcttctgccttagtctcctaagtggctgggtttgccaccatgcctggctattttttttgtatttttaataggacagggtttcaccgtattggtcaggctggtcacaaactcctgacctcaggtgatcgacctgccttggcctcccaaagtgctgggattacaggcgtgagccactgtatccggccattttttgtttgtttgtttgtttttgtagagatggggtcttgttattttgcccaggctggtctcaaactcctggcctccagcgatcctcctgccttggcctcccaaagggctgggattataggcgtgaccaccatgtctggtccagagtctcatttcctgatgatttatagactcaaagaaaactcatgttcagaagctctcttctcttctggcctcctctctgtcttctttccctctttcttcttattttaattagtagcatctactcagagtcatgcaagctggaaatctttcattttgcttgtcagtggggtaggtcactgagtcttagtttttattttttgaaatttcaactttcagattcagggggtacatgtgaaggtttgttttatgagtatattgcatgatgctgaggtttggggtacagatgatcctgtcacccaggtagtgagcgtggtatccagtagttagtttttcaacccttgctcccctccgtccttccccctcccttcttccccctctaatagtcttccgtgtctgttgctgccatctttatgtccatgtgtacccagtgtttagctcccacttttaagtgagttcatgtggcatttgattttctgttcctgcattaatttatttaggataatggcctccagctgcatccatgttcctgcaaaggacatgatttcattcttttttatggctgcataatattccatggtgtgtatgtaccatattttctttatccagtccattgctgatgggcacttaggttgattccatgtctttgctattgtgaatagttctggaatgaacatgtgagtgcgtgtgtctttttggtagaatgatttattttcttttggctacgtactcagtagtgggattgctgagtggaatggtagtcctgttttaagttctttgagaaatctccaaactgctttctatagtggctgaactaatttacattcccaccaacagtgtataagtgttcccttttctcacttatatacaacagtgtataagtttcccttttcttcccagatctcaccagcatctgttgttttttggctttttagtagccattctgactggtgtgagatggtatctcattgtggttttgatttgcatttcttgatgattacctttgagcattttttcttgtgtgttggccgcttgcgtgtcttcttttgaaaagtatctgttcatgtcttttgcccactttttaatggggttgttttgtgcttgttgaatcaagttccttacagattctggacattagacctttgtcagatgcagtttgtgagtattttctcccattttataggttgtttgtttactctgttgatagtttattttgctgtgcagaagctctttagtttaaatgggtcccatttgtcaatttttgttttcattgcaattgcttttgaggacttagtcacaaattcttccccaaggccgatgtccagaatggtgtttcctaggttttcttctaggattcttatagtttgaagtcttacatttatatctttaatccatcttgaattaatttttgtatgtggtgcaaggtaggggtacagtttcattttctgcatatgactagccagctatcctagcaccatttattgaataaggaatcctttcaccactgtttagttttgtgaactttgttgaatatcagatggctgtagttatgaggctttatttctgggttctctattctgttccactggtctgtatgtctgtttttgtaccagtaccatgctgttttgcttactgtagccttataatctgaagtcaggtaatgtgatgcctctggctttgttttttccttttcttttttttcccttaggattgctttggctatttggggctctttttttggttctatatgaattttagaataattttttctaattctgtgaaaaatgacattgtggtttgctaggaatagccttaaatctgtagattgctttggtcagtatggccattttaatgatattgattgtttcagaccatgagaatggaatgctttttccatttgtttgtatcatctttgatttttttcttttttctttttttttgagacggagtctcactctgtcacccaggctggagtgaagtggtgtgatcttggctcactgcagcctccgcctcccaggttcaagcaattctcctgcctcagcctcccgagtagctgggattacaggcgcccaccaccatgcctggctactttcttttgtattttttagtagagacggggtttcactgcattagccaggatggtctcgatctcctgacctcgtgatcagcctgcctcggcctcccaaagtgctggctgggattataggcatgagccaccaagcctggccatctttgatttttttcagcagtgttttgtagttcttgtagagatcttttaccttcgtggttagatgtattcctaggtatctttttgtgtgtgttgtgttcttggtttgactctcagcttgaactaagttattggtgtatagaaatgctactactgatctttctacattgatttggcatcccgaaactctagtgaagttgtttctcgattcctggagccttttggcagagtctttagggttttctaggtatagaatcatattgtcagtaaagagagatagtttgggctttcctatttgaataccttttctttctttctcttgcctagttgctctggctaggacttctggcactgagtcttagtaattcaaagtcctaaatgaatattcatcccttcttctctacttctactgtcattattatcccagtctaaactcttaaatcttttcttgtctacttttttacagtaattctcttaactagtttccctgtgaatttgaaagcattccatacaatgctgtcagaagttatctttctaaaatgcaggcttaaccacactagttcttttaaaaaccctcaaattctcatttccatcagaataaaagtcagattcctccaagatgctatctaggcagtctggaatagtggaaatagcatggtctttgccatcagaccagatttgagattccagctctgcctcttactagttatgtgaaatcttgagcaagttgcttctctcaagctccatttcctgagctcagtttctagatgaccctcacatgtcaactgtgggtattctgtgcttcaaagggtagcaccgagaattaaagaaggtctcttacgccaagcttctaggagcaagcgtataccccttccatgtattgcttttcttaagagacaaggtcttgccatgttatccaggctggccttgaactcctaagctcaagcccagtcctcccacctcagcctcctgagtagctgggattataggcacgtgctaccatgcccaactcttctttcctttcagagtcctcctcatctgaccaccagctagtctctcaaaccacttcccaactggtcatccagctttcttcgcttgctacgcatttgcattctcatgcctacttggcttgctttctgcttcctcttgccctttggcaggattaattgtccttatatgtgtattacaacacatgtgttaattatctctgttagtatttattatattacgttgtcatggtctgtgccttctaggctacccactggctgtttgagggggaaccaagttttactttatgtactctttgccctacatttagtaatgttgaagagcaagcaagccttgattacagtgtagccccagtaagactgtaagggaaggcctttgaaccacagacctgttcatttctttttctagtgctttgcttagaaattgtagctgacatgatagatgctcatgactatgatttaaactcagaaaatgtaaccattaggttttgaaagtagaaataactccattattaaaagccatatgtgttaggcatttctagtaactcattcctgccacacatctggccttatatacctattattttttgttagtatttatatgtggatgttacatcgttttccagaatacagtgaaattttgaatttttacatattatgtttaaatgtatttggttataatgctaagtaaattatttaaaaaataacttttaagtgatctacaattaaattataatttaaattatttacagttttactgtgagaatcacagcatacattttcactttcttgattttgtatcaatagaatcttttgttgtgctttttgctctgagactaaactcttcttatcaagacaagctatggcagagaacttttccatctaataaatttaagagtagattcatctgtatggttgagagtaggctctgactatgtatatgtgtataataaacctacatatccaatacaagagttgtttttcttgttttagaaataattatatgttaaatatatgtaagatatacaaataatatataaagatataatatctataaaggtactttatgtatataaaatataaaaatatatatattttactcatttgactattgaaactaaaaactgtgtttttctctttattgagaaactgcatctcagtaccaccttatgtagctctgagaatgtttacattctttaagcatgtttgctttttattattgaaaaattggtgtttgacatgaaagaactgaccttggtttctaggtgtggttcttgagctgagcaagtcacataacctcttcagacctcagttttttatatttcgaacagaagaattgtactaagaagattgtctaagggaccttctagtgcaaaaatgccattttattattagactttttgtgtttatctttttttttaaggaatatgaatttacctatgttatttccagaaattaatttcttttttttttgagacggagtctcgctttgtcacccaggctggagtgcaatggcgcaatctcggctcactgcagcctccgcctcctgggttcaagctattctcctgcctcagcttcccgagtagctgggattacaggaacctgccatcatgcctggctaatttttgtatttttagtagagatgaggtttcaccatattggccaggctggtctcgaactcctgacctcaagtgatccgtccacctcagcctcccaaagtgctgggattacaggcgtgagccaccacgcccagccagaaataaatttctaaccaatgcatgtatttggttctaagccccagtaggatatgatcatgttaagagtgataaaggtaatttagcagagaggaagttatagttgaatcatttattttacttccataagtattcaggataataggggctttacagattatagttcagtttttttcttttagatggataagttacttggtttgttactttattaggagaaattaaatggcaaggctaagaaatccaaggttcctactagtactatttatactgtgacatatggcctgggaaaaaaaatcaattaacttcttttgtaaaaatggtatcttcaaccacataagaagagcaaactgtttgtattggagaatggcatttcaccatatagtagaaacctcaaatgatagaaatgaacttggattattggatagaaatagcatctcaggttagattttcatcattagtcctaaatagggtttggtgcatagtaggctctcagtgtttgttgaatgactattctctgtttttaaaagaatgaattcagagtagggaagggctgatggggatggctgtaacaggccccttgggttcttgttgctattaattttgccttgtagtaagtaacagtaatgagttcaacataatttcttatataggaattctggaagtcagtgtttgggacataaagtattggatttataattccattcctagtgcaaattagacctaagggagctgcatctagatagaaaataatttaatcaaattattttgtatggtagctcgatttcccccctactgacttgattaacacacatgtgtcgcttgcacatagaaatgcaaaaagttaattatctgtgtgaacaaggcttgactaggaaagaaaaatcagatgcttttctctgaataattcacaaaaatgttttatataagtttttaaaatgaagataatgaatttattttttcaagagaaaagggacttgatagtattatacagaatatccattgacgccagagtagttagtgaagtgaattttgatgggattgaaatgaaagaaccttattattcataacatttcactgtttatattgcttagtgaccgtagactaccagatcggaaactttttctgcgcatgcttcgaaggtaattacggtatagcatgacactaatgactcgagcctgaaattgttttgaaacgatgtagtagagaatcacatccagacacgtgctgaggttcatgaggaaggtggtaaaggctccccagggattgtaactgttctcccccgttcccagcatcaggaaagcgaaacagatgtggaagggcataaagcagacgagcacctgcaccagcagcgtgatgatgatccttatggacttctccttgactttgggtttcagcttagacgtcctgccgtgaaggagattatgaataatgaccaagtagcacccaatcatgatgaacaaaggaatcaagaaaaaaaatgtcagtcgagtgaggttcagcacgttcacagcttttagatagatgatgtcagaaatcttgaggcaggtggcgggagtggagtctttatctgggtctttatagagcagtagcagaggggtggtcgtggtcagggtcattatccagactcccacacacgccagcacggctttgcacgtgtttttaagttctttggcgtacttcggctgtacaatggccatgtatctgtcagcactaataaaggcaagaagccataaagcaatgcttgggtaaaacactgtgagagctccaagaatctggcagaagtactctccaaatggccattcatcttttgcataataaaacattcgaaagggtaaagtcattataaatatcaagtccactaatgccacattcatcatatagatggttaccgtggttctcttcttggtggtacaactgaaaacccataatgcagtgatgttaacaaataatccaattatgaagatacagctatagaagacaagggctgcaattttgtattcatctggatgtgagctgttaaaagggacaggttgatcttgattgttcagggtgatcattttacagcttgttggtaggcatgatacttagaaactgtaaaaatagttaagaaaaataagaataaaatcgttggttaaaaaataaatgcttaacattctcccactcagcttgactgccagtgaattttaagttcgagagcatttaatcaaggaacgattcaactggttaactactgaacattcacagtaattctcatttgagagagaatgggaacttttcctttgttacagctatagccccactgtctattgagcatgtaataggtactcaataaataaatatttactgaattgatgaataaatgaaggaacttttgatgagatgattcacagcaactctactttgctaaaaaactctagtttgtaattctctagtttgaaaatgaagacttgtgtagctggctattaaactttttgttttttttaaagtggaaacacttcataatatttattaccttatgttctctttaaattatcataggttgagaaacagcaatgttttgtgtcatggtcagcagatcaagaactagactgttagagcaatagatgagctgttttctagtgcacaattgggagtacgtaaagccaagtcttccaggttttgtgatttcagctgctctacttcagtggttcacagaaagcagcaccttgaaaaaagctagtgccgttagtaactttcatatcctcattccatctagattcagaagcttcaatattatttaaattttaacaattttcaaagtaaatccaaaaaaggagtatctaagacaagtagatattaataagaagtcattcagtaacttgatgtgtatgtagaaacttataaatttccatcaccaaaaaaaaaaaaaccgtccattttaaatggaaaggaggttatttggggttgcaaatatcattgactcctcagtgtgaaacttcattcccccatgatgcaacaccaacaacagacttcaaaaatagactttgctgcaatgagatggaatctgtggcatccccttgtaatatggaggtggatgaaaagtttccttcaaaaatgtcactttgcagagtgggctgtcttgaaatcagcccagaatttctctttaaggaaaactatgggggagatttgctgtctgtggtcagtggcatcacgggctattgataattaagaattaacttgagcaattgctgtggttaaacacaagaaacgtgcctgtctgccttccttcctttcccttcccttcccttccctttcttcccttcttctccttctttccttctcaaatatttaggttaaatatgatttaggagcataattctatatatttaaaaacatattaaattttccaaatattggtgtgactagaatattaatttctatcaaatgaggaaagtgctacagagaaaaattatatctctagtgtcattcaaaggagagtaatcttggaggcttaaatcttatttttaactggaatgcattcttattaaatagtagcaattataatataaatgaaattttgtatttgtttttctttttttagtattgcatcaggactcccttcacctatcctcatccttcaattttgtgacataagtcctgtacttacaaaccatcttgagtcttttttcccacgttatgctcaagctgtttttatgtagcttgtcaccaatacttatattcatttgctgacgtttgaaaaaaaatgagtgatgcatgtgttttaaaggcattatagtattgattgtgctctgcaaacacagaaatttttggataaatattgaaaagtgattgactttaaagtcagctttttaaaagctatagataccatgattatctgtagcttttcttttcttaaaaaccattaagttatttcatgaaacaatgtaattgaaaacatgtgatgaacattcctaaatatacatatgatttaccataaacattttctttccttaagttgaaaaaaattacatttagtattaatgtaaagcaatattgaaaataaatgtaaaatcatattaatgtggaaagatgattatatagcctatttcaaggtctttcaccaacatagtttgttatgtttatttttttaattaaatatatttttttaatagagacggggtctcactatggtgctcctgggcacaactgatcctcctgccttggcctcccaaagtgttggagttacaggcgtgggccattgcgcccagcctgtattattaaaatgaaatgatttttgaaatgcagtacataaagcattacttttgacaataatcatgaagttaattaaatgctgcttacctcctgtccatcaaaagtctgtgtgagagatgagcatttttcagcacttccacttctgtcgaagggatatctttgagttgcttctgttaaaatagctctttctggaaacagtgtatttaagaaatgttgtattttgttttagactcttttgttgctttaaaaagtagtttccagtgtaacgcttggcgtcggagttggtgctgggctgactttaattgctgctttgtctctttcaggaagtgctctctgaaataggctttttcaccttatgactttaccctggatgtggtttttctctttcacaaatgatttgtttatgaagtcacacttagcataagctccccttgaaatgatggcatatatttaagataattatatacaaaggataaagtttcttcagtttgtgtactttgatgcttgaagtctgcatcatctatggaaagagaagatttgatattgagtaaaagggggtttaaagtctagcttctttgctttataagctatgtgactttgtctagttacctacccactctgactaaccctttgttcctacttcatttctgtacagttgaaatagagataatactatatccagtaggattgtaggggccctaaaccagaaagatcccaagtgcttaatagtacctggcacttagtaggtactcctaaatggagtctcactttttactaccaagttattaaaaatcatagaatatccacatttccactttttactatttaaacatttctaaatgcttaaaagtaggatccttgattaattgcttctgctttgccacatacatttatccactttagtttgctgtattttgtaagtctgcttttctagtgcgtggaagtctagaaataatttcttttgcataaaaatttctgcaaatcttagcagaaaggactctgaagtctttagtggactgatttacatattaagagtgttttcacctaagaagggaaatgaaaccagcagaaagggaagtgagcaacgaatcgctgcctgccttgttaggttaattttgttttactttctcatttcttaaaaaaaattatctctcatttgcttatcctaaaattttaattatctttatgtttggttatgcatggtttgtcaactttttaaagggttcatgaacttaaatgtatttgtttttttgaattttagacagtttggggtccatccttttttttttttttctcagacaaaaccatagtaaatctgtggcttagaaaagttacttaaatccttgcctttggtgataaaatacttttgattgttacaacctgccagaatgatgggttttagaagtgttggagacaaccatagcaactatttcttgtgtggatgaagaaattgaaggccagttacttgcttaagaactcaaggtaaagccaggtccagtttctcccgctgtaataacttcttatgaggtaattatattgatctgtccactagataggacttcttatggctgaatcacattcatcagttttttatatgtgatgttatatttcattcatcacacaggagtttgatgtttcagctggacagaaatctgcctgcatgcagacctaatctgtcctttgccttattcacatagcttaggacttttctaaaattaagtattgattagcttccccattgctgctaaaatcaacagatacattgatggcatgtgtctagaagagtcctttcatcaagacttgaattcttcacggtgcacaggggcattcttgtttctgaattgccagactcttagaggaggcatccaggagcacctgagggctctccataggcctggcttcaggttggggtgagctctcactttttcctcatcttgctctccattccagccctctggactggctacatttgctcttcctgcctctcacatgctgttccacccactgtggcattcctcaccactgtctcccacctgatggcatggcctgctgctctttgttcttgtagctacctttttcaggaagctttctctgccatccgaagctgggctggtttctctgccctccgaagctgggctggttgttcatccctgcaggtttccttagcacttggtacctatccctgtagtggcacatgtttgcattgttactgcatatttacttgctttttctcctccactaaattgcattccttgagagttggcatgtgttgcatatgtgtgtagagaagaggcatttaatattggttgaatttctgactgaacaagtaggtgaagaaatggagaggttgggggaggaatggataaatgtctgggccttgagtcagcaggcagggacactttgaccagcttatgagatggggagacttaggcaagggcctgaggtctgtcgtcctcccctgcaacccatgagccctatagcattgacccccgttcgctgtgctcctggatcttcgcgatggttttgtgttggcagggaattatagtgaaaagaaactgcccagtcatttgacagcaagtaaacaatgggtcaaggattcaacttgtataatgtagacacaagtttctttaatacttgaacctaatgaatttttttttttccccaaacagaggaacttattcagggaccattcatgcagctttaatttcttcacttactttggaatatgagtgaaggagaaatgtttcacttgcaaaagagggattttacttattcccagagactgcaagattccctttgctttatcaaatagtgtgttttagctgcagttttgggttttggttttgatattaaaagccataagtgaattttgattttagccctataaaccagtttttgagtgaatataattcagttaagccagtttttaatgagaaagaatgtagttaatagatctgtatagcaaattcccactataaaatatgcttctatgttagacatttgtctatgccacaggtaaaataatatttcctgttctgttagcatagcaagtgtgagggcagcttatccttgttgcctcccatcagtgcggggaccaggggtccactgttgttactgttcatgtatcccagcagggggacagtcagcacacagccagtccccagggagaagagggtgtgaggcagacaaagagtcctctgaactagaggagaggcctatcctttggccttgacatcctccaacctttgtcccctcctttctgtttctcaaacttgtatctaaactgactgctctttgggtgtgggtgtaggggagatatgttgaatagtaagagtttctgcataaagaagattgagaaactatttgtctaaatgtgtggtttttcttaagtcccaacaatttacagctataatcttctaacccagttagtatacctcctttctgtttggtttcctaaattgtattgtaaatttaatattcccaaatttcttgtctttagcaatttttgtgtgtagttttaaagatgtatagacatgtagacattcagacacttaacctcacagcaaacaagttgaatccatatctaaccatatataagtgatggcagtgaaatcagtcctggaaccactgaagtcccatgggaccccaggcccagagtttgcagtgtgacattttactattggaagagagatccagagtcgccaaggcagcagattgagcagaactccatggttattgtgaggcacacagccttctgctgcacattctgatctcacagttaccagaggtgcaaatggagatgggtatacagtagtccccttatccgcaattttgctgtctgaggcttcagttaccttcagttaccttcagtcaaatatggtctgaaaatattaaatggaaaaattccagaaataaacaattcataagttttctgttgcatgccattctgagcagcaggatgaaatctctcactgtcccgctccttcctccccaggacatgagtcctccctttgcccagtgtctccacactgtagacattcccactcattagtcactttcatagccaccttggtgatcaggtttactgtcacagtgtcacagtgcttgtgttccagtaacccttatttaattaataatggtcccaaaacacaaaggtactgagcctaatgtataagttaaactttatcataggtatgtatgtacaggaaaaaaatagtaagtatagggtttggtactatctgcagtttcaggcatccactgggggtcttggaatgtatcctctgagaataagggggaaccactgtatagttaacacctagtaatatgaggaagtgcatttcagaagaaagaggagggctgggcacggtggctcatgcctgtaatcccagcactttgggaggctgaggcgggtggatcacctgaggtcaggagttcgagactagcctggccaacatggcaaaaccctgtctctactaaaaatacaaaaattagctgggcatggtggtgcgtgcctataatcccagctactcaggaggctgaggcaggagaatcgcttgaacccgggagatggaggttgcagtgagccaagaatgcagtgagctgaggctgaactccagcctgggcaacagagcagaactccctctcaaaaaaaaaaaaaaaaaaaaaaaaaaaaaaggacttgtggaaggtaaaggaacaagagatgtgttatcaggttatttaaacataaacctatataatagtgtgtgtggttgaggattttagtacacagccatttgtatagtaaaagtaaacatgtatctataaggttgagggttgttggtttaagacaagttacttaggattttttattatatctgccattattcttaactaaattatgaaaggtaatcagaggtgactgtcaggcatgattctgagagcctcacatgcttgagctaacttaaccttcatgctgactgcaaagtatgtagtttacatggtgtgacccagaaatatttactcatgactctcagattgtatgttctttctgtattttgcattataatattatacttcgttttagtaatttttgttgaagttggccctacttaatagagaatcatcataaatggtaatttgacttatagcaaacaatctcctgagggaatagaccatctttttatctccctgtttcttgctaatgagttgatattctcaaggaaaggttttatagctggatcctggcagctcgtacatgtaattgtggtgtctgggatctctgccattccatggccaaaagacttgaacaagcacttaagaatgagtagatccaaatggtcagcaacatgtaaatctgctcaactttttattaataattgggaaaatgaaaattaaaaccacagcagggtattatccattcgccagaatgcctacgatgaaaaagacggacagtgcaaagtgctggcaaggatgttgagtgatgagggtatcgagtaacaaggaacattgctggtgggagtttaaatatggaaaacagtttaagtattaaaatgaagataccaacactccatgactcagagtccactcctaggtctataaccagtaaaaacacatgctgcgtaccaggagacatggacaagaatgttcacggtaacattatttacaacaactccaaattaggaacaacctgaatgttcaactatagcatgaataagtcacttgtggtgtaggcatagagtggagtgcaagtcacaatcacaattgatgatacacagggcagatagaacaacatggatgaatctcatgaatctagtgttaagttgaaaaagccagacatgaaggaattcatatcatatgattccatttgtataaatttcaaaaagcagatgaaatgaaaatacagtgcttaggatttcatgcttaggtggtaaaccttttgggtggggtgtgggcatgtgtaataataaggaagggtcccccatcatctgtatggcaggatcctggagctgttgcttttcttaccctcaccacacttaggcccaaagagatcaaggaagggagaggttactagaacttggaaggagagaccccagtcaagtcagctgtcttggagcagtgcttttcttttgagagacggtaagcttgaggttcccttacaggaaggaaccagggaaatgtacactgtgacctcaggttcctcttggcctaaatctcccctgaggctcctgttagcaggaagccaggggcccatgagcctttgcatagagtttggacccaccagcctctgggacagagaacaggctagggaagggaaaagaagcaaatggattttctggcatgctgtacttttctgtatatgtgttacctttcctatttaaaaactgccttatagcttgtgtaaagtgcatgctgtagacactaagcactagttctcttggcttcgtttgtcccctttttttctttgtagcttatttaaatttttcctgtctttagactgggactggatagctgtgcaggagcccagcatgtgccactaactgaccaggttgtcttaaccatgttagctcatttctctgatggtcactctccccaggggcagttgggtgaggccttctgtgaggggtcatccacttccggccttgtgtgatttgaaggcattcctctccccaactctttgcattgcagagagtattttacctttggtcttcctctgaatttctgtaggactgtggataggagccggcaggataggagcttggaggctgcatggaagcctgaatgcgtccaggatgcatttcctaagtcctcatcccagggaggaaaaccaagaatgtgtctgctgaagtttgggcctactctaaatgcaaagcactcagtcccctgatggggtcacattagttcctgatctttgccatcgctgtttttttttttttttttaattgttcttcagtgtgtatgttttttaccatattttaaatttatttttaagtcgacctcttggagacattataatcaacctttagaggaagacgtgttgtttttttcttggtaataaaactgcattgattttggttactcagacaaggtatttaccagaactctcccttgtatgcttataaaataaaactagtactccattcagttgaatatttgcagcaatgttatcttcttattgctaataccatttgtatgggtagactttatgagaagtttatgactttcagctcatacagcttcttgcgctcagcaagccacagtctaaagagagtcttaactgagaagggaaggaaggaggcaggcaggaccaccctgagacccacaggccagctgccgctgtgcttctttggaaaaaaggttctcagactgtgttggcttacatctttctgcctctggtgtaggatttgctcttctaacatgaatggaacatttgatttaggatcagtaattacaggttttagaactggagtttgaagtatctgtgacacatctctctttgacagtcatgtgggtactgatccctgattgcactttcaccccttttcttcttcttgttctcgttttgtgtgtgccttgtgaacaaggacctggcacgtgcgtcttcaaacgtttcagcgcatctagagtagtgcttcacccagcaggccctcagttaacaggcatatggattcgactggtgtttgtgtttttctgtaagaaaggttatgccatgtctcaaaaaatgaatggctaatgtttctaggtagatacaattacaaagacgtaccaaataaaataatgagacaaaaagaaataggtagattgggattggctgtgtagaggttttaaggtaaaagtgggcaagttaaaaaggtttcgtatcagagaagttagttgcaatttattgaatgtaggagtactcacacagtttatttgaatatgaaatagatccagatttcttatgtatggtctccggttttccataccgattgatagttcagggctgctttgacataaatactgtgcttctactgccacctacagatgattagtgggtcttggagctcttcacctttaccccttctaaagtctctttgaaattgaaataattttttttaaaagctattaattggtagaatattataaaatattttaatgttactttatgaatatttctatattatattacataatactatataatatgtagctttatataatagatatgaatgtattcctctaaaacaaggtggccaatcttctggcttcccttggccacattgggagaactgtcttgggccacacataaaatacactaacactaatgatagctgatgatcaaaaaaaaaatcatggaaaaaactcataatattttaagaaagtgtactaatttgtgttggactgcattcaaagctgtcctgggcccatgtggcccatgggctgcaggttggacaagcttactctaaaacattttggcttgtagaccatttctgccctctttggaagcatcctcttttttaggaaacagtttttctctgtaggactatgtgtattcctgggctagggccttgagaagattccattttaactcttatttgtatctgatattatactaagatattaaacataaatgtggccttagaacaaatttgacatgttaaatatatatatatatgtattagacaatttatcgtcttaaccatgtttaaatgtgcagttcagtagtgttaagttcattcacactgctgtgcagccaacctccaggacattttcatcttcccagactgaaagcctgtacccatcatacagcaaatatctcttcagtccctactttcagttcttttgggttatatccctgaaagtgaaattgccggatcgtgtggtaattctggttttagtttgttggggaatggctgtatcgttttccccagcagctgcaccagcaacacaatgcccagtttctccctatcttggctcgcaggcacacctctctcacactcgcccttccctcccctccctcccttcctttcctgtagtagccatcctcatgggcataaggtggtgtctcattgtggtttcatttccatttccgatgatgagtgacttcaagaatcttttcatgggcttcttggccatttatatatatttcttctttagagaattgcctattcaagttctttgcccatttgttaatctttcttggttgttgagctgtaggagctctttatgtaatctagatgttaatcccttatcagatgatttgcaaatattttttctcttactccgtagggtgcctcttttctttgttgattgtgtcctttgatgcaatttttggagcatattttaggcttgctcatttatcatattttgatgataaggatgaatttcatagctttagatttctaaatggtgaggggaagggaggggaggttatcctgagtaaaatcaatgagtccttttggaacctttcctcatgacttaagccgaagcagtattttcctgcagtcctcagcacctttgccttgtccaggaggatataagtaaggaaggaagaaactagctctgttccagagtctgctcacttcagagccttccacttgctactgctgctttcttatgctctgaaaggtatctgcctttattattatagtcatttgaaattgaaagagtaacatttatctttttgtagcattcttggtccctgctgttctgattaatattttatcagtgataaaaaataccaaaatatagtgtgtttgctcatcagatttgcaaattacaaaaactaggaggatatttcagtaatggtggaggctaagcttctgtaacaaaccgctgacacagtggctcaaagagcgcagatgttcatttcacttttgtaaccaccctgtggggtaggcaggctctgtaccggtaagtcgtcaagggcctggtctggtggagcacctctgctttcctcaacatgtgccttccaaggaggctccatggcttctgcttccagctggtgtggaagaaagaaggggcatgcaggaggagggattgcctttccccaggtgccttcaaggttgcagatgtcactcctgctcccaaaccattggcaagaacttggtcacgtggccacacctaatcacagggaggctgggagatgtaatcttacctgggcagttgtgtccctggagataagggaacagtgggttttcggggagctgctagcagtcttctcagaagaacaatagctctaacacattagctgcctcagcaagctggagttttgggctttatagtcaaaatatgaaacatagaaggaggccaggcatggtggctctcacctgtaatctcggcattttgggaggccaaggcaggcagatcgtttgagtcctggagaccatcctgggcaacatagcaaaaccttgtgtttacataaaatacaaaaaattagccaggcgtggtggcatgtgcctgtagtctcagctacctaggaggctgaggtgggaggatcacctgagcctggagggccgaggctgcagtgagccatgatcctgtcactgcactccattcagcctgggctacagagtgagactctgtctcaaaaaaaaaaaaaaaaaaaaaaagaaacacaaaaggtaaagaaggtaagagagagaacattaggtctttctcttgagtcttaaaaatcagctgtagaggcactgaatgatagagttgtttggcttgtgaaatggcatcatggagtgactgccagttgacactaatatgcccctagatgccatttgtaggattacagggaaacaaggatgttgctggtggtccaggttggcatcaggatggggtggagatggagattggccatgggagaaacaggtggagaacaggcattgcttaccccagagagaagaaactggggcagaactgtcttccactgttgaaagggctgcccagtgaaagaggagttaaataaggggggaatggcctgtggtgaatgaagaccacggggacatgctacgggatatagctttgggcttggcataaggagtaactttgcagcactcactgtctcaagatgaggtgatctcccttgggagctgctgaatttgacactgaggatactcaggctgtggctgggagagtgcgaggcaggggtgttgcaggaagtccactcattggtaggtaccacaaatggagtgcctatgaaatccctttaaaccgtgagcattctgtggtttaaatgagctatattctgattctgtgctcttctttattgtgagattcataagtaggcttagagaactagagaaattaattggagtccagccaagggaccgcatttcccaggatgttctgtgcagcctagtactggtacagcagaacttgttccaggacataattcactgcaatgtagagttattattatatttctcaaattctgtaatacaaagaggtttgatattttttctatataatctaagtgattgattttttgctttcttataagcaaggggtatttttaaattttgaagtacgtacttccagaaagtctttataaatacttaaagaggaatagaatgagaaaatcctgacaccattaaggtaagagctaaataatgagttggtagggtgacatatttgaaacatttataaaataaaatattcaaaataaattacatttttcatattattactacgaattcttacagaacttcaatctagactgtaagcttccatgttaaagctgttttcccctttctgaaatgagcatgctcagcagttcagtaggcattgcctgcagtaacactgcactagatggcagtgttacatagaacttgataaaagctttaactcctctaaaataagttattaaatggggatcatatggtgaaacatttttgtaataaataacagaatggtattatactttatacaaacacctttaacagtttgataccctgtgactatttcataaaggcgtgtgctgtagttagaattaaaaactggtattgtgtatgtgtgttaatttttcctaaacaacacaataaagtattttaaacaccactggtatagcaattgtgaaactcctatgatgtaaacctaagaatgatttttagttctgattattcatgggctcagctcagcacagttccaaattttaactacgtaaggtgaggcaacacactacttggccctaatagtaacattaaagaaaaaaataatcattatctgaaaattattgagctaatcaaagagaattgtaagcagatatttttatcaagggcatatggtaatattgtttgccattttgtgtctctttgaagtcttatatgaaccacagactgttttcactagaatgcacatgtatgtaaatgttaataagaaaataattggaatttagcagaggtgaatattatggtcacatttatagtcatcagcttttgtcttcctaaataatgctccttagctaattcttgggcacagatcaagtgttagattttaattactactttttacatttctatatcaatgtccaagattatagtggtatcaacaacaagtagaatattttcaaaacccagaaagtaagtaagtagggaacgagagtttgtacttagaaacatagttagatagaaattgatggttgatggtgtggacatgcacatgagttctgaagaagaataaaaataaggaacaggaagctgaactgtaaaagatgattttcagtacattgcgtacttttattaacttagaaaatatgctaatcttttatggtaaattatggaggaagtcaatttcagtcatgttttaggagaagaaagaatttccaaagtgaggaagagaatagcttgacacttccttgtataaagtagccacttagtaaatgtttgggtatttatgcatgcatgaatgaatgagagaattctacctcatattttacaagagcaatcggctcttttctgatttccccaatctttttgcattctcttttcctcttgttaaattatttgttgagcacctactttatgataagccttgttctgggctctgaggatcctgcactgatcaaagcagacaaaatctttgtcctcatcgactgtacattgtaattgagggtaaaagacagtaaacaaaataaaaatttgtaatatatatatgccagatcatgatctgtgttgtacaaaactaaataaactagggaagggaatgccagggtgtgagtgggattgcagttttaataattctagtaaggaaaagcttcagaaatcaggtaatatttgagcaaagacctgaaggggtcaaggtgtgagctatgtggagatattggggaaagtattccagatatcagagactgccagtgccaaggccctcaggtggagatgggaccatcccgtacgtggacagctggagcagagtgatggggggatggggtgtgggaagatagcaggagatgaggccagggaggtaagagtggtcactgtcctgtcaggccattgtactaattttggcctttaatcagggcattcgggagccattgcatgatgctttgggagatgaagtcatgttggcctgtgctttcttttcattgtttcccattcttttttaaaaaagcacttaatcattttatacatacttagagtttttaaattgtttttcacttctgcttctcaggttatcaaattctccctcagggtagtctgttgtttcttagagttttaattttttattgtgaactcattttcagtggtttcatttgctcttcgagtccccatgtcccccagctcacaaaagtatctctgttgagggattttgtgtttactactgctgggtcctgaggggtttttgttgcctggattagcttttatattattttcttaccttagagctcccagaccattcaagtgggggtaaatctaggccacaaattcaggtatgatgttggccttagattttaattttttgttaggactgtttgatctttttgtttccaaggcttttaatgtaagctaactttctttgttgtttcagcagactataaatggaatatttttagtcttctctctaaaagacagtgatctttgatggtctgggctcagtcccagctctctttccttgagctgcttaaggtcacctcttttagctctactagacctaaaaatcccagccctcaactccaggggcttgtatctaggtcaagtgccttgtgggccactaaagcagcccatattttaatttctatctttgtttctgatatctgggttcattagagaaatttttaagcatgtataagaaaggagagaacactgtaatgaaccccatgtttcaacatcacccactttcaacactgatcaactcatggccaccttgttttatctatatccttaatcttaagccattctcatgggcctgtgacagactctctttggcatataaacccaggagcaggaatgtagggtcataggatatatgagtgtcttagtaaactcgtgctgtcatagagtgggtggcttacacagaaatttattttctcacagttttggaggctagaagtccaagatcaggatgttggcatggtcaagttctggtgagggcctgccgtcttcctgacttgcagatggccaccctcttgctgtgtccttacatggctgagagagctcactttggtctctcttcctcctcttacaagggcactaatctcatcatgggggccccaccctcatgacctcacctaaacctaattgcctcccaaaggtcctacctccaaataccaccacattgggggctagtgcttcaacatatgaatttaggggtggggggagacaaagttcagtgcacagcagcatgtatattgtgtgtgtatgtgtacattgtgagtctgtgtgtgtatctgctttactctctattccattggtccgtgtgtctgttcatgctctagtatttttagccattttgtttttgtagtatgtattgatatctagtagaacaggttactctttttttttttttggttcatcttttcaagattaacctaactattcttctgtataaattttagagtaagttaatcagttatctttaaaaattcagctggaatttgagatattaatattttcttttatctcttctattagtatacctattaatatattttataacttgaggttcatcttttctaaaaatgttgctttcctagttggtaatattattcagtttgtttcttttttgttgcgactgtgttctaaggttgcctagtgattttggcctcttagctcatgtttccctgaaaggtgttaaaccactttggcagagtcagattaggttaagaggggcagtgagcacccaggatagagaatccacagccactgcaggacctttgtgatccactcctgtttggtgaggttccagaggtgtcttggctagtgagggattcatttttaaactctcagaaattagcagtattgagagtaagcggtttctttatatggtagtttgcctgtcctgggggaaaggaaagatgtagaggaagaaatgattaaggaaatgctatctcttggtaggtacctacctcttaaggtaggtaccttgcagtgtggctgttgatgaatttagtgttgatctgattattaatactttgtgacagttttgatgaggtgctttggagtgatgaatccaagcagattcatccatttgggttgtacacttggtgtgggccctgtcaaacaggtgatccctgtatttctcttcttgaatttttcctgaattattttgatcacctcctcttccatttttctcagttctttctggaaatcctattacctagatgttcagtctcctggacaggtccagttttcatctttttttttttttttcctgctttctttctctgtgtttttgctctccttgctgggaggtttcctgggttctaccttgcaattattctaattaatattttaaaataaatttttattgaggtataaatgtatatatcttgagtccagagctcacagactttttacaaagtgacaccttctaagcaccatccagttgaagaacagaatgtgacccactccctaaaaggtccacttttgctaccttacagttactccttcctcccagaagtctacactgacttttaacaccctgatctagttttgtctgtttttaaactttacataatagagatgtggactcttctgtatcttgcttatttttttcagtattctgtttagtttcacctgtgttgctgtatgtacctgtagttaattttttttccattattggtatagtattttggtgtgtgaataccaccatctatccattctactgcttttttttttcttgagatagggtcttgctctgttgcccaggctggagtgcagtggcatgatcacagcagcctcgacctcctgggctcaagtaattctcctgcctcagcctccccagtagctgagactacagatgcactccaccaggactggctagttttttttatttttagtagaaacaaggtcttgctatgttgcccaggcaggtcttgaattcatgagctcaagtgatcctcctgccttggccttccaaagtgttaggattacaggcatgaggcacgtgcctggcctcataatactgttaatgttaatggacattgggattgtttataatttgggaatagtacaaatactgttattatgaatatcctttttccttttcttttcttttttttttttttgagacagggtttcactgttgcccaggctggagtgtggtggcacgcagtcatggttcactgcagcctcaactacctggcctcaggtgatcctcccacctcagcctcccaagtagctgggattacaggtgcgcaccaccactcccagctaatttttgtattctttgtagagatgaggtttctccatgttgccccggctggtctcaaactcctgtgctcaagcagtcctcccacctccacctcccaaagtgctgggattatagatgtgagccactgcatgcagcttgaatgtctttgaacatgtcttttgttgcatatatgtatgcatttctgctgggtatgtacctaggagtggaaagcagaatcatagtgtatacatatgtttagatttggaagatactgctagttttcctgtgggtcaggcatttaagagcagtttagctgggtgattctggcctagagtctctcatgtggttgtactcaggatgtcagggaccacagtcatcttcaggctttactgggattggaagactcacagtgctgttggcaggaagcctcagctcctcaccacggagctgcctcctgacatagcagctattacagcttcccccaggtgagtggtccaagaatgttgcagtccttttaattttagtcattctagcagatgtgtggtgatatatttttgtgatttcagttcacatttccttgatgacaaatgagattgagtaggttttcatttattggtttgttgttttggttttcttaaaaatatttataacctattttaaatttttattagctctttattttttgaatattcatttttcctgacatcctgttttcattttgtggatgcgatattttttatccctctcatattgaggatagtttcttcactacctgcctcttctacccaccccccaggttttatttctctacacagtttatgtttcttctgagttcctttttacctctttgttttctgcttttgatgtcaggagttttccttacatatctctaagcctttgattatctgtttggatttaagatccagctttttaaaagctgattggagtctcgggatgaggtcctcgatgaccatgggctctgtcataaggtcccctggtgaggatgtttgggaatgccagtgtcaggatctgtgcatttgtttcttccctgctcaccaccaatgggttggtcagattccccagatcatactctccactctaatacctgtagggtgtaagcctgggagtcttaacatttactaataaaccttgacttgagtggacaaattttgatttttagtattgtatttgtactgtcagtggtgtctgtgagtccctccagtctcaagaccttccgtttttctgcttctaaataataaatctccagccatctgccaagatggggagaggcagtgaggggtgttttccaacgctaacaagtagtactccagttcttctgagtgtccagcagttcaattcagttctgacactttctacctggagttagtatcagatcctacaagtcaaagagctcagtctcagaagactgtctccacttcagatgccagtcacacgtttcaggacatctgttcttctgactgacccgctgtaaattgggggttcccacaaggtctgtacccccaccaggtctgatacatttgcaggaacgtctcacagaactcaggaacgtattttacttacgtttattggtttattataaaggatacaacgcaggaacagccaaatggaagggcaaggtgcgagggtgggtgagagtgcacggagctctcgtgccttctgtgggcaccccaccctctcagcacttccatgtattcaccaacccagaagctgtctgaatttcactgcagaagagtttttatagggctccatctcccaccaccccacttcctggaggctggtgggtggtgctgaaagttccacccctctagtcacttggtcttcctgctggtcggccagctccatctgaggctatccaggggctctacctaaataacccattagggtaaattcagatgtggttgaaaggggctcattatgaagaagaaaaggcacttctgtcacttaggtgatgccgaagattttttgggagccaaacaccaaatacatttttgtagaataccacagccagccagcaggtgggtagagttcagggggtggctgtgcagtgctctgccttcctcttagcacttctggaaagccctggccctgcaacctttgggaagtcaaatgttaatcaggttgcctctcagatttcaccactggtggcttagtatttggttttctcaggtttgccaagatagctaccctgtatagtgttgctgttttctaacttagaaaaatttttaggatcatctactcttcatctttgtgggcttatacctttaaaaaaaatccttttaatgtcactcttatgagattttaggaaagaacagaggagataaatatgtatgttcaaactaccatctttaaaaggcaatattaaggccaggtgcagtggctcatgcctgtaatcccagcactttgggaggccgaggcaggtagatcacctgaggtcaggagttcgagaccagcctaaccaacatggagaaaccccgtctctactaaaaatacaaaattagccgagcatggtggcacatgcctgtaatcccagctactagggaggctgaggcaggagaatcgcttgaacctgggaggcggaggttacagtgagccgagatcacaccattgtactccagcctgggcaacaagagggaaactccatctcaaaaaataaataaataaaataaaataaaaggcaatattggtttttaaaaaggtgtgtgttttaagaatacttgcagttgtgaaatcatttttttctccattgatagttacctctacaatcattcagacattttattaaggccattttacattgtgtcatcctccagcatcactctcttacttgaaataaaataggccttgtaatcactgtgctctattgtctcactttctgggcctacttactggggctttgagtatttcaggcactcttgccccatcccctctgtcaccacccgcaagcctcatcaagcctctaatctggaggtgggtggtggtaaatgagcaagagggaacttgcttagtctcgggatccatctgtaggaacataacgttcttctaatatctgcagatacccagtttctgcaggataaatttcctcatggtctccccatagaagggcctttcctgctgttctcgatgagcagattaatgtagggcacaggtcttaccttctccatgttttccagttctgcctcttgcattgcacaggataaagctttccaggactaggcacagataatttcggaagctaagaaatagctgtgatggtgacaccaacattattctgtggattaatttggttatttagacctatttaaaagaatccattataggtattttatgtaatatttttcttaaatttgtagtcctgtgtgtggctttcatttgggctatgctattattaattaactgttaccacattattaatacatgtggcaatagagttggtaccaggcagtggtattcactttctcgggcgcgtgaagggattgcctgtctggaggtgagggctagtcagagagtagcagcacacctacaatcatctgtggtcatctcgaattgcaaccgttggagtatttttaagggaagtgggtattgtgggcaaagttagcaataagtgacagttagctttctaaattattgtgtctctgctttgaatttgggctaaatagccaacatataaataatcatcatagcttgaaaaatgatcagtgtctttaaaagtgaaaaaaagtgatatttctcaacctaaaaataggactacctggatctccaaatttgaagcgatcacattaacatgtttggaataatagattagataagttgaatggatagatattttagatatcttctctcctttaattcctatttaaaaaataaactttgttgatagggttatatctgttttactggtacgaaaacatttttagagagactaagaaatctgtccaggaacatataactcagttgaaattttaacctacatcacttgaatctaaaaccgccatgcctccaagtcaaggtaaagcaacagaaactgtcaggcttatggttcctcatgatcatcagtttgcagagaattatatttctgagtattgattataacaaatgtgtgtgaatgttgactttccttcatgagttactcagtatttatactgagaaaagtagactttagtctgctgttgtgtagccaaagcctttggattttaagctgttccctttctccttccttttcccacctccctctcggcttgccacctcttttctccttttcccccttttcttacccctttatctcccctgcttttgcactgatccccactcctcttcccctcccaacagtacctactggtttggttagccctaccggggattttagtaaataaatacttaaatgcttgaatgtgattgcacagagcaaagttgactaataaaaagttgatcaaaatttgtatctagaatgaaggatgtgagagaataaactgccaccattcaagtgtttcaagagaagcttaaaggtaattttttgcagaagctgtctttgactacccccaccctcagactaggtcacagtctcttgtgatatgctttcttagaacatttttctttcttatagcactcatcactatagatagtaaataagatgtaacaaatgatttgatacctgccacctccactagaatacagactttgtgccaggaggagactgtgttagtttgtctcactaatgatgcctcactgccttagcctgttcaggctcctctaacaaaatgccctagactgtgtgacttataaacaaccgaaatttatttctcacagttctggaggctgagaagtccaggatcaaggcactggcagatttggtgtttggggctgtcttttcgtggtgtcctcacatggcagaaagcagagagttcaatgggttcccttttataagggcactaatcctatttgtgaagactctaccctcatgacctaatcaccactcaaaagccccacctcctaagagcatcacactgggggttaggattttaacatgtgaatttggagaggacagaaacattcagttgatagcacttggttagcatagtggctcccacatagtggacacaactgtgagatggatggattgatagagcaaatagattaatgaaaagtatttgatcttttgatttcatctcctttggtttggactattgctgtagcctcctaactgttctccctgtcaccatctcaatgccatcatctgcactgccccactcccctaattttatctacaaaggagatctggtcttattcctttacaccttgagaaatctcctatggcttcctcctgctgttttataaagtttaacttgcttgtgacacacctcagagctccagccaatcttcccagcctcattttctgtcattccttccttgtactctgcatgtcagctaaattgcattactcactactgcctgtcacgcatacatcattacagatttctctggattcatttattacgacaattgtggttacaacatcccttctcccctttgcttgacaaacttctaccaagaaaacaaggagaacttcaagtgtccccttgggtagctctgctccacgaaaccctgctccagccagagttggaattaacctctccttccttcttgctcccagttaactttgtgcttgtaagttatgtgaaacattcattacttgagatggtaattatttacctaattgaccactctctcaactggatgcttttgaaagagcaggatcttactctctcttacagctccctcagcatggagtagtgaagagtgttctttaataccaaagggacaaagaaagctgactgggatcggtctgccacatgctagttgcttcagttatttttttgcactaaattattgtgtctctgctaatgtcctttttcctttcttccttccctcccttcttccttccttcttctttccctctctctctctctctctctctctttctcactcagtaagctacctcaaatctgttacttaagagaaaaatgtaggctgggcgtggtggctcacgcctgtaatcccatcactttgggaggccgaggcaggcagatcacttgaggtcaggagtttgagaccagcgtggccaacatagtgaaactccatctctgctaaaaatacaaaaataagccaggtgtgttggcgggcacctgtaatcccagctacttgggaggctgaggcaggagaatagcttgaacccaggaggcagaggaggttgcagtgagatgagatcacaccatggtactccagcctgggtgacagagcgagactccatctcaaaaaaaacaaaacaaaacaaaacaaaaaaaaacaacagcaacaacaaaaaagtataaaagttgaatttcacatttgggttcagtgatttttttttttaaggattgaaatgtggacttataaaatcatttccagcatcttacctaagagagaagcatataatccattcattcttatattcacaagatatctcctttctcaaccaaaaagttctcacactttgggctcagttcagtatttgggtgttggataccatgtgtccggcattgtacttggtactatgtcaccttggtagtcagcaagcacacgccaggctcatcccagacactctgcaggtgtgccactttctctccttagaacagccctggaaggtgagaactcgcatctactttgaggaaacaggctcagaaaccttcagcgctattttctataaattgataaaagaaaaatcatgatgttagaagatacataacaagaggaagaggcttttcttgtctcacttatgtcttgacattgcctgaggactgattaggaactgagattgccaatcattttaacaagattttagtaatgtttgaagatctgtgccttctgaatcaaagtggcgtgcagaggtacttaccttatggattgctggctaattgtgaaaggagactcaggcttttaacactgcaggaatttcaaactgcggtctcagtggccagagtgtcttaccagggagcagacctaatgtatccagtttaaaagggcgtgtaagctgttgccagaagtctacatgaagccacatgataagtgattttgtatttgaacatgaagggcagtggcatcattgacctaagctagagtttcctcaccctcagcacttttgacattttagttgcataaccctttgcggtgggggcggtcccgtgcactgcagggtggctggcagcatcactggcctccacccagtgtatgctgttagcaaaacctcctttccccagtcttaccccagtcatgacaactaaaaatgtctccagataatgccaaatgacacttggggggcaaaatcacccatgatggagagtcatgacatgcatgatgctgggtggtagatagaaccctggaaagagttagcccacacccttgaggagctcatgacctaggaagcttgttgagaacttttgactaggtagaatatttctagtagttgactgaaatagctttggttgaggctattagtaaaaatttgttttaaagaggtttaacatctgttttcatttctgcttttctgagttgctttgctgctcaattccttttattttagctgtcttcctcttgggacttcaaacatttgagtgtgtcaaaatttccagtctaataggaaatatgttttgttcaaaaagaaataaagatatttataactgttgggctagaatgatggaagtttaacgctggttaagtgagactcaggtaacagacagcaaaggagatactttaatagtgaagggaacttgaagtctggttgtattcaagattcacttcctgttcttgtttatcactggaaagttgcaccttgtgaaagattttagatttagatcattgtattgttctaagaaaaaaaattcaaaatgctaaccatgtcttggtaactatagcaaaatatacagcacacaaaaataatctcatacctgtcttagggttggattttttggtatatgttatgtgttgagttctgaaatatctaatgtgcttgaaatctaatgtgcttttgttatctgaactaaaggaaaaaggctttgtcagttacaagagaataggcatccctgttttggctggattgttagttgaagtaatagaatgaattctggctgattcagcagaaagggaatttattaaagtagctcagagaatatttaggaaggcaaataatcagtcatgggtacaccagagctagaatcaacactttacagttctctctcctaaaattattttgtttacttacttaatgtttaatattggcttctaggatgtaggattcagagagcaacttggtctgtgtggttttcagctgttattccagtgtgtagaatagcagctggttcatagagacacttgataattatttgctgtataaataaatgacaataccaaggataggtttgttaatatcagtgacaatatgaaggaaaaatatggagtaacattatgaaatgttaacattacgcattccatttggagatttttttttgacagcaggatttaccctttctcttaagaaatcttaataaatttatattgaacaattttgtaccgtagagccttgtttgacatatgttcctgatttaaatgaatagccagatttaaatgaatagccacaagcagacttgcaagagtagatgttgctattgctgtgttctacatgagaaagctgagggtctgaggattgagtcactaagtgacggctacttaagtggcaagcctggatggaaactcatgcctgtctgaattgtggctcagacatttccttaatgccttaatgccacctttttttttttttttttttttttttttttttttttttttgagactgagtcttgctcttttacccaggccagagtgcagtggtgctatctcggctcactgcagcctctgcctcccgggttcaagctattctcctgcctcagcctcctgagtagctgaaattacaggcgtgtgccaccacgcccagctaatttttgtatttttaatagagacggtgtttcaccatgtaggtcaggctggtctcaaactcctgacctcgtgatctgtctgccttggcctcccaaagtgctgggataacaggcgtgagccaccacgcctggccaatgccactttatttttaaaggtaaaacagtctagttaatggtcactatagcaggaagcaacttgagcattttaacttgccagactgaggctgtgtatttcaactttagcaatgtaaatgtccaaagacaacttatatgattgtattcaaactttgctgctaaaataagaagtacaaataaacacacaatgcaaagaaaaaaagttccaattggggggaagtgcccccatgaatggggcctgaagaagcactatatgacactccagttatttagctattacttgtattttcatttaatagactgaagaaactgctgtttcttttcagtagctaccaaatgctgccacttatgttttatactttttgaaaattttaaaatagttctggtttatagaaaagttgcaaggataaaacaaagaactcccatataccctaaaaccagatgcccccgttattaacattttccgcatttgctgttatcattttctctctacacagtattttttctgaatcatttgaaagcaagttgtagacataatgtccctttgactccaaaataccatgagtatgtattactttattcacatctggcaattgtccaaataatgtcctttatggcaaaaaggaaaatcaaaattctagtccatcgtctggttcagtattacatgttgcatttcattggtacatccccttactgtttaatccggactgttcctcagtctgtcttgggcgaccttggcatttttgaagactgtaagccaggacttacagaaaacgatacatattctaaggctgctggaaaattaaagtttgtgaaggtgaagcagtagatgaaaataatgtgtagttttcgtatttctcttggaataacattttataactttttcatgaaaaatttcagtgacacaagcagagagaataaaatgagccctattacccagattcagtaattaacatttttgctatcctctttccattccctggcattttaaaagtattttgaagcaatttccagacatcataatatcatatttcatatttcagaaagctctaaaatggcatttcttatataaccataatgttaccttacctaacaaaattattcataattctgtaatattatttactactgaaactactgtttccacatttatcctattagcttggaaatgcccttttacatttgcttttgcattcgattgtggtgtgtcttaagtagctgctgctgctgctgctgctcctcctgctcctcctcttcctcctcttcttcctccctttggtagagtatttttgtactttattagaatggtatggtgggtatactagattaactggctcattatttattattacctttcttcttttttttttttttaagagacaattgtcttgctctgtcacccaggctggagtgcagtggtgcgattgtagctcactgtaacgtcaaacttctgggctcaagggatcctcctgccttagcctcctgagtagctaggactacaggcatgtgccaccacgcccagctaattcttaattttttatagagacaacgtctcgttatgttgcccaggctggtctcaaactcctggcctcaagtgaccctcctgccttggcctcccagagtgttgggattataggcatgagccaccatgcccggccagctggctcattatctgttccagggttctcctagtgtacttcccataaagcagaggttggaaagctgaatgctctatttcttaaactcccttgcctggagttctggatatgatttaggttccattattcagaaaaacgtgtggctcttgaattcagtatgagccaaggcatatgagatagccattttcctggtgcagttctacacatccaacggggtgccagagttcacagttcaactccctgaaactccctgatccctagactctgccaaagtggtttgaccttggagctcacagttgatgtaattaacttttgtgatttcccagctgcctcagtgtgtcagaggaaacagttctcctggtagaccagtccttatgtgttccaggagtctattcctggaggcgctggatctggccttctagccttttcagcaattgtataagcaccgaattctgtgtactaaatctgctgcccaaaatagctgacaagatttctgttatctataactgaaccttggctgacagaactgctaatcaaaagaatgtaacatttatatttgacttcaaatgtatatatacaaagcaacatacctggatctgaaacatttagatttgaactgggacatagttcttccttgtggtcctttgtgttaggagatcaagttcctcaaagaacattgtgtgtgtgtttatgaagccttgctgatcttttcatgtggctttctggtataacctattctttgctggtgactttgttaccaccagccatctcttattaggacttcttttttttaatatttatttatttttaatttttttcccacttttaggttcggggggtacatatgcaggtttattacatgggtaaattgtgtgtcactcaggcttggggtacaaatgagcccatcacccaggtagtgaccatagtaccccatatgtggcttttcaacctccatcaccccacactcccccaacaagcagtccccagtgtctattctgttgttcctatcttcgtgtccatgtgtattcaatgtttagctcccacttatacgtacaaacatgcagaatttagtttgctgttgccacgttattcttaggactccttgaaggtctgctgagactcccctcacatgtaaccttagaatgtggccagtgcgcgtcccattctcctatgatttgaattgctgtgcttaactgattggagatggagactggtaactgtgtctcagttctttctgaatccatccctgaatttctgcctctacccccgatgtaacaagagtaagggcatgtgttagagaacatacttaccatttttagaaatttattacagaaattttcaaatatacataaatacagagagaatggtataatgactaccatgtacccatcaccttttaatcattttttcaaacacacaaacttcaaataatttgacagttggatccctaatgggacactggtttccatttttcattttaccatgtggttcctaaaatctgcatggtgttagcctgcagtgtccctcaaccctgcccttgcctcagatttgccagtatctctacgggcctccccagaggcctgagtgtcaggtgcaggcacaggcaggtaccaggtttcaagtagagctcataggagattgttgggactgagaaccaggattgccttgatctcttgtcacatgtgtatcaggcctgtgggtctgttttgataatgtcgtcttcttaactgctgttcttttttttttaaattttgagacagggtctcactctcacccaggctgaagtgcagtggcacgatcatgactaactgcagccttgacttgctgagctcaggtgattctcccacaccagcctcagttctttctgaacccatccctgaacttctgcctccaccccatgttgtaacaagagtaaggaaaaatatctttctttcttcttttttttttctttctttttttttttttttttttttggtagagacgaggtttcgccatgttgcccaggctgatctccaattcctgggctcaagtgagcctcctgtctcagcctgccaaagtgctgggattataggcgtgagccaccacgtgcagccttaactgctgttcttttaacaaaccaataatgttcaactttaggaccttcttgcccttgctcccttactggggaaaataataagcaataatacatgaaatggcacttgcatatactttcattactctcttgaacatataatatatgatatgctaaaacatactgtttgcatttatttttataggctaatataggcagtaaccttatacatttttactatgtagcccctgccaaaaaatttgatacttcatgccaggacttgatgggaaaattgtgggactgctgccctcaagcaataagaacgtatcaaaatgttactttttttagattaggtctcaaaccttttgtagcctccatgtagtttcattctgacacacttttttcttctcaaaatctgcctgggaaaagtcattcttgtacagaaaccagaaataaatgttttaacactctgagaaaatggataaaagccaatcagaaaagcacttgagttcttgttttggatcagttgcagtaggtgccatgtggggcagaaagtaacgtggcccctgctctggagtggttttcagttgagtggacaggatgtctaagagcattactaactacgagaagccacacagttagcatgcagatagacaacagctttaaaatttttgaggaaggtgaactcttgaaacaaaaaggaaataatttattgtattgccctcttaaacagcttcttctttctaacaactacagtattgccaggatttctctccatttggatatgcattatcagagataaagtagcatagcagtcatatgctgcttttttacatgtggaaggaaatggaaaagctagtggtgctcctcttatactctcaacagaaaagtttcattttggaaaataaatcctgactgatttaaatgtcattctaatttctaatttaatatattttccatgattagcattttagtaccaagcaagtattagttatctgttgctgcctaacaaattatgacatgtaataatatcaacctcttaccatacttaaaaactacaaatcatataatctcctcagctaatatttgatgacctatagtcaacatgtattttttggagcactgtctatgttcagggtgtcatgcccagtgctatccagaatagaaagaaggaaaagctagtgtctcttccccaatggagtttatgtttcatttgagggatacaagaatattgcacatgaaataatagaccatagaccgtacgatggctggcaaagagcttgcctattatctaacacttacttcactgacaagacaattgaagtctagaaaggctcaaagactggacaaagtgggatggagctgggttggagtctgacagaaccaggccacccatctccaggccagtgtcttttttcttcctttgttgtaagatctaaattaaaactatgtggcatatactgtaaaagccagataagttgaggaaaggaagatggatggctttgagtagtcaaagaaggattaagggaggcggtgtgatttggatgtaagtgtaaacaagaaggggaggaagcaggagaatcccactagagagaaccaaacattttatccacaggacagacaaaaccaactagacaaacttgaaaggcccatattgggcaatggagataaatcaggttggagggagtcgaaagtgtgggagaggaacttggacttgatgtggtagatcatggggaactattctcaatccctgagcatgaaatgacacaatgaaagtgggattaaggaagattgtttgccaagagaactggatagtgtctgcatttttcttttcttacactctgtgtattggtcttttttttttcattccaagtaggttaaacactgttttaatcagaacaggttagcttatgttgcagccacgaaataaccctgaaatcacagtggcttaatccacagtgtgtttcttgtttgcacacttgtctaatgcagttgggtggggcatggggtgggagttctcacttactcattcagggacccaggctgacaaaggtgccaccatctagaacattgccaaacactgtggcagaggagaatgccactccctctcacctcgggctggaagtgacacacgcgtcttttgcccccaacccattggtcagaggtagtcacctgctcttcctccccacccccaaggaacttgaggatatttggtgagcagtgtgtgtctcttttaaggctttctgaggacctggaacatatctgtttatttgtttaagagagaaaatacgatgatgaagagtgcagaccatggagccagaccccagagtgtagagcctggctccccacttgctgactgtgtgaccgtgggcaagttactcaacctctctggagcatagtttcatcatctggaaagtgcgactgataaatagaacaagcctcacagcattcttgtgagatttgaatgagcactttatatgtaaagtgcttaaagcactatgctatataattgttagcaagtatttattattgttaatctgctggcttctggtacagcatcctaaagaaaggctaaagtttctgactctcatcaagaggcctgggggaaagaggttgtaattaggtgtgccaaggccagtgtctggactaggatgatggtagtgggcaaagaaaacaggcaaggccgggcgcagtggtttacgcttgtaatcccagcactttgggaggccgaggcaggtggatcacttgaggtcaggagtttgagaccagcctggtcaacatggtgaaactcatctccactaaaaatacaaaaattagctgggtgcagtggtgggcacctgtaatcccagctgctcaggaggctgaggcaggtgaatcatttaaacccaggaggtggaggttgcagtgagccaagattgcgccactgcactccagcctgggtgacagcgagacaccgtttcaccaccaaaaaaaaaaaaaaaagaaagaaagaaagaaaaagaaaagatagggaagagtgcatttaagaggagagcacccaggtagggatttgttcaccacctgaatcccatgaatgagagaaaagtatcagatgtgggtgacagagaatgcaggtagagtttgtagagaaattcaggggcttgaggggaaaggtgaattgaattcagatgtggtgatggggagatgtccaaggccctggaggacataggacagggaggaatggagctcaggctacagggtggaacctcttactaaccaagtttcagtaagtggtggcatgaatgctccaagtcaggccacaggttctgggaccggagagtgtgggattaaaccggctctgccacaccatgtgaccttgttgctatagtttcctcatcagcaagatggggatgatagtcataccatgtcttaaggtagtgagggttaaataagatgatgcctgtagaggacttggaaagtggcatgtagtcagtgatcagcaaggtcttaatcgaatagaaatttgggggctgtcttttaagcaacctgcttttctgagtttaatgaaaaccttccattggcagcagttcttatgagtactcatgtagtcctccctgggttcaaaataatggccttgtcaccgggtcacttgtaatccacatgcttttcattttctcattcttcacccaaatagtcagtgagcaaatattttttagctatgaagagaataagaaattacaatggtccaaaaagtaaccaaaatagaccattttaagggctaatttaagatcagtgcttccccttctaaaatcgcatgccaccttgtactcaatggtaggagccactgtctgcccttgcctcttgaaatataaaattatttctgtatttagttttaaattgccttgttggctaattagcgctctcctttaatgtgtctaatttaaattacaggatcttcaagggcatacgctctatattgtgtaactgccttcagttacacacgtgctctagcatatgtaattgaatatttgggttgtttcttttcattgagaattaagaacttcacagatatttcagtagggctttagaattttattagtaataatacaaaacatacgttatcaattaaatagatatttgaggaccttcaatgtgtaggttctatggcaatgctgtatatataagagaagaggcacttgccctcaccgagcccacagcttagccaagtttataatctatacctattgttgggttatttgtcctatttaaggattatgaagtcggctagcatgtaataaagcagtcgaggcttctaacaccttttcaggggccacatgattgagttgtcttctttatggccaggatacagaattggggttacattccttttttttttcttttcttttttttttgagacagtctctcgcactgtcacccagactggagtgcagtggtgcaatctctgctcactgcaagctccgtctcccaggttcacgccattctcccgcctcagcctcctgagtagctgggactacaggcgcccaccaccacgcccagctaatttttttttttttgtatttttagtagagaccgggtttcaccatgttagccaggatggtctcaatctcctgacctcgtgattcacccgcctcggcctcccaaagtgcagggattacaggcatgagccactgcgcccagctggggttatattcctaatgctgcctttaatttatcagggtgcctgttctgaagttaggtttctttataaagtatgggtgacactgtttgctcaacctgtttcacaggattgtagaaaggaagatgttacataatatatggactgttttataaattattgagctcttcacatatacatgatgccatttctaacatctgacactattctatttttactatcctctcgctgaatagtcagtgaatttatttacactgatccaaactaaatagctttgagggtttttttttttaatgtggtcaactgccataataacgatccattttcccagattagtttttctagctcccaattattatttaaaattgttaataatgtatcacccgattcatggagaaaatacttatagggttgtgattttcaaacagtatgttatataataaagtcatgttctgtaacagaatataacaattatacagccctgtcctgttctccaagttgacctcctggttaggagaatgccccggaaataaatgtaaagctaactaataacaagacagtgagaggatgcccacagccgtgtatgaacagtggcttgatgagtagaatgggcagcctttaaggggagttattggctgagtttgattggagtacagacttgtaagaaaacattaattggagataggattagagtttacctttttggcagtatggttgctgatgactggataaaatcatttatatagatttgtggtatagtggagggaggaggcagaaaactgaacagataaaagaatgttattctgttgtcaaatgccataggtatttactctcttgtttgtaggatcctaagaattgactcccttagcccagagaggactcttgcctaccctaagacagtgtgttggctcatacatcccagaaggcgtctctactccagtgtagtcacagaaccagggcaccacagagaagctctgaaatggaggaagctttctttttggttttcctttagtagtcttcacgatggttcctctttagagatccaactcagatgactacctaagtgccaacttacatacaatttgttgttttgccctttcttttccttcacttgggaaagtttagaggtggagtgaaggaaaggcagtaagatttgggctttcatccgtgttgtctcacctgtctgcataagatgttacaaagaccagtgcctatttttgacaatggctttaaaatcaggtggctctttgtgaaataaatgtaatggaaatctgaatatactagtaaatggtgttgaatcaaccattaagattaattttcatacagagtaaaagttgaaaatgggtaagatgagaactttaaataaaatattttcaggatataaagtccaataaaaatttaaagtgtaacagagtgagaccccctttctgaaaaaaatttttaaagtacaactcagaattaacattttctttatctaccattataaaaattggtgtcattgccaacagagaatactgcattggggtagttttggggataaaacaaatttgaacaggcagaccagttgactacctggaaaggtcatgctactcatactaaggtactcatttcagcaagtatataatattgtaaagaatcctaagatgcttaattttgtaagtttgcattttactcggatcgtatttagcaagcagcagctatatttttcactgctcatcatgcaccacccttctcctacttgataactcaaaccattgaaatacagatgtagagtactaacagcttgggggaagaaaagagaaatgatcccctagtgatcccaagaaaaccaatcatataggcatgtcttttattctcaagatgaatttagcaagcagaccctcctcccaatgggcacctccatataaagtctttttcatattgctaagcagaggccctaaaagactgtgctggcagctccaggaaaagctcagtgctttcattgcctcagtcatcatcatcatcatttataatgttgcagttcaaagtctattgccaattatcttttccctgacactcccactgatagttgacagggagcattgagggacagactcataactttgcagcatcctgctctttattccaaaagagttccttaacaaagttttatgacccagaacgaaacaaaacaaaacattggtgttattgagggaattaaatctaacattgagagaaatttggatttaagaaatatgttatttaaaaagtatgttacagtattaacatctggcaatatataatctattcagtcctttctagccatttgttggcaagaaataataattaaattttttattaaaacaaaactttttacattgggagttattaagagcgcctccttttggtgtattcgtttacaaataaaaatgaaatatttatttgcatttttattgtgctttatgttgtttgctttatgttgttctcttgggcttacttccgagttggagatgggaaagtgcccaatgaaagaaatataaaagaatactaattggaagctgaacaattattttgctttataagggaagtcctgcaaagtttgtcatacagtttacgtcactataaaccaaaatacaatccatttcactttccatttgaagacttggaatgtatcatcatctgcgtttctgtcatttcacgtgaattttcttcaggggctgacttcacagcactagaaatcgatacactgacttgccgtttcagcatcctcataacctttctcttataccctttacatgcaaagaagtagataaaagggtccatgcagcaattgaagttcatcaggcatactgtaaagtgcagagaaatctggaacgaatgtctttggctacattccaggaaattagagaaacgaagcttcttaatcatatgttgaataattgcaacatggtaaggtgtgaaacagagaacaaacacaacaataataagaataattgtgttgagagcctttttgtttacaccagatttctcagtgagtgggttttgtttggcagttctgaagagtttgcagcagatctgagaatagcagatgagaatgattataagtggaagtacatatcctatgaaacatgccccaagcagaatccagggaagagatttagtttcttcaaagtttggatactccatgcatgtaatcctttcagcctcctgctttgacatagggttgatgaggagtgggagtgtctgagcaaatactagaatccagacaaatatgcacacgccttttgcatgttcaatcctttttatcttgttgtagcgtagagggtgcaccacagcaatgaagcggtcaatactcaggcaggtcataaagttcacacctgcatatgtgttgatgtaaaacactagcgcagttatcctacacaaggcatctccgattctccagtcaaagcccattgcatagtaggctattcgtgtaggcaaagcggtggtaaaaagtatatcagaaatcaccaaatttgttgaatagagggtggtagagttgatttttttcctgttttgaacaatgacgaccaaggctagtaagtttcccacgagcccaatgatgaagacgaggctgtaatgcagaggcattactatcctggccgtgctgtgatgtgcatagaggtcacagtcatttccctgaggagttgcagagggcggagtaaaattgtttgccatttgtatatccattggtggtggtccaggtgtctagaaaaaaaccaagaaggatcatataagtaaaagcatatgtattcagtttgattactcattagttttaaaaaagtttaaataatgtatcaaagcaatccaaactgtcttttatatatctaagttttaaaatttcatgacatgcaatttttaacagtttataattataatatggttacatatatgataacaggaagaacagaataaaatttgtgtttttactctcacaatttgctgactttggcaaagctctggcaaaggaaacagaaccatttaaatagggcaaacgcacttttgtgacagaagggaatgcactaaatttttaggcagaaattccccttcccttttttgaatcattgtctggttaagtaaagcaccccacatttcagacaggcattaagctttgcttttaaatttaatttcagttggatttttttttaaccaaatgcatatcactgccaggaaatgaaatcagtcaccacatttatgtagtgaaatatgaacttaccacagtgatctgatttgtgttaacctaaaagtctgagaaataggcttagtccatgttaggaactgaaagttagattttctttttaaaaagaagaagacgacgaccgcaacaaccatgactaaaatgacaaaaaaagaagaaagataaagaaaatgagagagaaaaagacttaagctacttcaaggggaaattattaaattttaaaactctatcaatctgcaagtactccatggatccatgcaatctatacttctacctttgcacatagtagcaagcatcacactttatattttgtttcttgctttattcaccaaacatcttcatgtcagtgcaatgtatatatttgtcgtgtatattttatataaacatttgatagatattctacagtcttccaatgtgtcaatgcataatttgcttagctactcccttgatgaacttttggattctttccaattcttttcttgttataaataatgttaaagcagaaattttaagtactaaattgaaaaatggaaaactcctacaataaagttctgtagatgagggtaaactttgattaaagcaggaagaacagagcaataaatcctgtgtgattatttttaaaagaaaaataattcctctgatagaactgtgtgtacataaatctcacctggaagtcaccaaaattaaggggcactttcagcatatctagtgatgttgctactgtatatttaaagaactatacagtatttccttaaagactatctctaccctgatcaaaagcactgtctgcaaatctgcttctctccctgctgtattaaatgacttggatctcagctaacttcattctaacaaccttaaaactgagatgttcatagacactgagggttagcagaggattgtggtcatgttatgttagaggtatgcattctgtacagtgttgataggttagtcattataacctaaatggaaataaaacctaaagcaaaagagagcaaaaatggaaataaaacattttattatccagaaaagagacaatgggaaaaaaacaaagaatgaggatggtaagtagaaaacacaagagggtagggatgtgtcacaacaaacttaaatgggttgagcttgcctattacaggacagagactatcggtttagattaaaaaaaaaaaaattccagctgtttgctgcttagaagagatacagctcaaagtgataaagaaaggttgagaataaaggcaagagaaaatacataccaggcaaatcccaaccaataaaaaggtagtatggcagtattaacatcagaaaaaatagaattcaaggcaaattcaatattaataggaatacagagggtcactgcaaaggttaaaaagaacagtctacaaagaatataaaaataatcatgaaatttgcatgtaacagcaaaatttgacggaatttgaaggagaaattggcaaattcacaaccatggtgggagatcttaacacatttctattatgatgtgctagatagaaaagagattaaagacttatttactcaacatgatttaaaagctaacagaacttgtactgaagacacatgagcatatatgcaaatttgaccatgtgctaggtcaccagaagactcaaagctttcagaaaatagttattttctgatcacattgcttgactacagtgcagctaaattataaaccaatgataaaaagataaaggataagtttggaaatgaaaaaatacacttctaaggaactcatgggttaaagaagaaatcacagtggaaatttcgaaatgcttagaactaaatgatgaaagtactacctgtgaaaactgtgggatgcagataaggcaatctgagatagatataaagccttgaatgcatttatttaaaaaaggaaagatttaaaatatatgttaaatatacagttcaagaagctagaaaagaactgtttgtccaaagcaagtggaagaaaacaatagagataactgcagaaattaatgaaatataaaagacaataaatatcagttttacattttgtgcaggaaaaaaaatggagtggttcttaaatagaaaatcatagggatttcattgtggaataaaagtagaaaaagatttttccatttagttgggaaaggcttcatgtgaaaagcagcttttcaggaactaggactagacacaagagagaggtgaaaattccaggcaagggttgcagctttggaataggcaacaataacttttattaatatttttctaagttctttgaaaatgtatttttttctaagttctttgaaaatgtatttttttccaaaaatctaaatgtatatttttgagtatttctaagcagattcatgggaattgcctttaaaatacatggcaggaaaaaaatacttcactgtagagtctgcaaatcctccatatgaataattattattgtagaaattaggaaagtaacacttatgtgacactcagaggtgccattgcttgccagtttgtatacaaatgcgtgtctgactgcatcaccaaataagatgcagcatctagcagagccagagattgcaggagtttcagaaaaaagttcaagaatgttttacatagtttataaacagttcaaatatccttcattaggggattaaatattttatggcatagccatacagtagaatacaggaatacagccatgcagtgaatacagtgcagctctgaaaatggcaacatgaaaatgcctgtttcttgactgggaattatgttaagtgaggaaagcagattatacaacatgccacttttttgggaggtagggaagcaaatacacacacacacgcacacacacacacagaaagatgtctgtatgccaaaacataattttgtatgagtaattttggggctttactcatatattctagatttttaatgctgaacgtttctattcagaatgttcatttctagtcagtgactggaatgaataaataggtaaaaaaaattttaatgggaaaaaattttagttccccttttcttgtaaaaaccttgttatctgacatgcttttcaaagcttgctgttcagtgttcctttttcagatttctgcattgacttactagttgtgtacctttgcattgtgtcatcatgtagaaacctcacagcagccctatgagcttgagcattgctaccccttatctacttcgcaggtgataaaactgacaataaatatcaattttatattttgcacaggaaaaaaattggagtggttcttaaaagccacgctgggcttaaatgccatgctagatccctctctgtgatgacctggcttcaggtttcttcctctgttcagtccttagcacaggcagctgtttcatgctgcccttaaagaactgagggcttgtggtttcaaagtggtctaggctctaagggccatcctcaactatatcatggcacatgcgcaacattgcccagctgctccagagcaaagggacaactccttctaagggcagggggtgcccacttccaggagaggtgccttcccaaatgggaagccacttgtggccacacatcattgagctccaagggtagcctgttgagggtccttaactgacgaccgttgtgcactggaggtggccaaagaaaggcatttgcagaatgtggacgtgtaagtgggatggcttggaaatgatcttaggtaaaggtaaatgcatgctttggatatttggatgtttagtaacctcttgaaggatgattccgctagctggccctaatatgtcactttagttcttgcttatatttatcctgtgttattaatgtggtagttttagccaattttatgatcccaaattgagaggaaaatcctttcatatgcgtgactgttactatcccattcttatatcagccagtcccaatttattataatcttcccttagagatattactttatatcttcctttaatcatcttaaggattcctttctgaaacttgaattaagtccattctttcattcagcaggaaaatggtttttagtgcctccatgtgctagatgctgggaatacagagatggtacctttttgtattagagggtctggaactgaagggtgaatatatagcgttgaacatgtgctgttatctgagtgaggtgttcctcaggattttttcacatgcatagcagtatgtgctgggttcctcctcatacacagcagtactctgctcactttgtgcattacagtgcaccagtgtcaatatttggatagtatagttatcttttaattattttcaggtagaaaatttattcttaagtatattttaagtattttacattttaattattaggcagcagcttctgacatgttatttaagatatatttatataaactaaggtatactagaaagtattatcatttatcattgtattgcctagggaaaagcccaaagaaatgttagttctaaatcttttttctttagaacactaatatcagaattatagcttcctcataatgcattctaatgaaaagatgcacgtggcccctcagccgtccttcgtgctgcccacactgagggacaggagtcaggacagaggcctttccctggagggcatggataatgactgggccacaggaagcctggatccttattcaggttccacctgtggaacagggccctgtcggccttcaaggctcctgtaccttctgctgggagccaccctggaagccatctatgccattctcttatttttattggtaaacaaaggagacaatcccagttttgcctctgtaatgcagtacttggtccttttaactttactgttatcctaacatgtgtaaaacagtaagtttcttcctcagcaaaatatcttccaaagtatttttacttatgctttgagaagtgagcctgtgtgtttttttctctagaatgtatttcattgctaatagagttgctaacacttcttgagatattatcatctcatttttgcataaccggacatgttgacatgaactgacaggttctttctagccgcaaaaggaaaaaaaaataaaaggccccccaaaactcatttatttagcatctaagaaaatccctagatacccacttggagggatttgtgatttttcacagaggacatgtaccttccatggtcctaatttactcgttcaagtaattaaagtgttttcttagcctttaatttgggcagaaacagaacaaaacctttaccatattcggggatttagttggtgctagaataacagcttttggtttttgctgaaatgtcacctttgccctctaatatttatttattttaataatcatcaacaccttgaatgaaaaggggcttacctaggaattctgtttaattgtagccactagcaatgactggaatgggtcaagttgtgctgagatgatcaccaattggaggtgacttctctgtaggtcaagtcttctctagagtcagcttatacagagaggtgacctaaatcaatgtgcccacagtggatgtaccaaagaggaacttccagaagctcactttcaaaaacagccaggggagccacccagatgcagccacacagatactaattatatgtgtatattgttaagtgaggagtgtttgatctgatacactgtccttggctactttgaggaaaggttaagactgaggaaaaatttctggagcagggagaaataaaatcattggaaaggagggggaagatgaaagctcagggttaattgaaatttcaaagatatggttctactgaggaaataaagataagcacagatgtatcaggatggcaagctggggctgtttcagctcccttgagaacaaacctgctccagggaagaaagaaatcattcattacttcttcctctggttacctggtttgataagtatttgtcaattatttgaaaacgccttcttgttcaaacaggggcatctaaatttggcccagtgtcacacatactgggtcctagcattcaactagtgatttttctcatcacctttttcattgactaaacagccatcatctgagggattatgggtgttgtttgcctgtaaaatggacagtgggaaacatgcattcctggtgtgcaagaggaacctgcactgctgtggagctgtgaccagcatagtcagagcctcctggtgcttcattagtaaagtcaaattgtccattctattaataatacgctgctaaccaactgtcacagtagtcagtacatgcctctgtggcctggttaaatacatctttgtacactgtaaggtgactttttcccagccaactttgagtcctaaattgatagctatgtttatgtccatgattcattttttagaaggattgagaacaatgatattcagcatagagttgactgtggtccgtctgtttgggggacctcccctgcctcctgggggcttgctttctggcttatggagtgtgactagccgaggggcttagtagaggcagccttattgaggagctctgtgaccagcctgccaaccccattgcatatcctgggtcagaccagctcccaatagatctgcgaaaggccatttataggaccaagtacagagaacttcttcaagacagaaaaagacagaaaaacatcttcaagactgaaaaagggtttagcagtctactgtttcctctttgtgctttatatgtgtcctgaacccagtggatgtgcagcaaagacccacttcggcttcatagacgcgctccttggaaatgatggaaaggtgcttgagcacgggaattctttggttgaacacccacttgcacatttggggtttcacatattctagttattttctttcacctttcactggtaaaagccacctatgtggcttttggtggcttttatattgaaaagtatggaagttattgaagatgaagatgacatatgtttagagaactaagaaactaagaatcccaccataatactcattttagtgtaagaaagatattctgtgtttgtatctggcatgatttgtaggatgcagcatgtgggaaaactgcataatataaaaaggctctttataatgaagctctgtgtctataatatttctcctctgagtcctgaatgtttctggaaataatatgtaccttttctctttcaagttcaaggagtttcaattttgtttttgtctcttatcagatggaaattagggaggaacattaaatatcattattttatggataaactgaattccaggtcaactcggtcattcgctcagggatcttactgtggtactcaaggcaggggtcgtgaaggcgcccaggactccgtgttctccctcacctgctgcctctggtcagcgagcagtccctgtgcctcagccttgtgctctgctgcacatccgtgtctgtctgtctgcctgttgtgtgccattcccgcccttctgcccgcagccacggcagcagcttcccgccaggctctcaaacggggcccatccaaccccaggcaaaccacaagctctgtgtcatgacacacaagttccctcatgatctgagctccattccttcttcaggagggttgctggtcagcttcccctgatcgtggcctggctccaggcatgcaaaattacttagaacctttggatatcccacgttccctcacaactctgtgcccggtaacattcttccctctgtttgatgtcctctggcccctatcctgtatccttagctcttactttccttcaagccttagttctaagtatcccaggagcattcctgttctccatcctctgaaaggcagtgtgggtgtatttgtgagagtgctgtgctctgtcatagtgtctgcatcattgattttcttccctgtctcccatgagcctgtgaagtactgtgagtggggaccctatggtgttaatttcttgtatctctaggtgatgtatgatcgatattcaataaatacccattagttaaagaatagcaacattgcagctttcttaatccttaatgaaaggttctttattacaccccagtaagcccttgatgaataataatcaattaaaattactaagcagagactgtgttccaggcactgccctgggcactctatgtgtgtttactcattgaatcctctcagaactttcacaagtccattgacagaaggtgaaacggaggcaccagggcacttaagtgaccaaagacctagctgttaaatgttaggattcagacccaggcagtttggcttcagaagtcacattcagtacaatacattttatctcctatttccgacgtgatctgctattatgggtagaaaacaagtaaaataggaaggcatctcaaaaccttaacgtacactaactcatacctatctgaacaagagagactaggagaactgggggaagggaatgggagcagggaggaagagatgttgattcaaatgaaggagtttattagtttatttgtagcatattttaaagtaagtaaaggttttataaatggatttagagtactgttttaacagtattttaataataaaacaatttagactgaaatttcgattgaaaaaagatggtgaatatctagaataggcttttatgctgttaattgatttttaaactactttttagatatttgcagagatttaacaaaatatttttattcttctctttgggcttccaaaacaccacagccatctgtgttactgtcacagctttcagaggattctcacatgtgttatctcattttatacaatgcccagacttcttgagaaggtgataaaccccccagactggagaacaccacgcgtcctctacacaggccacgtccagggctgcctaacaactccagcaggtcttaaccatagcagagagaaaagtatccctgtaaacggctttattaggtgcgaagctcttttaaatgtaagcttcttgaggatgatgacttgatctcatccaacattttatcctatagaatgctacagaaccaacctacaatagatatctagtaaatatctatagaataaataaatgaattaaagtcatatagaaacctgagttaatatttattccattaactgactggtcatggtactaattagctctaggaagccagatgaaagtaatttatgcaagggatcattaccattgtcactaacgcgatacataaacatgtgagtgaacattttgtggagtagcatattctttgtggttttatgtccaaaaagtgcagtgaacccgcagagagaaaacatgctaaaatataagaagtgtgcagtcctaccagtaagcacagttagatgtgtgatcatccatagactcagggccatttatttatttatttatttatctatcgagacagagtctcgcatggtcgcccaggctagagtgcagtggcgcaatctcggctcactgcaacctccgcctcccaggttcaagggattctcctgcctcaccctcttgagtagctgggattataggtgagtgccaccgtgcctggctaacttttatatttttagtagagatggggtttcaccatgttggccaggctggtctcgaactcctgatctcaggtgatccgcctgcctcggcctcccaaagtgctgggattacaggagtgagccaccacacccagcctgattcagggtctttatgtaaaatatccataacatatctgttggattcaccctctggtacgtcagtggccagagagatgggagaagaatgatgggagacagttttttagcacttataatgagaggcaatgttgtaaggacttggcagtagtaatactccccattttacaggtaaagcagctgaagccagatattaggtaacttgtgtgtgggggggccacacagcttgtaaatttcatttgatcctgatttcagagcccttgctcttattacactatattgtactcagagtgacaccaaaaaaacaaaataccacgcccccctcccccaacacacacacaaacacacatatataaaaccctcactgccctttaaaggaagtctcttcacagcttctattttgccaagtttctgttaccaccattcccaacctggacataaatgttgccaaagcactgcatagaattcattgtgattttttcccctcaggcacatagaaaagatacgtttagtctaagtaaacacaagtataaaccacacaacagacttttttttcacttatctaattagtagtatttagcatttaaaaagcaaagattggtactctttgctggcgggagggtaaattggtaaaatgtttttgtagaccaaaaagtaccgttttatatctaaagctttagaaaatataccctttgccctaggaattctacccctgagattctatcctgagaaataatcttatatttctaataattcctatagcataggaatattctatattaaaataactttgttccttttccttcatactaagttatcctgaaatattggcattatttgcatagttttgcttgatactgtcttttgtcattgtgagtttatacagtagtacatgaagtgagccctattttttgacaaagatatttctggtggacccatcgctttcagtcaactttataagaactaactagacctaccagtcagcagagagagtaaacttacattattaatataatttttgttagaagtgatggtagcttgttcttaaatagattgttttcctttttaccttttaccttaaaacttaggcttttaaagtttttctttaaaaagtttgttgaaaaagcaaaagatcttgtacttacatatcagtgactcgttcgggtctctgtgtagtagctgtgagtagttgtccaaactgaagtaagttttaactgtggcatgttgttttaagagaggctgtgcagacctccttttatggtggtgactttttttttctctgtcaccctgtgactgagcatgtaatgagcagttagcctcgtgtacgtgtgtgcactttgtgtttttttttgttttaaatgggaagtgaaattttttatagtgattaaaaaaaactatccaaaagccccttggaatttatgaattgttgatatctgtggaactttataaatttttctgtaaaggtttaagtatcaaaaaattctttgaaagagactgaagcaataaaccttaaccaaaaaaaagaccaagttactgatgattttatattgattttgcatgtaaaagtatgggtttttaaatgttttaaggaaaatagtgtcaactttgacagtgctttttacctggaaacttggtatcagggagtagtttacacattccaccttatccacagcttatgagaaagaaacaggtttctgtggcgtgggggtgagtgacagtccaggatgtggagtggactggattagtcgccgttttcagtcgagaggctgcctgagtcagaggctgtgtgagtacttgaataacagggaaacagttgaagggaggcccattatagataaaatccagcctcttcagcacagggtgaaagagactcatgccattcacctcatagttgtagttgactcagtttaaaccaactaacgtgtctgtcagaatgcagtttatttgtaggctaaattaccagatatgtagcactcagatcaggagaggtgatgtttacacttagtcaggactgatctggccattcccagccacttctgggtgctgctttttacgaagacatagataacacctgtggcagtgaggggcctggatagcaggtcttaggagaactgattaaataagctggggatgtgtatgctttgtaggcatagggtcattatccttatgcttgtggaaactctcatagaaaagtgtttacattgcttgtgtcagtcttcctaactccagagactagcgggagggtcagtaagaagttactggacatagcttttggatcaaaagatgagagtcattcccaaaagttgtgattattttgaaaaatggaatatgctgtttcttatttagatgcttgagtaaacttgatgattttgagggatgatgtaaacagaattgaatcatttggtaggaatttgtaactctgtgatctcagaagcctttctgctccaggattctgtaaaaatagtcgagtagcttttgcctcccacagatgtcattaggttcttctaacgtctaaagtgctgtgagtatggaggaacattgtcagacacaagaaagagcatcaagcaagtcagctgaattctttgggccgccacctcactgtgtataaaataaaggtattgaactaaatgatctccaaggtaattcctagtacaaaaattctatgagggggtaatacagagattttatgacttggtggataaacatgacatcatattctagaactagttcatttaaaacttaggctgcagagtacttgaagaagacactgttgataaatttttcagtttgttgaaagaccattctggtggggttttgcctgttaattttgaaatagttatattaagtaaaacatttttatatagtgaaggactcagctagttcaagtaattcctctgacaaactggatctgtcctcccaaccttcttttttttttttgagacagagtctcgctctcaccaggctggagtgcaggggtgtgctgtcggctcactgcaacctccacctcccggcttcaagcaattctcctgcctcagcctcccgagtagctgggactacaggcatatgccaccatgcccagctaatttttgtatttttagtagagacaaggtttcaccatgttggccaggatggtctcaatctcttgacctcatgatctgcctgcattggcctcccaaagtgctgggattacaggtgtgagccaccgtgcccagccccttttttttgatatcagagtagtcaggcagatgaagaagaggtgatggggtcattatcctgtaagaggccgctgaagctgtatattagatcatttcatgagctcacaaaccttgtttttattgctgttgaaagttaccagggtttcttgagttgtgattgtactgtaaaagtagagttggcctttacagtttttttgtttgtttgtttggagacagggtctcactctgttgcccaggctggagtgcagtggcacgatcttggctcactgcaacctctgcctcctgggctcaagtgatcctcccacctcagcttcctaagtagctggggctacaggcacatgccaccacgcccagctaatttttgtatttttttgtgtgtgtgtgtggagacaaggtctcattatgttgcccaggctggtctcaaactcctgacctcaagccatctgcccaccttggcttcccaaagtgctgggattacaggtatgagccaccacatccagtgaccttttctatagaagaagtgaaatggacatttgcaaccttaacaaggtgtctctgttattttatgttttctatcgagtgcgatcatgaatatatagcagtagatgctcagtaaatattagtgattttaaaggatgaattagcaatggctcacgcctgtaatctcagcaattcagaaggctgaggcaggaggattgcctgatgccaggagtctgagatcactgtggggaacacagcgagaccctgtttctaaaaaaagtttaaaaattagccaggtgtggtggcacacaccagtagtccctgttactctggaggctgaggcgagaagattgcttgagcctaggaattagaggctacagtgagccgtgattatgccactgcactctactccagcctgggtgactgacagataccggtgtctcaagaaaaaaagaaaggatggatgaaatgtttataacctgctttctcttttctgtgctaccagcctcatctgcttaagccagaaagggcttccagaaggtagttcttcacagtatgaaaaaggtcaaactgaattactgttgacagtatagagaacagatgttgtcataaaataaggaaaagaaaaagactggtcagtgactaataacattatggtattttgtgaagtctgtgtgtgtagaaatagcaacggaaaatttctgcagaacagcccatataattttggtctgaaatgtgtatgtgtggcctagtatttagtcatcatttaaaattatacagtgattaatatttttaaaggagtttttaaacttctattggtatgtgaaatgtaaactgtggtcattaaaatttctaccagtattttttttagtttacgttgaaatgtaacctcaaaaaagaactctgctttaggttatttagttataacatcactatttgtactttattactaaatgtaaacagaagaacttctatgaattaagcgcctccaagggcatgttctgtggtaagagacctctggtgcgattggctccccaaatagggttctataatcaccaagagagcaggccatattttgagctacatatgaaaccatgtgttttaatcccattaaaaatgataaaaaggaagggggctttttaaaacaaaaggcaagttctgctgtatggttttactgttttaaaggaaaattcatttcttctgcaaatatttattgaaaccttactctatgccaggcacaattctagacagtgggaataaaacaaaacagaccaaaatccccatctatgtgaagcttccattctacttttaagatagataggcagtgatgagaaggctgtaagtgctgtgggggaggacagtcaggaagagagtagagaatgcagagggggaaggctgtgagggcgggaggtgcggtttgaaatggggcagtcagggaggacctctctgagaaggtgctgtcctgcggagcacaggatcagaatggggatggagattcagggcctgggacgtctttgtcatgactgtaggtggggaggcattggaagatttatgcccaggagtgactaactcatacttttccatgaaaagaaggcccagctgttttaatcagttgtgcttgggtttataattggacaaaagcagttcttctgtgtagtatttaaaaactgctttgttaattttaaaaaatccaaccaatattgaatatggatcatgtataagaatctgcatttggcaaacctagataaaatatgatgctttctctcagaattaataatctaatgggaggtttttgagaactctgtatagtcaattcaaatgtgagtcatacagttgttctagaataaggattattttgtggccctaaatgtagtgagctcctaaactgtgccaagcattgtgccaggtgctaggagaaccaggactgcctcttcttccctgtcctggggtgctcagcctgggaagaaggactgatacgtgaggaattctagactgggcaagtgggggtaggaacccgctgtgccgtgcacctccgtctgccacccagtccctgccatccttctcactggatggctagccaggtgtatctcacatctctgtgtccccagtcctgacacagtgcctgcacttaggccttactggctggagttttccctgttctagcatttgctgcgtttgtgttgatagcagttgatgcggctgccatttatcacatttgttttgtgtgtgttgtattttggtttggttttgtttttaacagtagaattgagaggacagtgcattttttaaaataacgtagtctctatcaaggatgagaaattgcgcaagaggccaggagggtcctgtgtttccacaaaaatggcaccaaggacagttctttgtagaagtgaaacatatgttttgcatttttctcgtgataatgaaataattcttttttttctggtgccattttcccaaaagtgggaaaataaaacacagactgagtaattaagccaagtgtttaatggaaaacaggtgcaagcttgtgcccaaaccactctactcattcatattacctgcctagcacttgtaggaatgtaagatttccgtcctgtgatgagttccttgaggtcaaggactgcttctttctcttggacgtagttgtagctcctgtgctgggcatcttaccgtgacatccttggcacgcatttgattcactgattcattgcagtggtgaaactgacatagcttgggggccacgaggagagccaccagctgccaggaggagtcagagaagtcttgtgggaagagctgagcagtgttgcacaagctgagtttcctaggcaggaaagtggaaagcagaacctgcgtcagtggagagtcaaagcagccagcgtgttcagggagcagctgtgtggatttttgagagggccttgtgtgtgttgggccagatgaggggaagcagagaggaggacagtggtggcagactccagtgatgaaagcgaactggggagctttgccatcacatctttatgaagcattttatctttggatactggagcctatggaaggaagggtttttttgttttgttttttatttttttttgtttttgtttgtttgtttgttttttgagacggagtctcgctctgtcgcccaggctggagtgcagtggcgcgatcttggctcactgcaagctctgcctcctggattcacgccattctcctgcctcagcctcccgagtagtagctgggactacaggtgcccaccaccaagcccggctaattttatgtatttttagtagagacggggtttcaccgtgttagccaggatggtctccatctcctgacctcatgatccgcccgcctcggcctcccaaagtgctgggattacaggcgtgagacactacgcccggccggaaggaagggtttttaagcaagggagtgttgtgatcagagttgtattttaggaagagagtactgccaacaatgttaagaaatggattagagagaagcaagactgtaagtagaaagacacataagacttttgaatctgtcaaggtgaaggtgtcaaattgacattcagaaccaggtgaggggtgggcaggcagttttaggtctcacttcattttcttagcccaagctatagaaagggttgagattgtatgaggagatgagagagcaagaagaaaaggctataatggaaccatggagaagccagaagagtggtgtaagaaatcactgggcaaccactgagaagcagggtttcagacaaagggaggaaggaatgtgaggaagggagggccagaggtgaaccgtgccagtgccatggcgacagatcactggacagggcttgagatgaggcttttggatttgactgaagaattctaatgtttgctgctttcgatttgtctagtttctctcattagattttagtaatacctgggaagaaaacatagcctccacttttctcacacttagtaggtgctgaaccacttctttgcagtggtttcaggagggtcaataaggatagaatgattagagttttcataaagtgttctataagtacaaattattttggacatgaatcatatttgaaaatcaatatgtatatctaagaccatgctttcagactgaaataaaattataagcagtgttacttcaaagatacatctgccatttgtgtttaaaattcactattatagtgatttttttttatttgtttgcatagcctggcacctgtgtttgctctgtttgtaccattttactgctccataccaagagtccaagtggcacaaattctgggtccgttgtccatcacaaacaagacattgatttatatattgggactgcaggtacagtatgcatttttatgttcacttttctttaaccagatcttttttttttttttttttggtctttttctcatttgatctccttgaaaacaatggtttttttccccccataatcttggcttcatgatctatatcaaatgtttaaaggaagtgttacagaacaagaacatcaaggtatagaagatactagaatactttcatagtctttagaaatctgataagagctttcactgtaatttgtatctgtggaaaatattttcatttcattgtacaattgcatgtgcgtactttttaacaatcatagtatgaagtggaaacaaatgagaacaatcaaaaagtagaaagtagaaaatcagtgtcaaaattaatttattgaatacagtgtcgcaaataaagctctgaagaagaaacccggtgtgctctaccaacccgagctttggggttttcaagaagcattgtcagcttgattatttccttgtttgtgaagctgtgatggtagcgtcaccatttgctaaatggtttgctgtgaagactactagagtactactgtccaggttacatttgaaaagcttctttgccaatcctcagcgaatgtcaattgctccctgctgggctccaggtctgtggtaggagaatgattttcagttttctatctgtactacctgtcacttttcttttactctcacggcttttgatgtagttttattctacagcttcctgtgtcaccatgtgtcgcttggccttttgatccactgattaatactcataacattccttatcccacgcactctaaccggatactggcgtcacttcagaatgccttcctccctccccttttaacctttagcatttcctctcacttctccagtctgctgtcatgtgttatcaatggctcatctggggcgttttcttaccacttttacaaccgtttctcatgaaatctttttattctccatctctcaacccccgtaccgttacacgccccctgatcctacctgatatccatgtaaccaaatagcccgtttctgcatttgattcttatgagtaggatttgctatagcagatttaatatttttaaagttgttgtgacagaggccatgtggaattcgaagagcactccagacctccctcaggagacccaagttctagtcctagcatggctgtctccagccatgagacttgggttgagtcatggaaaccctctgagcctcacattcactgtatagttcttccaactctaaagctatgtagaatctttgagaatgaaaacactgttttattaattgtggagtaggagttcagtgtggcattgtggaaagtctttggagccaggttgttgaatttcggtttaatgacttggtctggtaatgatttgctttgtcacttactttttctgagcccccatttccccatctatcaaatggggatgataatatctaccttacagaggtattttaaagatagcatgaagtgtttagtgtaatctgaacagataataagagttaagtcaattggttactattaattaataatttatatctctatagctaccactattcatttttctgagattgtaaatgtatttcttgttttgtttttggcataaagcaagtagtatgtttcatctctcggggaaagggggtcttagttggatgaagaggcacagcatggccttcatcacggggccattgtagtaggttggtgcaaaagtaattgcggtttttgccattaaagtaaggcaaaaactgcagttacttttccaccaacctaatatctagtgccgtttccacagtgttacacagctcaccatgagggatcccccttagccctgccgaaagcagaaaggtagatgcaactaccacggatagtttttcaaaataatataaatttccaatatttttgtaatatttccggtaactttgagagggagaagttgagatcagaaaatagaggtggagatgcctcattgcctccttgataaaatctaggtccttagcatgaatggcatgcagggttcttcttgactgtctggtgtcaactccccctgtgcccaccttgaaggagtgtaactgaactcctttgtgctaaaatgtctgtcctccacctgcctccctcccctccaagcctttgcatgtgtttctgtgcctttgtctctccccactacaaccagggacattgttgaatgaatgaatgaatggatgaatgaatgaatgaatgaatgaagacttgaatcataatcggaagagccaaaatgcttaaggctcatttaagtatccaatgacttgagagcccataacatcatgccctgtgcaatgggctatgacgttgtgggctctcaagccatccaatacttaaatcagtatcacccactgggtgagatgtagcccctgtcctcaaggagcccagccatgagaaaacacacagatactgtgaagacataggcagacataatggggaccacacaggcaatgagaggcttcagaacccagaggaaattactttttcaatgacaaaatgatacgctctttttacttgcgtatgagacctggaagagtggagagcatggctgtagagccagtcctggatacactccagcccaccacctgctagctgttgacctgtggcaaattgcttaaccactcggttttactgaagtgccttgagagcaatgcctgacacatagaaagtgttagctagtctgttattctttctatttttagaagaaaattacagcaaaatatttgtctacatggttccatccttattattatcagagtcatttccactgaacaaacgtccgtgctacatcaaaggttcagatttaaagttgcagcctgtgctcatttctaactgagcctatcactagagcaaagcttgccagcctctttatctgagtgtgtcaactcttaccttttgtgtctgtcttctttctgtgtgtccttggtaagtgtgcagaactttgaggttttcatctagcacaatgccagcgatgaacctgggctgtcctgcctgagtatcctgcctcttcttccacaatcagaagtaaacccccaatctgaagttctaaaaattaaccaacaataacccacaaatcatttctttgttgcaggaacactttcagagtccttatgatttttttttaattaccctgagcacaactctaagatataaacgatttggaaaacaaagggaagaatttcatgagatctaattctaattacttttgccattaattaactttgttctgttatttagtttgctcttccttgggtgaactagaatgagaatatcaacacttgagaaagttaccattggacatagacctaagtaggctggcagggttcttcccatctaaatttagggtgacaatgttaagaaattaaaatgagaaagttatttacataaatatcacatcattgccaagcatgggatggtgattacctgttttgtatgttgttaattctaataatttctttatatgtagtattttactttaagtcagttgaaatttgtaaataacatcatacttgggtttcatttatttttctttgcatggggtgtgggccaggttcaacttgttttaggctatacaaagtctgatgtctgaataaaaaaaattaatatataattttcttttaagtaacagttgatatttactaattttccatttgcttctctgtattatggcatatataattaatactttatataaatggtcatgactatagttatgtaaaaataagtgtgctgtgactggcagttgaattttatttttagttgccttttttttttcttttatagcttttcacctctggttcctacatctggattgtagccataagtggacttgtaagtgtgactacccttttacacccaattctctctctctcctgtaaaaacattaggaaaattgtcctatttagattgtgcgtcatattcaactgtctcaccattctttttttttgagacagaatttcactcttgttgcccaggctggagtgcaatggctcgatctcagctcaccacaacctctgcctcccggattcgagtgattctcctgccttagcctccagagtagctgggattacaggtgtgtgccaccacgcctggataattttgtatttttagtagagatggggtttctccatgttggtcaggctggtctcaaactcctgacctcaggtgttctgcccgcctcagcctcccaaagtgctgggattacaggcatgagccgctgcacccggctctcaacattcttttaacccatggcaggtctggctcaatgttacttctgtggtgattaaaaagggccagtcacggccaggcgcagtgactcacgcctgtaatcccagcactctgggaggctgaggcgggcagatcatgaggtcaggagatcgagaccatcctggctgacatgatgaaaccccatctctgctaaaaatacagaaaaatttgctgggcgtggtggcaggcgcctgtagtcccagctactcaggaggctgaggcaggagaatggcgtggaacccgagaggtggagcttgcagtgagccgaggtggcgccattgctctccagcctgggcgacagagtgagactccatctcaaaaaaaaaaaaaaaaaaaaggccagtcacagggaaaattgagacaaaggaggccagtttgtgctttcaaggtaattttgatgaaagttttagctgggcttgtcagtgttgtttttaaatcatagaaaaaaaaaaagcctgaaaatgaagaagttggacttactaaaaataaggagagatagtctgctcattttgtaaaaagacattgtcacacgagggaaaaaaataatgccaactggaaagtcaggtgggttggacctgaccaaagtctcatcatggaagaagggaatgaaccaagcaacctcagtatgtttgctggaattttttcatcttgtctatgctattgtattttaataataagcgtttgtcctaaattctctgtgaggtattaaaaaaaattagagcatgaagtggagttttattcttcatccatgacttaaatttaaacctccagatttataaaaataaattttaactagcggttatagagcatagattttatttctttcttagaaaagacttaaatgacagaatggattcataataatacacatttcactgcaatcactgtacacatttcaaataaattatcactatccttgtttcttgggtgaatgactggtatttggggctagtgtgtcatcctgtacgcctgcttacccctcttcttcctttaagctctctgtattattccttttctgtgttcattctttgcttaaaattcacgcctttgttccccacagctgatatgcttgcagccaatattctggggctccaagtcactttgttttctcctccctaaaaattttcacatctacccagatacctgatttggcttcaggaccacagagctaaaccctattgtgaagtcttcaaaacacctaagctatccgtctggtattcttgagacttgtggtggcttagggccatcctggggttagactgattctctgggacacaggtgccagactcccccaagtctaggctcacccagttagaactgttgcgtgactgaggaagacttaaccagcctgagaacagcaaagaaggagctcattgctttgatcatgagagatgcctgaggatgtactgtttgttccatggcatatttgtttcacttagcagtaatggttttgagttctgttttaaatattttccaaaagcattcaaatattgaagtaccttattgtatacgatttcattgtgttagttactattaattcttttactctccatatttgtccccttccttagtaactcttatgtgactcagttttttaaaacacattccattttctttctttattctttttttagactcctagctttaagtgcctgctgtctcctcagaaagttgcattgtgtgacattcagtgcactaaaattggaggttgcatttttcatctctttatagtctttttaaaatctaaaattatatgttatgattatagtcttttccggtacacatgtttaacaggtagtggggtacctgttttaactttttaaaaggaatcagacgtttaaaataaaattcttgaccaaaaaaaatcccttgtttcagaagggtgaatagaattacagtgtgtttggaatataattcaaagataatgtagcattttaaagaaccctactaataataaacatttctgagccttttacagtcattgattcagccaaagttaccggccttctactatgacaaaaaatctgataaatcttcatattaaccttgttctttattactattttaccataattagatgactgtttatttaaaataattaatattcatgaatcatggccagttttcctatgttcctataccataaatgttggtgcttgttttgaacctaaggaacattttctttctttgtctagaaaattctcatttttattatgaaatatttactgtgatgtggcatactttagataaggaagattgtaaaagacaatatcagtattatttgtgagtgtttgatttacacaccactgactataggatccaagcctgagattcacaaagccacagtctgcctattccagatgtctcttgctcaacatgacttcccctcttcctttatagatcaagtgacttccctttttggggagatatttatgctaaataaaatactaacaaaataaaattcttactatgcaaaagaaatgcacagataattataattatagatgatattcagtgttttggggaatgttacaaaacctgttgatgagatttcacattttagtattgaaaccagtaattcacttaaccatgtgtgttaagcaatgattttatttcattctggcaattaatgtggtttttaagaaaaagagtattttttaaacaaagatatttgtatgaaacatgagtaatttgttatttgctgtcatagaaaccaaaaactttactcatgcttttctggaaagctgccaactttggattgagcttattttatttagctaggtactggttgatttattttgtttaggctagcttttttgttttggagacaggctcgctgtgtcactcaggctggagtgtagtggcatgatcttggctcactgcaaccactgcctcccgggttcaagtgattctcgtgcctcagcctcccaagtagctggaattgcaggtgcacgccaccaagcccggctactttttttgtatttttagtagagacgaggtttcaccatgttggccaggctggtctcgaactcctgacgtcaggggatccatctgcctcaaagtgctgggattataggcgtgagccaccgtgtctggcctaggctagtttttaatctctcctcggtgtcccttattcttgcataattatagatgtctttgaatatataactttaaaatattccactgattaaaatagaaggttgataaattatgtcagtacagtattttactaggtaagttgaccactttttatcttcagtgatatcacagaaaataactaaatcatttttctgagttgagggaagacagtttttagcttacaggagcaatagtaagttagtttgcccaggatggctgtcagacctcagtcctattttgttatccagtagagactccagctgctgcccaggaaaggtgagggggattctcttgtacttaaagatgactgtaagattattcacatgtatcattgataaatgtttttgtgttacctttttcctcatttgacagttctgatttttaatgcaaacatttagtatttaaaataggacttttcatgaaatgttgcaaaattgtaattggaaagcttggctattacagccaagtgacatatatcagtttaaacaaatacttcaacatttcagtgaccgtatcaactgttcttctagatgtctggtgagagaccttcaaaaattgaagtcagtctttacatattcataattccactaattttcttacacattaatacttttccttaaagcattgcttacttactgaacttcatttaaattcttcttgtggttctgcagagagcttttgagccatctacatctcagaacttcttcattttctacagttttatgaatcatagtactgagtcattaccacagggatgcaccctaattctcaaaagccgaggtctcaggactgatctgattctggcatgattaaaatagaaagagccttcttttgccaattttctttttacagttcacacatttatctttacttgaccctcttttaagctgtttgagagtgaattaacaggcctatattcctcagacttctcccttcaacgcagcccttcactgtacccatttcctgcattcgttacttgtcatgtacagtatatcagactttgattatctctgatccagcagccttagtgtggaaaaaaaacaatctgttacacccaaaagtaagatttgggacttcaaatgtggtctgagtttggattgttttctgtaaggagtggggatctttaaagcacttcaagaagaaacactttacgatggtgcaagattacagaagccttatcagggttcgtagatcataggacaggggtagggaaaatgagccatctggagggagtcaagacagcgcatttgcgggctgtgatttgcctttctctcttccctctgtagtacttttaaagacaaacaaaaaaacccaaaccactgtcttaaagtaactgtgaacaaatggaaacagcataacctgctgtggaagcataagcatctttagagtatgttttgaggccctggcctgcttctgggcgagggatggtaggtgtgagttcctctgcgccgcctttgcttgtgcccagctctctcttctctccgtgcttccttttctcctatttaaccttttttcccttagattgcttctccattgaccaaagagtggtataggtagcagctcagataactcctctgatgcacaagcctcccagttaaacttactttagagatttggattattttctagtagttcattgaaaatgaggacaggaactgcaaagaaaaatcaaggctaaccagatacagtggctcatgcctggaatcccagcactttgggagactgaggcaggtggatcgcttgagcccaagagttcaacaccagcctggccaacatggcaaaaccctgtttctacaaaaaacaaacaaacaaacaaacaaaaatttcaaggctgaccaaagccatgagggtgatgggacttgtgaaaggaccacatgtagaagttgaagacaagtagcaggttcttaagaagcatccaaatttggagggtgccttataattaaaatagcaagtgtgatgtcagtgcttgtccaatgtacaccccacacacactcacattcacgttgactcatccatatacactcccttttctcctttttcctccctccctctctatgctacctttcccactcctgaccacagggagccaggactaactggaagaagccttctattaatatattcttccttgtggcaattgcaactcaggcccaggatgacaaatggtgtcttaggccattgttaacacagggaggtagcgaccagttgacgtgtgatttttaaatgctcagtgcagaataaatgaaatgatgccattgtcttaataaagctggcagatagaattgccttataaaatttataaaaatagctataaaattttattattgcaacttatgttctacctgtaggcaaaaatctagcctcctttcaaaatgcgacctcctcacctacccctgtcacttctgtgaaccatacactccaactacacacaatccattcccaaacatccactttcaggattctgtatgattgtgcaaacaagtatttttctttaacaaacacacagcacttagtatgtaccagacacttgtggtagattttttactctagtatttttgtttgttcaaatatatttggtcaaaatatgttctgcccctctctactgaagccctccctatagggcctctgcatgccctgttgacatcaggttttgttgtttgacttacactagccactaaaatatgaacagcagtgacaaatgcttcatccaagcagaagcttgaagagccactgcctggttccaccattgctctgtcccctttgccatgagaaaagcagggcccggagaggggcagctcctcagactccagaatgaagaagtcaaatggagcagggctgtaccaacatgtagcatgaacaggaaagaaatctttgttataagctactgaaatttgataatttgttaccacagtataacttagaaaaagctgactaatagtactcttttctaagcactttacaaacattattttaattagccctcataaaaacctgaggaactacggaatattctccctattatagatgaagaaactgaggcacagggaaattaactacagtcatgcactgcgtaacaacgttttgatcaacaacagagtgcgtattcagtggtggccctgtggattctaatggagcataggtagaaacctggtgtatggcactcagtgttggcactgcagatcaagtaggggaaatgactgatattcagtcatggtgccagaacacttgattttctgtatgaaaaaatatatataaatgaaaatatatatcccatctaggtttgtgtaagtacactctgtaatgttcacacgatgaccagatcacataacacatttctcagaatgtgtccttatcattaagcaacacatgactgtaatttgccaagaacaccaggtagctgaaaagtagtggagacaggattcaaatgtaggtagcataactttagtgtctatgctcttttttttttttttttttttttgatacggagtctctcactgtcacccaggctggagtgctgtggcgcgatcttggttcaccgcaagctccacctcccgggttcacaccattctcctgcctcagcctcccaagtagctgggactacaggcgcctgtcaccatgcccagctaatttttttgtgttttttgtagagacggggtttcaccgtgttaggcaggatggtcttgatctcctgacctcgtgatccacccgcctcggcctcccaaattgctgggattacagacatgagccacagtgcccggcctatgtctatgctcttaaaagatagctttgcataaccacatgcagtttcttccaactatatcccctatttcactcacatatcccttcttctaggaagtcttactcatttaagtcctggcccaacccttttcctgagtcagtcctgactttatttatgagagctctcctcttaaatttttaagtgacagtttataattgttgactataggtatggggttgtgcagcgaatctctggagcttatcgctcttgcttaactgaaactttatgcctgttgatttttaactctccttttccctctgcccccagcccctagcaaccaccattttactctctgattctgtgaaattgactatcttatatacctcatataagtggaatcatgcagtatttgtctttccgtgactggcttgtttcacttagcatataggtcctcatgtttcatccatgttgttgcatattacaaaatgcccttctttttgaagggctgaatagtattgcattgtatgcatggaccacattttcttcatccctttgtctgttgatgggcacttaggttgtttccccatgttggctattgcaaataacatggtgatgacatgagagtgccgagacctctttgagatcctgattcatttcttttggatgtatacccaatagtgggattgctggatcatattagttctatttttaattttttgaggaacctccatactgttttccatagttgcatcatttgcatttctgccaactgtgcacaggggttccagttttccccacatcctaaccaacacttgtcttttggtgttttttgtttttttataatagccatcccagcaggtgtgaggtgataccacattgtggttttgatttgcatttccctgatgattagtgacattgagcattttttcatgtacctattggccatttgtatgtcttctttggagaaatgtctgtttaggtccttagcccatttttaaaactaggttattagttttttggtattgaattgtaggagagtccttttagtttataggaattctatgttattcttcataatcttcagtgcctagcacaatgtctacttgatacacattctaaaaataattttttagtttaaaaacttaatattatcaaaaaataatttctgtactataaaacattatactacatgattgtcaggatgcttacaatgtgtactgccttactaggttcttgatgtgttctctatagtggtagaatacctggactgcctattttaaagatagggaggctgagtttcaggttgcatgaatgatgggtggtagaaccaggacaaaggccaggtgttctgctccaggcccagtgagtccagcaccttacactgcacatctcaaggctctcatccatgtctcttccagccacgagatgcacagacacagttattcttaaagtttcccttagccacaccactaggatgaggccccattcatcagcaatggagacatgattctggagggcaatcttgggtatgaagaggttttcaaagtccccagaggccctgaaaaacacaatcgacaactttttgcagccttctgtgtgctgaccaatagccaaggaaaattttttctcattagcagactctattttcttcgtaatatgaagaatgtggcctatagctatgctttctcttctaaaatcatcaagatatttaactggtcctctctccatgcttggttaaaaactcagcttaaacctcaccttcagcaaactcactgtcttgtatttcttgcattgtcatactcaatctgaagtaaagaaacattcagagaaaacttaaaggataatttaaagtatattaggctggtatagtagtgttactgaataaaggaaaaagaagtagagataaggaagaggttgccaagaaacacccgtacttttacattgtagagattactggtagattatcatgtccgttgcaggacagaacattttcccatgggtcttcacattgtctttttatcaggaaattaaaattttttcatcagttttgattatctctttaaactatatgtagttttggtttttggtttttctctctctctctgtgtgtgtgtgtgtgtgtttaagtgtccagtgtttgtcttcggggactgactgtgttgatattttccttctgtcttgatgatagcctctgggaagggactatggtaaaattaacatgtcgttttgaatttatttattatttataaacaacagcataggatgttatcaaaggtcttccatgttagcttatattgatagctgagaacattttcaaagcagcagaagttttttgttgttaaaagcttgtttttgttctgctaaaatcctacctcttataaaatttaaaagatttatgtatctatttgagatctttctagatcttcacattcttttttattaaaagattctttttccctttttttgtttattaagatgttatttacatacaatagaactcaccaattttaagtgtatagttcgttgaactttggtagttatatacagtcatgtactcaccaccataatcaatatggaaagcagtctcctgaccatgaatggtggcttcatgccccatgctctttccccacatccagctgccagccgcaggtaaccactgatcttcatgtaattatagttttgcctttgctggaatttcatatacttagtattgtataatatgaagtattttgtgttttacttctttcacttgaacatgaaaatttcaccaatttttaaaattaatttttcatttattattgtattaagtaacaattaatagattaagtattaatctatagtatggatgcaccatactttgtttatccattcaccaattggtggacatttgagttgcttccaggtttggattattatgaataatgctgctgtgaacatctgtgtacacatttgtgtgtggacatatgttttccttctttaggaacggaattgctgggtcatatggtaagtgtatatttgacattaggaaatactaccatgttattttacaaagtggctctaccattttgcatttccaccatcgatgtttgaaacttccaaattctctacacccttgtcaacacttggtattgtcagttgttttagctttagccgctctattgggtgtgtagtggtatcttgtggttttaatttgcatttctctaatgattagtgatgttgagcattttttttcatgtgcttagtggtcattttcatatcttttgtgaaatatctgttcaaatcttttatccattttgttcattgggctatttatcttctaactgacttaaaataattctttatatattctagatataagctctttgttggacatgttttatgaaaattgtattctaatttgtggcttgtctgttaccaaaaagcaaaattttaaaatcttgattaattcattgttaactggtttttaaaatagtttgtgcttttgatgttctatttaagaaatctttgctaatccaatgtcacaaagattttctcctatatgttcttcaagaatttaatagtttctgctattacatttaggtctgtgatccagtttgagtataattcttttgaggtaaagggtaagatttattcttttccacacagatactcatttgttccattaccagttattgaaaagacccttttctcattgcatgaccttggcaccaaaactcagttgaccagtataggtttatttcttgactcttttctttcccagttatctatatgtctgtccttacgccaataccacactgcactgatgactacagctttatggtaagtcttgcaatcaggcaatataagtcctcccaccttgtttttcttttttaaaactggtttgcttattttaggacactgacttttaatatacactctacaatcagcctgtaatttcttcaaaaaaaggggaaaagagttaagattttgcttgtaattgcgttgaaactttagatcaacttgggaaggattgccatggtgatggtttttaaatgtttccacagattcttttacacatcaagaggtggagcttatttttcctctgctagcatttgagctgtacttggtgatacttataatgaatagaatgtggcaaaaatgatggaatgtgactcccaagagcagatcataaaagacacagctagtcctgtgtctttactctctcctggatctcttgcccttggggagcccatctaccatgccatgaggactcttaagcagacctgtggagaggtccacatggccaacaatcgtggcctcctgccaacagtcagcactaacttgctaggtgtgtttttgagccaccttggaaggttatcctccagtgccagtcaggtcttgagatgagtgcagataggctgacaccttgactgactacagcctcatgagagaccttgagccataaccactcagctaagttactcccacattcctgcccccacagaaattggataatagatgcttattgtttcaagccactgagtcttaggtaatttgttgctcagtaatcaacagctactacaacaatcttaacagtattgagttctccaatgcacgaacgtgataagtctctacgtttatttagctcttctttaattcccctttgcaatttttaaattttcaatgtacaggtcttgcacatctttcattagatgtatttctaagtaattctggtatgttgatgctattataagtggaattggttttataaatgttttcccaattgtttgtcactagtgtgtagaaatacagctgattggctgggtgtggtggctcacagctgtaatcccagcactttgggaggccaaggtgggctgatcatgaggtcaggagttcgagaccagcctgaccaacatggtgaaaccccatctctactaaaaatacaaaaattagccaggcttggtggcggatgcctgtaatcccagctattcaggaggctgaggcaggagaatcgcttgaacctgggacgccgaggttgtagtgagctgagatcatgccactgcactccagcctgggtgacagagtgagacgtcatctcaaaaaaaaaaaaaaaaaagaaatacagttgatttctgtatttcgttcttgtgtcctgcaacttttctaaatgtgtttattatttctggtagcttttctgtggattccttagagttttcaacataggtggtctgtgtcatccagaaataagttttatgtgtttatatgcttcttctttcccaatttgtaccttttatttttctttattatactagctaggacctctaatagaatattaaataaaagtggtgaatggatatccttgcttcttcctggtcttagatggaaaacgttgagtttttcaccattgaggctgtatctataaatccacaaatcttttagagcttcacattcacttttagtttgttatttttcatcaaaggtaagaaatgagtttcaactgaaataagcccatatttttattaatttttcattttttgaatccatttaagaaagtgcatgtaacttttaaaggaggatggtccgcttgttaaaatggatattagaaggtgtttgtttacatataagaacctgatgatggttttctccatgtgctagagactctagttgccttccagtatattttttccttcataagggaaggttcgttttatttgagccagcaatgcctccagctgagatcacgtatctcttatccttcgcctctcagtctgaccactggtctaagtcctggcgtcctggccattgagctgtaaacacacatatttgtgtgacttctgagaaggctccttaaagtcgccttttgtcctttcttattttttttcttctggctgctttgactacagttaagatgtttggagctttttaaatatgaaggtgaaataaacttctcttgtatttaagccactgttgtttgaagttttctacttagcatagttgacctaatcctcctgatgcatgatttcccaaaaggaaaagcctagagcaggtttctaagacagtatgtgagaaacgaataatctgtgattagtgttattacttctgtctctattccaatttggttttccaagaatcagaaggatatccagcattttaattgggtacctcaaaatcttttaatttagtatcatttctattccctcatatgagatagaaaagctatagaaagttcaatctgaatcacttttgcacttaaagaatagcaagtctcagagtaactgccaaaggcacatggttctgtctgtcatgaaaagaataatcttttcaaaatgtatgacaaatggcagaaataactttgggaatccctaatttgcattcacattcttggggtaataaattagggaatgtacaaagttcccttatgctttctctaacattttcattggagaagaaggaataggaaaatgtaagatgcatcagggcagggatttttctgttttgctccttactatgtttcagtgtttagaacataggctggcacgtattagcattgagtaaatatttgtggaatgaataaatgaggtctcggtgggtctggttaccacaggccttgagggcacatgaagtctatgtgctggggctcagttgcaaggggacatttattcctttggctgttccttgtcatgcagaggcaatatcatgcccctgggaaagcagcccctaggtttgtcctgttgtcccagtagatggtcggtttcttgaatgtgggaccggtggttggcacagcttgccttgtgggtttttgttcagccacagttggccaaagaaagcaatcgacacctgtgtgtcattgcaaagtcatagtttctaacctttgcctgttgtggtttcaggctagtactaaacaggaccagaggacagttgaagtttactctctataatcaagagtgttttgcatgttttctacccagcaaattaaattatttgcctgatgagcattatttcatgattcccttcctaaaaggatgaagcatctggaaaatctgaagaaccgtgtaattgacgtccatgtttattagtggactaagagaaaatcatttcctcttgccttacattctcagacttacagggtcacagcttctgctgttggcatatggggggctgctccctctgacctggagccagcgtgggtctttggcctagactctcagctggacgtgggccaggggttctctggttgcgtgaccatgtgtcccctttcctagccagggttcctgcttcctgttgcccaagtgctcaaactccaactcgagcttgtcttcccgggcatatgctctttgttcctttttgctttatctgatcgtcctgcactgaccccttgcctgccggagactgcgccactgctgccttctttttcagtggcccctccgtttgctctttggcttacccaggtctgagggcctgcaagacctccttggtagagttcccccagccccctgacacacaaatccaacatatggtctttttctaaagcctgcttttcagagggtctatggatttcaagaaaactcgctcattcagaagacctagtgtaaaaaaggtttatgagatcatgaaaattaggtcaggcatggtggctcacacctgtaaccccagcacttggggaggccaagatgggaagatcacttgaagccaggagtttgagaccagcctgagcaacatggtgaaaccccgtctctggggggggaagaaagagagagataatgaaaattaaaattaaaaataatgtgtgaatgtaacatagtattataataactgatgctctctaaaagcttttggcagtaattaagtgaaatctaatgtaattatttttgtcccatctttccatagactagggttttaagcactttatattttaatcctttgtgaaaatctaaaacattgtgcagtagcactttatttgacaacttgaggtcatgctggcgtgccagtgacatggacaagtgaactctttatcttttatcatatgggaaagtataaacttgggaccaaaaagaatgcataactttccaatttcctttaaaaggatctaagataatgtatttatttttgtggagcatttgttaattcaccattcacccaggaaatacttacagtactatgtgccagacactgttctaagtgcagaggccaagtagtgatcaaaagcaacccaaatcttccccattcagagtttacatttagatagatgggatagaaatgtaagcagatgaacacaaaagccctacttccctgccagaatttgcagtcctatttttgtttattactgggtggggtatccatattcttcacagaatggtcctgctgaaattgaatacatagttttgtgagtgtatactcacgtctgattgtcattgtgggggcagggaaggcatggacaggagagtgaagatctttaaccttcctcagtttcttaagggagtctgtggcctcccccccataaattaagagcttctaccaaattgtgaactccttaaatactggcaaaaactatgcattttcattatatttttcttaatttatttaaaaacctgatttaaaaaaaattagcaacaagatcttgctccgtcacccaggctggatgcattggtgcaatcatagctcactacaacctcgaattcttgggtcaagtgaccctcccacatcagccttccaagtatctgggactacaggcatgcaccaccatgcccagctaattctttttatttattcttattttttttttagagatgggggtcttgctctgttgcccaggctggtcttgaactcctggcctctagtgatcctcctgcttcagcctcctaacatgctgggattacaggcgtgagcacagaaaaaccaacattgtattgttgagcttttaaggtatataggtgtaaaatatgacagaagtaacgcagtggatgggaagacattacatggaactgtagtaagtcttaaccttgtcagtaggttcttggaaattccaactttaagcaaaacatcattcaaataatgtcatttcattcaacgtcttttcattacagcattgaggagacaaaattatactttgtttcagttaaagttggagtttccaagaacctatcagtgagttaagtgaggacttactgtagggtcttgcaagcttctcctgttttacatgaagtaattcagtattaactccaaatatattatgctcaattttgaatgcatattataacctctagggcaaatatgagggggaaaatacagtgatatatagctgaaaaaaaccaaaatactaaataatatttgatagcacaaaagaacgtaggaaagggggagtaaagagtaagaaacagatgagacagacagaaaccaaattgcaaaatccagctattcaagcaaatacattaagtatgaataatagctaaacactccaatcaaaaggtagagattgtcagactaatttaaaagaaaaaaaattgctatatggtatctacaagacacactttaaatacaaagacacaaaaaaagcctgaaattaaaaggatgaagatatattatggagacagtaaccataagaaagctgaaatggctgttttaagattagacaaagtagacttctctatgagtattactaaaaacacagcagaatgctttgttatgacgaaagggtcagttgtgtttgtgtgcctaataacagcgtccacaaacaggaacagcttctagatatatgaagttaaaatagctaatgggagcaatgaacaaatcaacaatcacagttgaatactttgagaccgaaaaataaaaatgtttaattttgtacttcattcaaatctcacagctctaatttgtactacatttttaatattttgttatgtttataacattttgctatcttctgctgaatcagcgtaatgctgatatacaccctattttctgttttatatcagatcttcagaaaaggcatttctacttccttgcctccaattcattactgtttttttttttccatattgacttcatatgtctctcttcattaaaaatatatatttgttacagagaatgcctctgcctaccccctaccctgtcccccatcacccctctacagcaaagactgctttctgtgattctgtagttaccgcagacagatgtgtgcacaaacggcatagactattattttgttgtctgaaattttgcaggaagatgagcgcaacatgtgataccttctatgtgtatttttcattccactttaaacacatcagtacacgcacatggagttcatctggatggctgtatagtactgtgttgtatgaataacccactctgcagctgttcccctcttggggatgatttgtttctgcttcctctctctctcatgcagggctgcagtggaatgagcctcaaagctctacttggtgttgccacattgctccccagaggcgccatagcttcaccttccctcgggactgtgtgagagttctcagttccctccatccttaccaaaacctcacacctggaatcccagcacttagggaggcagaggcaggaggatcgcttgagcccaggagttcaagacctgcctggcaacatggcaacacctcattctccacaaaatggaaaaaaaaaaaaaagagataaaactggatgttagaggagctttacatttttgccagttgctgtatttaagattgctcattttagatttcagagtcctaaaaacaagtgaggataaacatcttttcatgagtttgtcagccatttgagttttctcttctgaaattaccttttcatatgcttttaaaactgggctctttcttacacattcctagggtttcttgatatgttctgaatgctgccttggttggctgtatgaattctgaatactttcttcaggcctcttgtgttttcatttcatttatggtagcttttggcatactacagcttttaaattgtaaagtagaccagtgtgtgttttcttttctagtttgtaccttatgtttcttaatttaaaatattttgccaccccagtgccaaaaaggtattccttctgtattttgtgcagaaagatttacaatttcatgaattctatttgagttcttattccattgcaagtttacgtttggtgtcaggaaggggccctgttctgtctcttccttgtgtatagcccatgtgccccttccctcccaatttacccatgtctgctgaataccaggtgcccttacactgaggatcctatttctaggctcttgttctcttggtctatttaagtaaccctagataaagaccacactgttttaggtagccaaactttatagtatgtcttgaaatctgataggacttacgtttctttaaaattgccttgccttttctgggttttttatttctttgtcttttaactcttaattgtgatatacaacacaaactaactgtcacaaagccttgcaaatcactataaagcaaatatacccataatccaccatgcaggtacagaccatgcctggccagccccgcagcccatggtgccccccttccttcccacctctcttcctccttcccacctccctcctgtgaccccttccccttctttctccctcccttctgtgacccctcctagcacacatagtcatcatctttgcgctttcctgtctcgttttactgcttagtgtgtggtttaggttcattcattcacagaagtggaatcgtgttttcaggctttgggtctggcttctttctcccaacatggtgtttttaaaatgcaaaccttaaatattccgcatgaatttgaggcttggcatttacattccaacaaaacaccctgttaagattttattttgaatgatatttaatttatgtattaatttgatgaaaattggtatcttaaaagttttgcatcttcctattcatggaactggtatctttattatcactagggttggttttgaaaaaatatcccttattatctttttcttttttttctgtcaaggccttatatatatattatttatttattcccaattatcttacagtttttcttgctgttatttgctaacagtttattttttctttctaaacagtctgtattttatccctggttgcttttaaggatttctttcttttgtttcaccacagtggatctagatgtaaatttcgttttagcattcttttagggactcttgccctttcatcctaaggatttatattctttctttattctagaaaactctcagctgtttatctctttaaatataatatcctttcccccatattccctctgttgtcttcttctggaacccctatgctgacagccgcatgagatgcacataatctgcctgtgcagaggccttggccttcccaacccacatggaccctccttggttcatgccctacacagcttttcccttctctctgtggaggggagaaagggtacatggagcatgaggaggaactggggtgcctcttacccagacttaagtaaccctctacttctctcctccttccacagggcctagaccctctagtccaggggtatctagtcttttgaactcttctgtgacacattggaagaagaattgtcttgggccacacataatatacactaacactgaagatagctgatgagctttaaaaaaattgcaaaaaaatctcctaactttttttctttttttcttttttttttttttttttttttttttttgagacagagtctcactgtgtcgcccaggctggagtgcagcggcacaatctcgacttactgtaacctccaccacccaggttcaagcgattcttgtgcttcagcctcctgagtagctgggaccacaggtgtgtgccaccacgcccggctaatttttgtatttttagtagagacgggtttttaccatgttggccaggctggtctcaaactcctgacctcttgtgatccgcccgccttggcctcccaaagtgcagggatgacaggtgtgagccactgcgcccaaccttgtaatgttttaagaaagtttatgaatttgtgttggaccacattgaaagctgtcctgggccacatgtggcccacaggcctcaggttgaacaagcttgctctagtccctgtgcttttctgagtcccacaggactctctgcaggcatttggacttatatgctgcttatatgcagagtggtttataatcacttgataagctttctattttgttagcatggttcaggattagtttctggtttcatggaccttggagtttgtttctgttttcattttctttgtcttgtactatttttgagtaaaggggcacagaaattatttgaaaccagaagttgtccaccattcactcttcagcctactacagtctgtctttggtaccaaaactgttcttgtaaacaccttgtttatcaaacacctccatttgcaacatccagtggctagttctgtcttacttatcagctgcattagatatagctgaccatccctattttaaaacacttcttagcttcagtgataactaaactctatttcccttctcttcactggcagccctgtctcagatttccttactggcgtttcctactctgtctgtccatagaatatttgtgcactcctggattcagtccttagtcctgttctctcttctgctgtgtctcctcctcccccccattttatctcctctagtcctgttaccctaaatgtcatatcatatccagtgactctgaaatccttatctcgaccttttccttgagttctagaattacatagccacctgcccactcagtagccccccaagatatctaatagacactcccaagctcgggctgcgcagcatctgctgctttctctgcccaaaatgttatttccccagttcatcaagtcacgggcaccgcatcatccttaagatcttcgctcaagtatcactttctctgagggctctcctgatgtcccccgctgcccccagagtaggttcgtgccccatgtcactttatttccttcccagaacttgccagaaatagttttatgtgttgacttgattactgcctgttctccacattgactgctataagccctgtgagagtggggccttgcttatcttgttctttgctgtattctaagttcccagaacagtgcctggtgtgtagcacagtctcaaagaattcttgccaattcatcaatttaaattttatttttaaacattgaagtatacttttctcatattagaaagttgtcaaatatgttctaatctgatcttctaatcctaagaatcaaattcacatcaagatttttttttttttacaaaggaatagccatagtcatttttaactagaaaatcataggaagccttgagacttctgtaaccatacattataaatgaccttcaagatgaagacaaggttggtttataaatggaactaatattggtgaggattttaaatgtctagaaaaatcagtagttgaaaaactgattaaaacactatgtaaataaaaaccaagattttagattgtgtttattctctgataaattgatcgtgtgactgggtcagctgagacatggcagttgttttctgctggtgtctctgtgatggccatctgccaacaaaggtaaccgcagagtcagtacagtgtgaaagtgtttcaataatcagatcttttacggctttttaaaaaatgaagacagtgtcttgacaatcttttaccagaactttgaatactaaatgattagaattttgctagctcttctaattcaataaaaaacaattttgttttactaagttcaattttgtgttgatttgcactgcttagtgttctgcagtgtggtagaggattttgcttattgcctaacactgctatgactaagaaaaataccgtgtgcagtgtctggaggctgctgatttttgagtcgtgtacattttttaaaataatactacatttaaacaatcacattggacgtttttcttctagatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcaggtaaaagtgataataatcactaaaaatttagaaattctcagtggcccaagcaaatctttcctctgtgattgcatgtgagatagagactacattttattccagtgccttgcaagtggattttgacatttccaaagagattgtaggtctctgttagtggccattcttagttttttaaaaaggtaaaaaataaattgcagctgaaagattggtcaaactggacattcttgttccacctatattagataagcatgacttcttagagaaacaccaacctagttaacaagatgtgctatttatctgtttttataatcttgtaaaagccacagtgtcttcctgttaaaatgctaatcatatgctatggagtgaagaacaaatgtaaaatttcttgattttccttggttgaaatgaagagaatatgaaggcaagaagattttcagtggaacaaccaaggagtagataaaaaaaaatgctgtgttttctcaaccttgctatcaataatcagaaattattgcacatttgtctacaaattctgcatccaaacaatctgatactacatttgtcttccatgggcagtgagagaaggagggttagtgcacatcaggctaaaacctcaggcctgatctttcttggacacttctgtgagccagcccacagggctccccatttttcgcctccaccttctttacccctggggtagttgtaaaccgtacagttacctctgccatctctctgtcttccactagcattggatgcaagaagtaggtctgcagatctcacgatggtttggagaagtgaaatcaggtttgaggtccttagagtcccattggagatgcaggtcccagagtttatatcagggggggggaggaagggggcagcttattaggggcagagtctacaagagaaatagagaagcaaaagttgtttcttaaagatgtgcttgaatttgagtgactctggaacatgccataaagatgcccatggtgtatttaaagctggaggatggacatctctgtcttggaaatgtggaagctacatatatatataggtgatggagtcacctctgtagggatgagagctgagagccgaaagcaaagaagtagtaagttctgtaagagaagagctacatccaagatgaacacaggctacagatgaagcctcgtatttagcaggaggtaaatccttcaaggaaactgagagaagagcgaaaggtatgagaaatcagaatgatcaaggtcagaaaaactgagtagtgattgagtataaaggtagaggcacagagcttatgagggagagaaagaagtaggggatggttctgatgtttctggcctagataatcttagatagatgactgatagttccatttcaccaatatcaaaagagcagatttgggggaaatatgttgtctgagatacctttggaatcctgggaggagattctccattggagagctttgaatttgtcctcataagcaaaccagagaagttgcatttctcagattggcctccccaggaagatttttatacaaagagtttatgagagaacaccgtcagcatcagtatctatgggggcgggctggcgaaggcagcaagatgggacagagggagcagctgcagttccagcaaaagcctcgctggtcttatggagcacagtgaagctgggagagcccttctgagttgtcccaaaatggggaccagtcctgttgggtaagtcccatgcgtacgacctctttgaaccttaattacctccttaaagttcctacctttaaatacagtcacatcgtagggttagggcttcagcgtgtgaatttggggcaggggcaaggggtgggagacagtgtgttccataacactgcagagtggaaagggcccagcatagtctcggcgctgagtgactgttctgcttgcagacggtagttatcaggcacacacagtctctgtggatgccaggttggatgctccatagtggcaggagataggtcggcctaggtgagggggacccacacattcctctgtgctaccaccatggccatccattcgtgtgccagcgctgggttatctggtgatggagccacagtcattctgtccaccttccatttggtgccttttctgtggtggatgcccgtggtgggcacgacctgcaagacacttgatgctgttcctttagctggatcctccttgttccctcccttccagtcccctgaccgaccaaccaggtgatctgccatgcccagcagatccacacgtgtaattgcctcaggccacttctcttcacacagagttgatgaccaaatgtgctgcccaggctctgcccatagggggttcccctgatcgctgtctttcaagattgagccatcatgcagccgtttctttcagctgccactcatgtcctgagccagcctgtccatttggctgttttcccctctgtcacttggtcatgaggggcccaccagctgtggtagtcggtgttagctgggaagaggctgtggtgcagcagaggtggctgccagggtggtctggcatgcctgcttctgcagctcacccatgccctgcagccccacctatgctgagcccagatgcccgtgtccatctgatgatgggtttctgtcggcccacctggcttggtaacttggtgggtctccactgctgaccacatgctcactttgtggcctacagacaggcacttcatggtgcagcagcagtttatgcaagtgggattcttggctgtttgcgcacgccctcgctccaggattctacggacccccattgtggttctcctttcctgccttgctgtaaactccgcacggtgtctttccccccagatacttggaacatcacgggatctgccaggttgtacccaggcctcagggaatgagacagacccaaacccctgccctgctggagcgtgcattcccaccaggcgcctgtgaagtggcacaggcctttatggctgtctacactgctgtcagactcctccactttcataggatggtctcactaacagatctgaagtccagagcaggacaccagcccctgggctcttgctgggcttttacgttgagtggtctgctgggcagcacagaccagactcttgattttttcctaagcttcctaagttctcttctagggtccgcacatgggtacacccaaacctgagcacttagcctcctgctgaacttcttcactcagctgtgtctcagttttcttcacataagtatgataaatcaccacgtagagaactcttttgttaaaccaccactggaaattatctgccgtatttgtgtgcatgcacgagtaccgtacagggtgcagttgtattggaatgtaataccaggagaaaagtttattttcatttacttttcaacaaataagtacttagtgcttattatatggtaggcctagagctggacattgaggacacaggtgtaaaaaagatagcccccagtcctttttcttatggagcttaggtcctgtctctcttgcagaattagcatgtttcactctttatcagtaagaagaccaccaccatttattttgccagtcctatagtaagtactcagtatatgttatctcatttatgcccggtgtacgcctagagagatgcaggtattccctcatgaccccggaggctcaggggagtgcttgcttgtccaggggcatgcagctgttgatggggatctgggagtgagacccagctgtgtctgactctgaggtctctgtttctgatccctaactcatatacctcccaatatgagagctccttggtgatttgttttcccccttttcactttggctggcaggaaactcagtgccaggcttcaggtttaattagggttaagttagaacttttgcttccatcttcttctttatgtttcaaatacatgtttttgttgtttgctcctgtatcttttattgtaggcaatctcatgctgtgtatttcatttaaaatacaactgttatttatttaaaaacttgatttttagatgcttttcatagaatctgagtttatttagtcagaaagtcattttttttcagttactaactgctgtatgttacacatgatctgtctgcagtttttcatttcaggtattccaaaataacactcaagtcttgattcagtgttgtatttctttagatttctcttgcctgcttatgccagagttcatcctgccatctggcaggtgctcgctgccaccccctgccacgtgctcctcgtgtggctctgggggcacagttagacagttagactgcttgggaagctctctgaccaatactggtggcttcgctgtgggcacaaaataaatgaagaacatgtcctttccctccgtgagtttgtggccaacttcagggagctcaggcagttgtagctgaaatagatgagcatccaagaaacaaggaaatatttactgaagcacccatgcagtgaaaatctgaggagagagccactggtgtggactgatgctgccaaaaaagatttcaggaagtagaaggacgggtggaatttggatgggtggagagggtaaggcacatcattccagaggagaggaccagcaagagtgaggcatggaggtgctaatgagaccttaaaaaggagagacctccaggagccctgtgattgacatgtgggcagatatgtagtgagaaatgggaaatgatatagtaactgataatggagggaggtagtttaagcctgacaatagatttcggcttggacattggctgtgaaaaattgtttattcagtaacaaagataggacagttatctcagaaaaatgtcattttattgcacagtgtaagatggacgggggaaaggagaaaccacagaggaggagacaaatagaaggaggtttctaaagcccggctctcagaggagtgccttggctgggctgatgctgtactctggatcgagctctccttcctctgttcactccctaaataggttgtttcccaagactcagttctctgcctactgagcttttcacgttagacacccaaggggacccacccagcccctgtcctcaccactttattgagctcatggctcccatgagtccctcaagatctagagactggacctccctctctcctggggctccagaccgaaatatcctactgcctatagtacatctccacttcactgtcccatcagctcttgacaggtactgtttctttttttctttctttttttttttttttttttgagacagagtcttgctctgttgcccaggctggagtgcagtggcgtgatcttggctcactgcaacctctgtctcctggcttcaagcaattctcctgcctcagcctcccgagtagctgggattacaggcgctcaccaccacatccggctaatttttgtatttttagtaaagacggggtttcaccatgttggccaggctggtcttgaacccctgacctcatgatccacttgccttggcctcccaaagtgctgggattacaggcgtgagccaccgcacacagccgacatgtactgtttctttgctaaatttgtttccctttctcactccctacctgatgaaaagcacccattgtttacccgaaagtccaaacctagggtttcaccccagacatttcccacttatacatccatgtccttcctgccttccccaccagttcagccccaaagagtctccctccttgatgtaagtccgtcattcatctccagtgctgtagttcaggccaccggcgccatttgcctggatttcttccctcccatctccatcaccgactgcctccctcctgagcctgccccacagcctccaccagtgatctctgtgaaaacagaaatctgcttgtttcactccagctatcatccttcagggcctctccatagctttcagggtggttccaacacaaggctcctgcctgctatgtggccgcatctcctttctgctgccgtgtgcaagcccttaggccagccatgcctcaccgggttactcacagttaactgctgctcatattgtttcacgcagtctcacctttacatcttccctttcctctctgcccagaatgaacttccctgtaccaaccccttcaccccacccctcccacatacacatcattttcacttgtctagctgctatttactcggcattcctgacaaatatcgcctcctcagggaggccttccccagcttcctggggggctcccagggctctctctgcccctgtagacactgcctgtctctcgtggcaccgcaaacccgatgttcactggtgatttactgccctttctccaccagtgtgtctccggatggagcagacttgttttctgtatatctccagtgtgtgaataatgcctggcagatgttaggaactgtgggaattaatgagcaaatatgagcataataaatagatacagaaagactttaagcaagctgaacacagatgaataatcagggctggaaacatctacagaggttgagtgcagtggttcacgcctgtaatcccagcactttgggaagcccaggcgggcagattgcttgagcccaggagtttgagaccagcttgggccacatggtgagacccccatctctatttaaagaaaaaaaaagatctacggatactcttgagagaacagtagaaagcaagacccatgtctagagagtgcaaagagggaaaaaaaagaacccccagggaccaaggagaaaaccagttcagtggccagggagcctgcggagtagaatgtttcaggaagagtaggtgtttcaggaacagattcagacgttactatccccgggcgcccccccccccccccaggaaaaaaaaggcaagtgaagatgatactggaagaccaccactggattcagcagaatgagttcacttttgaaaggggcttcggtggagagatggggatgagaagcgctgcatgagctggaagtgggggaaggtcaatatcactctgttctgactggctgccctcattctgggacatcactgtggtcacgctggtccccgttcaagttactttcactctgtgagaaagtcaatatgatcttatgctcctgaagcatttttagtccactgtgtggcatattcccattccacagctctgatgaacagtgaccagggtgatggctctatagatctcacttcaactgagacatgagacctaggtgctgacaggggcagggtacagtggtcccatgctcatcattaagcacaggcatgtgataacgtcatctagtgtgctttgacctcctacagatctttctggacatttcccgccagcactgactatccagaggcctttggaggcttgtctcatgggcctgtggcagtgaagatggagtgggctgcagagtattagctgcagcctgtggtgcccacttcttatctccctccacatccacagctgtcccattcttttgtaaactcgggacactatgctggacacacataagctgctctcagtagttccttgcccgctgactcactcttgtctcccagcagagctgccttctccaaagcaggtggcatctcagagtcattttgctacttgcagctgtgatcatctttacactgccagggccattacataacttttcatgggtttgtgttttgttcatccccagtagaatatgagctcttggaggacaggagctgttgtacttctttgtcttttggctctaatgcagtgtactgccctgagggattaaataagacgccgcctgcgccttcaagaagtttgcagccagcgaggggaagacatgaggctgtactaggcactaggtttctacaggagtctgtgcaaagagaagaaaaaagaaccctgagcctaaacagtgggtgtggccagttctccctaagggatacagcgagggtaatcttgaggccagcattggggcaggtgtttcagtcacggggggccttatgaaaaaacgcacaggggctcaaaacagctgtggggacagcaaggaattgcattcgcctgagattgaggttcctataagaaagaggcaatgaaagacatggttgggaagagagcagaggccaggacgggtcttctaccaaactaagaattgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtgcctgtagtcccagctactcaggaggctgagatggaacgatcacttgatccctggaggtcaaggtgcaatcacggctcaaaaagaaaaagaaaagaaaaggtgacactagaggaagaagaccaggtgggagacagtgaaaattctgtgtgctcaggatattgttggtgatgagctagagcatgcttagctcatcacagtgaaggacgagggcaggctttgcagagcctccttgtcttcagacctccagatcaattactggagtctcctgtagtaatgatcatccgaatggtgcctgtgcaacctgagtctccacagcttcacggtgcatgtctccctccctttgctcgctgtagcaaagaagctctgtgtgctgtgatgagaaagatgtatctgttctctaccactggcccctgacacacagcacctaaagcccttggaatctccacagtgagcatagggtccagccctacagggcttagcaggtgttctccccatgtgcggagatgagattgtaataaataaagacacaagacaaagagataaagagaaaacagctgggcccgagggaccactgccatcaagatgcggagaccagtagtggccctgaacggctgggtgcgctgatatttattgcatacaagaccgggggtcagggtaaggagggtgaatcttctaagtgattgacaaggtgaagcaagtcacgtaatcacaggacaggggggcccttccctcttaggtagccgaagctgagagagagaaggcaccatacgtcagcgttttcttctatgcacttataagaaagatcaaagactttaagacttttactatttcttctactgctatctactacgaacttcaaagaggaaccaggagtacgggaggaacatgaaagtggacaaggagcgtgaccgttgaagcacagcatcacagggaggggtttaggacttcggatgactgcgggcagactgggataatatccagcctcccacaagaaggtggtggagcagagtgttccctgactcctccaatgaaaggagactccctttcgcggtctgctaagtaatgggtgtcttcgcagacactggcattaccgcttgaccaaggagccctcatgccggcgtgacagagggctcacctcttgccttctaggtcacttctcacaatgtcccttcagcacctgaccctatgcccgccggttattcctaggttatattagtaatgcaacaaagagtaatattaaaagctaatgattcatgatgtttataatgattgataatgtccatgatcatctctatatctaatttgtattatgactactcttactctattttcttttttatactgaaacagttgtgccttcagtttcttacctcggcacctaggtaatccttcgcccacagtgagaagtgtcttttcacatggatgactgatgtccaggctctcctggatagcctcagatgggggctggttaccaggggaactaataagtgattagagggttgagactttcagccccacccccaacctctgtgattagggagaggggttgagttgatcaccaatggccagtgatataatcaattatatctacataatgaagcttccataaaacccccaaaggacagggtttagagaacttccagattgctgaatgtgtgctggagcagggtgcagggggtgccagagaggggcaggggccatgccccatgccttgccctgtgcatctcttccatctgactgttcatctgtatcccttgcaatatcctttctaataaatgggtagatgtcagtgtttccctgagttctgtgagccatcctagcaaattaactgaacccaaggagtggaccacgggaaccctcatttatagcacgttggttagaaccgcaggttaggtctggcgattgccatctgaagtaggggagcagtcttgtgggagtgggcccttaacctgtgggctctgatgttatctcctgggagacagtgtggggattgagttaaattataggacaccctgctggtgtccactggagcactgcttggggtatgaagccccccagcacatctggtgtcagaatattgtgttgagtcgtgtgtgagtgtagaaaggaagaaaacagtgttgtttttcttcagagccatgctcacaatagaaagcagcgtaatataatgaaaagaacaagaatgggcagttagggactcaatcctgggttgacagggacatctatacacaatctgtagaatactgttgtcattggggataaaaaaaattatacaaaattaccttaggtaccagaggctctatcagatattagttattatcatagtattgggcatctgtttttgtggctctcaggaagtttgagagagtcctaatttaggagccaaccttgatagttattactcgtaaaagcttgtaacctctagagcaacagtcagcaggtgatggcctgtgggccaaactacctgtttttgtacaatctgaagctaggaacaggttttacattttaaatggttatataggtaactacatagtatctttgatctcttgcctctttatcttccaaacctaaaatgtttaccacctggccctttacagaaaaatatttgccagtccctgctgtagaaggttatatagccagcagctttcaaagtaaccttttacctggaaatgtgaattctctcttagttctggtcatctgttatttgtgggagccaatcctctctctgttggctgatgatgagaattctgttatataccacaacacaaacttggggataaaactttccattaggcatttctgtaaaatttccatctattttagaagcagaactaaggtgaagcccagtgtgaatgaatcctgcttgttggtacaagccaagtgggacatttggcagcaaagcccaggagtccttggtgctcttcttttaactgcctcctcatctcattgggctgcccggtgttaactggttgattatcacctctgtgttttgcctgcaaggaaagaagctactgacacccagagtggctcagcgatactcacacgtgctttcagttactttcgcagcatttggttaaagtgagtttagctgcacatcctcacttggtaacattctgtggctgtgaaaattgtttctctctttatcctcccccagcaacagccatttggtatcatctgagatgtgcaccaggaggcagatctgccctgtcaatcatgagagttcctatcattaatcaagtattttgaattcaataactttttttagtgttttaaaagtatttactggtccttgatgtattttttagcagctgatggaattcacataccatataactcaccccctcgaagtgtacagttcggtggtttttagtattttttaattgcacaaataccgtaatttgagaacatttttcatcaccccaaaagaaactgcgccccattagcagtcattcccatccgccctgtcctaggcagccacttaatctactttctgtctctgtagacttgcttattctggacattttatagaaatggaagcatatgtagctgatctttatgactggcttctttcgctgagcttcacgtttctgaggttgacgcatgttgcagcatggttgattttccctctgtggtttagatagcaagatctgcctagtagagctttatgtgtgcaagtgccactccaccagaccagtttctgtcactgccccttcatcaggccagcttccttaggaagcttcctgttgcctcttggcctcaccagtgctaccattttcattaccgtctattccgcagaatacacgcagtgccaggctctggtgagtcccacagtgaccaaggcagcacgatccctcctctccctgagcttagagtagaaagcgtcagttacagtgaaatgtgatggtcactcttctgggagaaatgtgtagtgcagtcaggaagagtcaagaaattgtgtctggaggcagcaccgtcggaaactctctacctccgtctccacccctgtgtccggggtaggggcagtgcacgtgtgttgcaaaggagtccaccaggaatccaaagggagcgaattctcatgtgtcccgagcatcctcagagacagcaagctggcacgtggcaccctcctcagcacttttcctttttggctatgctctttcactttttggtgcaatttgatttgaaaacgattcttttcaagttgctatgcttccttgtcaacaaagcagtctaatcagttaaagctagttcttttatgactttcttctttcaagagtttataagtatatagcatcagatgtggaataagttactagtgcttagttgataaaaatctgcaaattaaatgaaaattacttgcaagaactctattttcagtgaagttacagctacgctgtttatctcaatctgtacctccttgcagaagctactgctgtgtttccagtgcttttgtagttgatcatactgatctttttgacaaaattcagaacagaaagataggatcaatctaaagtgtgatccttttccaagactgactcattaagtgaccttgagaaaatcatttctattttccatcctgccttggtgtcttcatgagaaaaaagagcgaggtacagtctcatgatacctcagaaaacaagcaaatgatgatgatgtacttggctttttgaagatgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaagccatcctgatgggttttcaaaaccagaaaaaagctcttaatgaggaacagaccactggagtacccatgagcatctcaggaaaactgagaccctcgagaagccttgatttcgtgcaacccccaaggtttcagagccagcagcccagtgctgtggttgacagacgtggttttgtggagaaagcagccagaggccaggaattttcagagtcgtgagtcacgatctcccacccaagattagagcacagattagccatactgagatttggtaaaatcattctgtctaagcaatggaggtgtgtgcacacgtgcagtgcctgttcacaggggatgcaggcagatcgtgggtttaggatgggggaggccaccgcaccccccttcactgctctgcacctgctccctcacgtggacactgtccacaactgtggctctcacaggacagttgcccaaggagctcatatcttattggagatagggggttgtacaggtgacattcatgagcagtgtgagccgggtgacatgggggtgtcaacccagcatctgtccaggagctcctcctgcagcggctctggcaggtggcctgaggctcctttttgagagagaactgtttggccttccagatgttctttaatataatgattgggaagagacagctcataactagcttaaggctatctagtccagctttccattttacagctggggaaacccagactcagggttttattctctgttcacttggcggcttggctgagttctgtggaagttcagcagagcaggggaacaggagggtttgggttgcagagaaagaagccacttacagatgggaaacaggagttgggccctatgcaaatggaagggaccagggagggcactttaggtggcagggacagtttgagccgacatagtaatttaggatgtaatttagagaagtaatttacgatggggctggtttgggcagacctgcaaaacaggacagactcagacaggatgcccgagggtttttggttgaggcagtgtcattgtgaaagggcttcttgtgcacactcactgaccgtggcatgcagattggattggggaaatcttactggcagtcatgtcatccaagaagttgttggcataatctcggagtgcaacagcaaggacctaaacgggcagatcctctcccaggggaaaatcagtagtccttcagcgttggctgggtttgatggacagaggagagctgagtccagacatgagctgggaagtggacatccgcctgccacggtgaacgcagataggcaagtgcgggaatgagactcaggtggtcactgaagacatgaaaatggatgaactctccacggaggaaatgtaagaagaggggaaaccttgagtaatccccagtctcatttttaattaggagtttcacctctgtttctgtcaaaacatttactgtaacaagtaccaaaactaattttaattttgacttttactttataatttgtgtgtagagccaatgctgggaaggaaaaaatgaccccaaatttggcagacaaaagaatgaaggaagggaaaacagaatatacgatgcagaaatggataatccacactctgagagatgcacttccattcttatgtcttcaaggccactgtctcagtcctcgctgtgtggcccttaccgtcaccagcgttcagtgcttacaggtgtgtcactcagtcgagggagtgaggaagctgcaagacaaggccttggcatgctcttcctgcgctgatgtccctgacctgcagctgggctgtgggctgtggaaccctgtggtccccccacgccaccctctcaccaccacctcctcctcacagagcagccttagcattctcattctctaccaaaaccaaaaccaaaccaaaacacaggaaaaggttgggacacctctggtcctgacggtccctggaggaaaagttccccatgaggagtgatgggtcagtcacgttttcaaaacaaacgagagccaggacgcaggcctgtggctcagcccgcagcgtgcttggtgccacaagcccccccgcagctgcccagagtctcaccccactctgtgcagggggcctggagggcagcggcggcacagacccactggacgccctggtgcatggctgagccatgtgcatcccatggctctctccagagtcccttccctgcacctccagggcctccccagatggaactggctgggagccgtgctttgttgaaacaaagggaaaacctgtctctcttgggtttgcagctgctgttgaaaccaactgaacctgtttgtaaaattgtacctatgtcacagtaagatcagctgtgctaggtatgtcaggcctctgaaaagaaatgtcattaaagtaaacaagacttgggacacatgtctgtcagactgtacacagtagaagcatcccttgcaggggctgttgggttgcatcctaagctgtgctggagcttcccgatgtactctgtagatgtctttgcaccttctgtcctcattgccatccccaatcagtccctggaacaccagctgtggccctgacccttttagcccctgcatggaatgcacaggcaaggcgtgtggcctttgggactccagccgactagagcaagacagaggaagaagagacggggcagagggcagccgatagttggaaacttctgtcccctaagccaaaaggttctcaaaactgagcaacaggatgtattgtgtctcctgatcgtattgccatggaaactgccttctgttctgcctagaagaaatagtactgtttgaagtatctcatccatcaacactggtcactgtgagaaaccacaaaggaaaagtgaaaccgagagctgcaaaactagcctgggactttgttcaagcgatcatctcctttccctctagtttattattttttccaatacctactgagactactgctaagcagcacagaaagatacaatacactgtttttatagcacgacacaaagatcatgggtggcacttcacatgacagggttagattcagtcttctgagttttctaaggttcctatttttaagactttaccaaggaaccaaggctttcaaatatgcagcatggtttcttctgggcctcgcgttgccccatctcttatccaagtggtgaatgtgttgccagtttgtgtgtggttctggtggtgggctttgtttggttttctttttttgggctttgtttggtttttccccagttttgccacaaagcttttgctgaggacagcagcctctgtggtgtcttttctctctgtattgtgctcactcttgtagtcatgcaccacataacaatatgttttggtcaatgacagattgcatgtatgacagtggtctcataagattatgatgccatatttttgctatgtcttttctatgtttagatacacaactaccattgtgttacagctgcctccagtattcagcacagtgacttgctgtacaggtttgtagcctggtcgccataggctacaccaagcagccttggtgtgtagtaggcgatcacatctaggtttctgtaagtacacagcaacaaagtcacccaacagcacatttctcagaatgaagccctgttgttaagcgacacgtgactacagttttaagtctaacaagatgcctctcgttcagtcctgaagtgcttcttgtttagtttttaatgtacgtttgttttgttatctcagccaaactcttttcagggccataggaaattagtcatttctctgtgtcacagcctccttatctggccccaggacagcgcactacgcatagaaggcaaatgagtaaaactaagtgtaagcatattcatacttacaccaaaagctgcagcttccacagagcacagggaattgcaaataactgtcttctatgaggagctgccatttgtggtttcaccagtttcccagcattgcttctttgtaactcctggttcttgtattagaagaggatgctatgtccatgaagaatgtaggtatcaagcatgtcctttgggagcctccttgctttaacccctctcaccccttccaccccgccttcattagtaacccatcacctgggtcttcatatcccaactaactacagtcttggctaagaaaaccccatacgccttaactcagcaatatgcctcactatgtctttgtccattcagttatccattttgcaactgtttcttgagtgcttgcatatgccaggtcgtacaggaggccaggtctacaaacaggacaagatggagaatcacagtccccgtggagctaataggctgttgtgagattcaggccggttagcctgcaagtgaaatgggatgtgctgagagctgtcctggggaagggatggtgaggtgtgagagcacgcagaggagtacagggtggtgagagcaggctccccagcaggagtagagaatgtgagggcggtgttgtgagaaagtgactccagtggcagacaggagtctggtaagcccaggtaagaaatttctgtcggattctgaaagcaacagggatgcattgagtagcatcaaaggggaggatgtctgtagtcatccgaaaaggcccttaatgtactctccctttcttttctaactgtgtatctatgtggctggatttgcttcatgtacttcaaaaaccagagtaacagaacaaaatcgaatgcagaagcagatgggagaatccagcaaccttctagtaagtcagacattaaagagatttgcaaaaatggaaaacagtgccactcttctcagtaattctgtttgggaaaacatggttattttttatttcaaaaatctatatttatgttagcaagtaataggcttgtgattgttaatgagttattaaatatttttaaattaataaaagggcaatgaggagccagcaaagggtttctaagtagaggaggggcttgacgagatttgtatcttaggaactaactctggagccaccccggccatggactgtggtctcacacggggcagtgagagtgagggtggagacagtggcgggggagttccagtggacagagcctagagatctggtttatgcagtggatggatgtggatgtcacaccccaagacaggggacacagcaagagatatggggtgggagatgagtttgtttgggacgtgttctatcttaggtgtctccttaacatttagatgaaagtgtgttcaggagacagtgggttacatggctctgagacacagtgtttgggttggaggttcgagtttgggagtctctaccccatgaagccctaggaatggatgggcacccagaacacggaagaaggagagaaacactccccacatggaaccttcaagaacacccgtgtctgaaggacaggagtgggaggaggagaatctgaggacactgagaaggcgtagctagagggctagaaagaaagcgggatgccacaaagcctggggaagagaatgtcgaggaagagtggtcagtaagacctggtgctgccagaaggcaggtcacagagcgctcaggaggatccactggatctaacaaagggtgctttgataacctggaagaaaaaggaaaaagtgtttcattattaaaataccagactatgagcttctaaaaggcagggaggttgtcttaattctctttctacttttgttgctgaaagtattaccaggtacattagtagatgtgataattttgtgattttacattaactcattcaagtaaaacgatctagtctttttctgcccttgatctccgtggtaggtcatcccctttgtcagagactcctgttaaatcaacctgtttcctaaatgtgtaagtatttccttatggcctggggtaaagcttcccagccactgtgccatggtcatagatgggctgagatactggtcccctccccgcttgggggcaactggaaagggcctgaagccactgggccagctgtaaacagttttggcttttcctgtggaccatgcaaatctgtctttttctgtgtgtgccatgaggtggaaaacatttgaaagccttggtccatagcacactgagtaagtccttgtgtgggccctgcctcgcctcccgtgtgcccaagcacagcacccctaaagagtcacatcgcccttcgctgcctaccccatggtctcccccagaaccttccctgcatggtggcctgcagggggccaccgattgtagactggaggtgcccctgctgtgtgcttcacacttcaaaacctggcatgctgataaaggctttctgagcaccaaagactgagaagaaagggtgcatttgtttccaatggccaacagtcttaaaataagatgaagatgcttttggaagtcattttggcttttctaaaacatcgcattcataatgccccctctgtaattgttctccattttactcttttatggggcaccaacttgtacgagcagtcagctcaggctgcagtgagctgagagtggtactggccacctgggaaatatgttcaggtcttccatccatcacagccctccaggatcctgtagtctagttgggaagacgagaaacaatactgtataaagtataaggccaagtagtaaggatcagaataatcatagctaagctgcaataagcttatagatggctttacgttctattttaaatgtttcacatgaattaactcttttgattctcatactctccatgtgaggtgggtgcagttattattaccactttacaggtgagaaaaccaagggtcatggaaatgtttgaaaatgcatctaaggtgttacaataagaggcagagctgggatttgagcccagttattctggctctagagactgttcttaactcagcttcctctacctttttgtccctctgccgttattccttagcattgctttgctccttgaaggcggtataaacccacttaggcccctttctttgaacaccttggggaaaatgccttgcttgctctcttctccatcgttgaaatcattctcttttaatattcagccccagccccatcctcttggaagtcttacccctgtgctttggccgcagtgggttgatgtccactctgagcttttctagtccttttgatttaggcctcacagctcccatcttaattatatatcatcttgcattgttctggcttttccatttctgggtatcttgccttcccccgaggagatggggcgctcttcgggagcaaggatgagaccgcgtgcctggctcacactctcctgtggacgctcgagtgcccgaggtcagccacccgtgagctcttctggcttctctaatgtagacactgcctgaccatcccatccagaaacctttcaatgcctgtagaacatggatttctgttccatggaacttctgcttaataaaatgtcagaaacttttactgctcctcggttgggaaaccatcatgtatgtatgtatgaatatatatttattcattcatacatgtatatatacacaagaatttttacttcatttgaaatcttcttacaaactaataataagtatttcataaaacgcctgttcaaactgcaagctgtttccttcttcacttttaaaatatgtggttattgcttttgaagaagacaaagtaaaggaaacatttcctgtttatagaggctcatatttaaccctacgtaaagagcagattcatgtcaaaacatcctagaacctagagccgtaactttctgctttttaagcacttttctactatcacaggagtagagggattggggttttgtttgctttgcctactctttgattctctcactctcttgtaagaaatgaaatggaactcaaagcccattccccttccactgtcctggagtgggtgtgttgtgtgcctttgcatgtttttgtatctttactacatacatacttatcagggtttctcaacctaaacaccattgacattttgatccagaccattctttgttatagcggctgccctgtacattgtaggatgtttagcaacatccctgacctctacctactaaatgccgacagcaccaccatcctgtcccccctcccctccttcacataacaaccaaaactgtgagcagacattgccaaatatctcctggattgggggtaggagaacagagtcaccatgaccatatatccatctaaaaaagttaaaatagaccagacgcaatggtgcacatctatagtctcagctactcaggaggctgagatggaagattgcttgggtccgggagttcaggactgcagtgcgccatgattgtgcctgtgaatagccactgctctccagtctggacaatgtagcaagaccctcatccccaaaaaaagttaaaatagtatatatactcgtgttctgagtattttttaatttatgtaaatagtattacattttatttatattatttacataaactacatacaatttatgtaaatggtatatgtatatgttgtatatgcatattcttgtacaactttatttgttcattaaacattgtatatttgagatttacccatgtaaatctaattcatttattgtagctgcttttataatggtcttttatataatagaaccacttattaatttatttccctccttaggaacaactgaatttttttcattttcttacttaatattacaaccagtgcttcacagaagatcctcatacatgaccccttcagcattcacagctccctagaggtgaagttgccaggtcatagactagaatagtttcactagatcttgacatgttgctctccaaaagggttgtgtcagtttatactctcatcagcaacttatcagagttcccatttctttcacatcattcccacactcagtattgttgggctgtgtatttttgcgagtcttgtgggtataaaataacttgttttcatttgcctttccctaacactagtgagattgaatatcttttcatatgtttcttgacttgggatttccccttctgtaaatggagtattcatatacattatctgcttttctcttgagtcacttatttttttctcattgatttataagtgttgtcttataagttcataagtgtcattgatttattaagtctcattgatttgtaacttttgaattttgagcatatagcagttatatgttgtaaacattttctctcaatctgtagtttgtcttatttaattcagtaacaattgaacttttaatacaaaagttcttacaggtaaagtaatttttaaccacttttttcattgtgatttatacttcgtatttctgttttagatatcctttcctatcctaatgacatgaaaataatctcctatttcttcaaaaaaattttcacagtttggctttccacatttaaatctttaatcttagtttttatttttgtgggtggtgtgaagtaagggcctagttttatcttttccctatctatagccagttgtcccaggactgtattcagtacgggctcataaccaagtgcccatgtttactgttgattcctagactctgtcttctgtttggattttttgcctaacttccactaataccacatgactttaattactgcagtctaatagtaagtcctaataactggtagagaaatcctttcttatatttcttcaaaatagtcatgcctagttttgagctttaacttcaagtagtctagtcccaccaaaatatacacatgtgcatacttttgaattttgagtatatagcagttagggaataggaataataataggaatctgactccacatgacagataacacaacatagcagaaacttaaccgaggtagtttatttctgtcttgtatagaagtccagcagtgggcagcccaggccggcggggcagtgtcctgaaggtgtcagcccccggctctttgctgctgctgtatcctcagcacagggcttccacctgatcctctaagaagggcgagcccctgcctctgaggatcttcctggtcggcccatattccctttctgctgacataccattgtcagaacctagtcaacatggaaagatactgagaaaggtagcaagtcacacgtatatacacacccaagaaaaccaaaactgttttttccaaagggggaaaatggatattggaagtgaaccagcagtctgctagactggagttggcagtgtctggatagattataggattacatgttaccaggctcaattcaggaacatgctgaatctttccatttacttagaaatcttgtagatcttttgtttgattttattcttaactaccttatatttttattgctatttataaatagtaattttttgtacttacattctctaatgatttcaatagagggaatgttactttttaatcatactctcttgttctcatgctttgagagacatttgtaaacactcttggattttctaggtagacagtcatcatttgaataatgagttttgtttctctttttctatctttatgtgagatttttgtttgggtttggtttttgttctcattatgctgtgacttgtgctgaatgcaagaattggtaataggcatttttgtctcttcatgaatgggtattgaattttgtcaaattgttttcatacctattgagatgagcgtttgatttttctccttcaaactgttaatgtgtggattatgttgctagtttttctaagatttttgagataaatcctaatacagcacatcatactagataagagaattattttgaaaacattgttggattgaatttgctgatattttatttaggattattgtatctacccaagaaaaattaactatatattgtataatttttcttgctcataatggccttgtctagttttggaaacagtgttatgctagtcccaaaaaattaggtgggaaactctccttccttttctgtactctagagcagtttatataagataaggagtcattaaagatttcatacacttcacctgtaggtttttggtgggtagatttttaagtactgtttcaattacattaaagtatgatatatatccagaaaagtacatgctatataataatagtcatacaaatgtactttttgtgtttattttgttcaacatcatttgagagattcagccatattgttgcatgtcattctggttcattcattcaaactgctttattagattacagtatgtgaatgcaccataacttacccattctatagttgatgggcatttgggtagttcccgtctttgactgttggaaataatgctgctgagaacgttctagtccatgtcttttgatgaacatgtgtttgaatttcttttattcaggagtggaattgctgagtctcacatatggctcagcttaagtagatggtcctgaacaattttaaaagataattaccaatgtctgttttctctagaataagttttaataagttatacttttctagaaagttgtctttcatcaaagttattggtatgaataaagtattcttgtgattttttaaaaatctgccattatatcccttgtattattcttaatactgtttatttgtgctccttcctttgtcttttcatcaagcttgccaggtttgcctattttatttgactttgtaacagccagcagtaggttttagtgactccttctgtttctttgttttccgttttactgacatttgctctcaactttctactttcttctttctcatttttttagattattgttactttctctaacttcttaaattgggtatagttaaccctttaattttcagttttctttttttaatttaatctcaatatttaaaaattacatcaaccactttattacatcccataaactttgataggtaggtaatagttttattcattcttagctatcttctaatttccattatgaggatttttttggtttccaaatgtgtgaggttttttgttttagttattattttgatgttgatttctcatttaattgcattatggtgagaatataatctgtgtaatgtttatgatttggtatttgtgaatatttcatataggatctagtacacaattactttgtaaatactttaaatgtaatggaaaagaatgtatattctctaaatattaaatgcaaggtatatatgtccattcagaaataaacttgttattttttatattattttttgtctggttgatctatcagttactgagttatatgctgaaaattaaatatatgtctggatgcttccacttctcttgtaattctattaatttttgctttctgtgttttgatgccattgtgttacatataaatatgatattcatgtattctattgattttatccctaatactgcctttttttgccttcgaggtctatttatttggcatgaatgtagcaacaacagctttctttgattagtatttctctgatttttttccatctctttacatcaacttgtgtacgtctttatattttagatttatcttttgtggggaggaggtgagaggtgagagtggcttctgtttccctaattttttttcacatctgttttttctcataataccttattcttttctttaaggtcctcctgtgacgtcctagtctttttgaagtgtgtaatcattttcagatcctcctatattcaggtccttggggacccagtctcttgtgtgttttgtgtgccgacttgctcatcatgggtgatttccttgtggattttgtggttttgaattctgagtttttccccactggagctttaactataaatcccatgtaaccccaaggcaagagaatatctctccagagtaattttacatttgcttttgcttggctccttcgatatctccatcccaaaaccaatctttatgtaacttttttgatgggttctgagaccatgaatataacaacatatgtatagtataacttgaaccccaaatttgcctgtggttcttaattctcaggcaggaccaagattcctgctgtctccgggggaagacaggctttttagtttgatttttttttcatccctttcgctgagggtgctgccatttgaagattgtatctttagacagataattgagctcaaaattgctgcctctttcagacccaaggccgcatcttccgaactcaaacagtgatagaacccaagtggtcctgggtgagcagggcctctgctcccccgtctcccaggctgctcacagtgtgcggctctgcttcccacgcccacttgttcctgaggccttgcaactccacttacttctttcatatttagctgtgtatagaaatatttatctattaatagcatttttaggtgtttgtagtaggaagagtttcagatcttagtctataattttgtcaggactagaagacttctagaaatagagatttaaattaataaattcaaagattgccatatagctagaaacatggatttttttaaagcagcatgtgatgcatttttcttcccatggtggcttcttttttgttggtgacatagactaagccaggaacggcattgctgtcagtcttcaggatccgtggagccaccctcagaaagatggttactgatgctcacttctcacctttttgctgtttgtcagatttcccttcacactctctagcctgttgctgaggttttatcacagtctgcagtcttcctccactgtgtgcgctcaggatttacttcagtcataagaagaagaaaggtagagcaggggagcattttaagggccgtgatggaaacaccagatttctggctgccctcagtgatttagcctcgtctccatgccttccttcctatcacaccctgcaaagccctgagctcctaagagttaactggagttgggacagtcagtggcgtcacagtcgggctgaaattaggagtgtctgtacagtgtctttcactgccttccagagccacagtgcacaaagagcttttacactgcctattactttcttttctcctgagcacctactgcaggctgccaattttgtgctattgactgaaggatgttgtgatacttttgaatttgaattgcttgcatagagcggatcaatatgatacttccttcccagtctatagatgtaactgcattgagagaaagctcttccaagcattatgatgattctgctccttctgtgtctgataactgtgtgttgatctctttttagggaggaatgatcaattggaatcgtctttttcctcctttacgtcagcgacaaaacgtaaactatcagggcggtcggcagtctgagccagcagcgccccctctagaagtttctgaggaacaggtaattaatcagtaatacctggtactcattctaaatccatgtttcagagttgaagcagtttcgatcaacaggactcaaaagtaatcaagcgtgtaaatacaaagatggtgacagcagtccatctgccaccatgatagagactttgggcttttttttggctattgtggttcttacgagtttaaggaaggcattattggttggggggcggcgggtgggaatgtattatggtagcttgttttagatgctcttacacttcatatatacaagaaactaatgagattggttctctgtgaaggatcggggacaaggaggtgggaggatggggagggagtgtgcctttggcatggtttcacttttgtatggttttgagtcatgttaatgttttacatattcaacaagcaaaccaaaaggacagggacaaatgtaaaactgaaaagaaacaaacaaatgctctaactgcatttcaaatgaataacataatcacattgaaggagggaaaatggatttcagtaacgtttgtaccggatataccctcagtctaatgaagaaacaaaaagaactgcaaacaaatcttaaacatttcttcaaggtttagttttcataaaggtatgagtatagcaattctaaaattatgctgtgtgtattatagatttgagcaaatgaggaactcggttgattttattgtggaagaaggaaaataaatatataaagcagggaaaggcaagggagaaccctgtggggttggaaaggaattatcactatcatcgtaaactcatgagagagtgtgtgtgtgtgtgtgtgtgtgtgtgtgtgtgtgtgtacacataccctcactctgaccgagagggctcagaagcagtggcctcctggtagcagtgggctcacctactgcccagatctggtttctaaacactcctccccactaaaaggaaccaggcctatttaggaaaacggtggattccaggcccagtgtagggaacgtacaggatagccctggatcatcgtgtgccaggaaagtaaggaagtgatcagtcactgctggggcctgtcagaaggacactggagccagctgcgggatcccactggccacatctagggcatcggcttggggatcagaataaataaaggatagtaagaatacatgcattataatagtagataaatatttatataaatacatacactggagggaaggaaatgcttttcctaaatggaatgtcaagtaataaatatacaaagaatgatagtatcagaaaatcacaaatttgcaagcatcgtaataaaaatccattcagggaaaaatgatcaatatatgaagactaggctatttatatatagatggtccctgacctataattgtcgaactttaacaatttttcaattttacagtggtgcaaaagtgatacatactcagtagaagccatacatcaaattttgagttttgctcttttcccaggccagcgatacgtggtacgagactcttttgcgatgctgggcagcgactgtgaaccgttctgtttttcacttgcagcacgatactcaataattacatgagatagtcaatactctagatttgtgagagatgattttgcccaactgtagggtaatgttaagtgttctgagcatctttaaggtaggctagattaagctgtgatattcagtaggttaagtgtactaaatgcatttcaacttatgatattttcaacgtacagtggatttattgggacttaactccatcgtaggttgaggagcgcttgtaatctcaaagtatccctccacaagttacttactaattataaaggaaaaccgtaattctacagaagagaaattggacaccaccttaaccaggttatcaaaattaacatcaccaattatggaacaaagaattattatgttcatatcctgaaaaggacctatcagttatgtccttgtaacatatgcagttacaatcaacatgcataactttgatcgtaagggaaaataagataaacttaatttgagggacattctgtaaaatacctggtctatgttcttcaaaaatacgatgttccagattaaaggagacttgggagtcatgctgcccaagtggaaaatgtgatcctggactggattttgtactggagaaaaaatgtctgatgaaaggccattttaggatcaattgatgaaattggactatggattggatattggtattatatgaattttacatttccaggacttggtacataccgaccgtggttaggaaagagaatattcttgttcttagaaaatacacactgaagtatgaaggaaaacggcaccatgatgtgtgcaacctgctctcaaatggcttaggaataatacctgtgcatgtcagtacatagtgtgtgattgtgtgtatgtgtgacagagacagagagagaaagcagctatggccaaataacaattggtgaatctggttaaggaggaatcaagagttccaggtactattctagaaacttttctaagtttgaaattatttcaaactacaaccttttcaaaatctataaaagaaagttaagagtgttgccatcataatactttgaagtttccctctgcctgttgtttttccctttcagcaaacaaaacaaattgagatcagcatttcacagctgaccacaccatccacgccatcgcctccccattccctgtccccagagtgaacaaatgccacgcacctgcctctgtagcaaaactttgtcctcatttttcccaaaactcaaaaggtgcccctgggcagggatctcatagccacccatgggtaaggctgtgacaggtgttttcaagagaaaccactgtcacgtgcccattgacttgatccagcccctcccgcttgccacttctccactcagactgatggtttcagcagctcttcaggattaacaggtggagtatggagccacagttttcctcttctacctccactagagaatttctagacaaaggttatccccatggataagaaaagcccaataacctgccatgtgtaaaatcttcctataacatgtttaaaaaataagatactgctgtcaagttcagctgaaaagaaatatcaaaattccgttatgttactgtttacttgatacagcagtgagtcacatccctcatggggcagccgttaagacgaggtatttaaaggtgatatatttctcagtttgggcacttcaggaaaaaaaaagtgtcaaaaagggagtgaaaggagtatgtgtgtgattgaagtcttcagggttgtttttttttttgtttaatgagtcatttttccttgatcatcccagaatgacaacagcgaggttacttcttgtcaacatcagtttaaaacagtacttaatttcttcctcgctccgtgttacgagaagttgtaaaaacatgaggggttgtttttaacatacactttcttatacattgattttctaaatcttgtttttggtgtttcttgattatcctgcaaatagctgttataaaccattgttgccttaaagatgcaaggttcttactggcattattcattctgcaggctcttggtgttctttgcagtgggtactatagagattataaaagataaaaaagatactgttgttgccctcaagatgcttacaaaaaagtttataaatttatattgtataatctcttggccagtttgtttaaccactgtctaaaatatttgttaataacatgttaagataacttgaattaacaaaagctttttttgcttactttttcaattaaatgtttgtattttcttcatttaaatatcagagccacgtaattttaatgcattaagaaacttagtaattttttaagccaagaaaaatagaaattattatttgagttttttctgctgtaaacagatactttaggaatttagtgagagttcaagaaaacctggtagacatgaaatgtatgccatgtactttgaaagcagaatattctaagaagaatgtgcatcctttaataaatccaatagtagtttgatagccatagaaatcttttgccaccttttctacttttgctatttttgctgttattaagattcaagatttttagttcttcagaatccactcccgttttttggtgagtaaacccacggcacctctgccaattcatcacccctcagagatgccaccccagccccatttaagaatatcccaagaaggaggctgctgtgcaggcaggcggtgggaggctgcagagtgccaagccacacagtgcgccctgtgctgcctggcctgctagctagacagtcaggatggcaacagcgatccccggaaaccacaaggcgagatgtctgctcatgccttccctgtgcagacgtgcggggaggaagatcagaagaaaaccccacaagttcctatcaatttcacagaactttccaagtgctcttagagttgaaagataatgtctggggaaagagaagtctaaatctgatgaaaggacaaaggtggataaagtaggctgtggggggaaaatgaaggatgatggaccagctaagggaggcaaggagaaggcccctaatgccccccaaagaccactgcctgttctgttcaggatccccagcatcaaatccatagaccctgggattgcttttggagatgggtagacaagcttggtgagctgtggaatcagtgaccgtgagaagcagccttaggacaccaaggtggggaagctgctggagaaagacaggtggcgtcaccggctctgagtctaaagggaaaatgggtggcaagaaggtcctgccagggttgcccagagaaaggtagacaagaaagaggaggaggaggaagaagaagataaatagaaactgtttgtcaacaacaacagcaaaaatgccaagccaaagaccacttgataaaactccttcgagtaatcaaatacgctcaatgtctgctatcttagaaataagtgtatccaggccgggcgcggtggcccacacctgtgatcccagcactttgggaggctgaggcggacggatcacgaggtcaggagatcgagaccatcccggctagcatggtgaaaccctgtccctactaaaaaataaaaaaataaaaattagccgggcatggtgacgggcgcctgtagtcccacctacttgggaggctgaggacaggagaatggtgtgaacccgagaggcagagcttgcagtgagctgagatcacgccactgcactccagcctgggtgacagagcaagactctgtctcaaaataataataataagtatatccattattccatctctctcttttttattgtttttttttttttttttaaacaggtatctttatactactatgacccatactcaaaattaacaaatgattaaatttttctcatatttgcttctgatttttttaaaaccaaagggggaaaaactcatcaagtgtatctcttctgaccctcccaaagcttagaaaatgactgttaggtaaaatcagacaagaaagttaaataagactagaccaaagctgggatttaacaaaaggaagatgagcaaatttcagcttcctctcttcgattcatgtctttctttcctttagctgacagtgaccagctgtctgctctgcaccggggctaagcgctgtgctgaattctgaaaacactaagatggataaggcggaatgtcctgccctgaggagctgtgagcccagggcagggaaacaggtggacaaagagcttgtggaagtgttcgggtgctgctgaggccaagaaaggccgtcagggcagtggtgttgcagaggaggggcctgaagacaagtacatgggaggtggggagccacggatgggtgggctggagtagaggggactggagggccggggcacttcttgggattctagaagctggacagaaaggaggccagacaggctcgccaagggtctgatgtgtggcatgtggttatactctagacaccaaggaaccatgcgggatcttacacaagaaacaccatcattgggtttcccaagaggatggactggacacagaggagggggcaggttataatcttataattttctctatccaggcccaggaaacatggtgcaactgcccagacaagagatgttaccatttggtgcattaatattaataatacatttataatgcatgtcaaacgacagaattacagcaaatttagtgacagatctatttggcttttatttgcaacttatgaattagtgcagcctccattctacaaaacagaatgtgagctcccgccaggcagtactggaacagtgcattttgtaagaaggaaacagagcaatagaaaaataactgataggttaacattgagttacttcaggttgctttttttttaagggttaaagcagaggggagttccttattatgctgacttgtgtagtctgggatctcctatttttagaaaaagcaggtcttcttgttttgggatctgtctgcttccttaaagtttcaatttgattgtgtggcatttagcatgagtgactccatttagtttggtcttctggtttgttggagcccaaaacaatggcgtcccataattttggtcaattcacatgacacgtcgtgtggattctgtttatgtctctgagatatccattagcccaagtagagagaatggctttaaacccacaaggtgctttcactcttagctgataaatagcaaaatgtatttagtattagagaatctaaatcttaatgaggctgtctcctctcttctcatctcaggaatccttaccactgtctccagaaaacccaccgaaactcctaaaatgctcaccttctgaaagcagggctctaatatttattggttttgagacacatctcgtgcttctgctctgagtagccaagcatggcagcacattgggtattgggttagcctcccatggcgtctggtctccctgtggacagcgagcttcctgagggctggggccatgtctgccttgtttgctaccctatgaaaagcctgatacacacaggtgccccagcatcggtcggagaagggttgaacacgaaggtgtggccagtaaacttccctttcagaactcttgttttcacataaaaaatgtgctagagagtggtattatgccaggtttttccattgcttgctctagtagattggaaatacgttttctaacaagatcccaaagttagatgtgttacaatgaaatactagatggtactcaaatagtaaccaacttttgtggggtgtctcattctgctgggtgctctgagagatgtacacaaaggagctcagccagccttaactaaagacctgctccatacaagaccctgacgaggctctagacacagttggtctcagagcagcccagaacgctggcagggtctgtaataaccagaaacctgagttcaaccaagagatgtgaaaggaggggggatctgcagttctcccaaggaagagagtggtcagacagggagaggggggtgggggctgcactgccttgcaagggtctcggccatgcgtcagcatgggggtgggcagctggtgccaacaggtaaccggtgccagttgctatgacagcagtgggcgaggcaggcccagcacatctgggctcccccaacagggtgtgcatgctaccctgcacccagtgtgagctcaggatcgggtgggggccgtcttcaggtgggcatcgctttctgcaagcgtcagaatatgggaagtaaaaacccaaaaaaaacatttgtttttgacgcacttagctaaaagggaagttaaagaaaaccacactctagtttgaataaaccaaaaggagtctttcactgaggggagttgctagaaatctcattggaatgaatgtcccattttacttatgtcaaagaggagttgaattgcaagtaaaataccaaagtgggatttcatttattttcttttctcttttcctttttcccttttttttttttttttttttgagacatggtcttgctctgtatcccaagctggagtgcagtggtgctatcatggctcaccgcaacctcgacctcctgggttcaagccatcctcccaactctgcctcctgagtaactgggactacaggcacatgccaccaagcccagctaattttttttttttttttttttggtagagacaagggttgcccaggctggcattttcttaaatgagaattatcttgaggtagtaggcacacacatcccaatcatagatgtttaaaaataaaaaataaggaaagagaaactggtacagatttatttccatctctagggtgttttcctcattcagtgggttctctgaaaagcacattattagggaatgtattccatcttgctctcctttggaacattgtcaggtgacagtgacagtgctcttgtggcaacgcctatttctgtcatgctcccctgccttggtcagccagccatgtggaagtgtcacaccagggctggtgaagggctgctgacgcctgtggttcagaagctcgtgacgaaaggcaactgatggagtcacaccttgctccactggggcaccctggacacctccaagagggtcttcatccctgtgggggctctggtggggcaccctggacacctccagagtgggtcttcatccccgtgagggcggagctggagtttgccattgccacagcaccagctgcaccttggtgtcctctgagtagccttatctctgctcctcacctctggaagtcaggtttcctgttacggaaagcaggctctggatgttacatttggggaatgttagtgtctagaaataagaaataagtagatgtggaagacaggaaagcaaagcatgctggaggcgaacccaactagagctggcttctcaatgaagttagaggaaggaatcatttcgatttgggggctagaaaccaagctgcactctaatctgatattttgtggtgaggatttttaggcagaaacttcttgtgatgcctgagcaggaggaaggtactcgctgtgctctgagatggagagggaatgttgaaagaacacctttttagaaaatttctttgagacatttttaaaattttccagaccaatgaatgactgcaagcccatgaagccaacactgacgaagttgcagtatgcagcgccgtgcctcgcctcgcctcgcctcaccattgcctccactcacgccagaacaagtgtctatcctagcacagtcttttccagagtctcagtgtcctaccagcattctcattttgtcctccacatgtttattggtcacttttgatcttcacattcagccttctctaactggtgctgggcaccgggtgtgtcaggctctgtgttggggggaagcaagccaggcctggtgccagccctcaagggagctcaccgtctatgagggagaccagatccatgcaaggccctaacccagtacccaactcatgcaagtacctagtgccagtccttagagcagaggagacctgtaaacattcattcctgtactttaacaacttgacatcaggagattttacattgaaactttctcttcctgtggatgttagatcggatcaggtgctcatggtgagttctgatgcttctcatcccagtagctggactacagagacaggaagcagcctgcagagaaaatgaagtagtccagggtttcagtgtgagttaatgtgtgttgtggctaaaatgtggtgctttcgatagggagagagatgggctgaccatctataataccattatttatatagtcatcagagttgtgtatttgctaaactttataaatacataaagtgtattttagaacaacacagtctttttgttagaatgttatgctcaccatttaaaaagattgttcctgtctttctgacttctttagggcccaccacacacctggccccgctgccctccataggagaatagtggtcctgagaggtcatgtttattgagcgctggtcatgtgcccgtcactgttctgggcttctcacatgcatccctctcatctcccaaactgcgaggaaacagagagtcagagcctggtcccctgcatgtggtcacacggggccaactccaaagctcgggtctccctgccaccctgcgctggagtcagacctaagacagcatgcagcttcccctgcatttttatttcacggaagcatgaacctggttttctgtccctacaagttgagtatcccttatccaaaatgcatgctgctctagtccttcagtaagcccatcacatattttctctgtgtcgtctgtagacactttttctgcagcgttagcatcatctccatcatcactgttgtcacagtcaccttgactcagaaccatctcagctatttcaccatgggtcagttaatgaacagctggagcccccttatcgatattaaaaacttcaatatctggctgggctcagtggctcatgcctgtaattccagcaagttgggaggccgaggtgggcagatcacttgaggtcaggagttcgagaccagcctggccaacatagtgaaaccccatctctactaaaaacacaaaaattagccaggcatggtggcacatgcctgtagtcccagctacttgggaggctgaggcaggagaatggcttgaacccaggaggtggaggttgcagtgagccgagatcacatcactgcactccaacctgggtgactgagcaagactctgtctcaaaaataaaataaaaaataaaaacttcaatatccacttcttctggcttactgacagactcgaaggtatattttttacctgttaggaggtcaggcatcattttatcctcatttgacatgtggaatccttcaaagtcaccaccttgttcgtcatcatcactgaacatagcacaggccagaggttgtgtcaggcttgcatagctgtgttctcagtcactgtgttccatgcattggcaacagcatgtgtggcatccttcacgctaaacgcctgttgaaaatcttccatacccattcatttgttgctagcatgttgttcaagaaggtacttttatatttatccttcattgatctaagaataccttggccacatggctgaattaatggagtcacatttggggaaaagtacatggcataaacatgatttttgatgagatgtcagctggaggatgaacagaaaagttgtcaaggtataacaaaatatttcagtcatcatccagcccagcttccctgcagtgagcacaagccacaggtccaaaatgtttgtgagaccaatcagaaaagatatccctagttaaacatgcctttttgttagcataataatggtctggtaagaaattcgctgcttgaaaacagcaaggacacaaacttttgcctgtcatgcaagtttacgcttatgcatgcctgctgcattagcacatcccagcaaagttgttctgcccttgatgtcctcagttcctggaggggctgtctcattagctgtagttgtgtctttctggagcaataaaaccaaaacagtgatgttccatcagcattatagacttgttctggcatcagatttttgtcagcaatgaccttggcaaactcaccaatgaatttctttgctgcttcatgatgctttgtcaccacattaaaaaatttggtttcatgttttttcttaaatttctgcagccaacatgttgaatattcatagttccttttcattttcagttcctcatcctgatagatccttgcttgtttcctgacccacatagcattaagtggcaggtgttcactgcaacaccaagggatccatcctcggtacatgatcaggatcttcatttttagctttatgcagtgtttctctatttttcattaatttctgtttatcacttttagcacagaacttcaacagtttatccttctgtttcttcagatcctatatggtggtcactccaacaccatactctcctgtaagacgtttcacacttacactgctctccactttctccaacagcttgactttctgtgctatagataaacataaatctttttcttatcactgttacccagagggtatctgcacaccttttagatattttaacaacatttttataacacagagcagaaagtaagcaaaaaagcacagtgagtgacgcacgtgggttttggccccatgcaggtcattgtggggaacctgcccactggcatgtgcttgcgtgggggagtcggggcatgtgcagaaaaggcatgtcacagctgaaggagggtgagagggtctcttttcccttggagacactgaataaactacatgttgtggcctgcattttgactgcagcccatcacatgaggtcaggtgtggaacttgccatttgtactgccatgttggtactcaaaaagtttcaaattctggagcattttcgattttgaattttcagattaggaatgcttaacgtgtgttttgcttacctgactgcacgtctgcgcaggcctcaatttcgtctttctgtaatttgagcacaggagttgatgcttcacatgccgagtaagctttcccaggagagaccgtaatgagatgtgtggggactgggcgtgctgggcttctctgagcagaggaatagtgagagccacagcagtaattgttagtgtccaccaaagagccctacagacaactgttctctgtgctgctagtttttgctccagttcttactgtctatatggtgaacctctgaaactacataaagaaaggacagcaggggccacttggctaacttgcacggctgtgagcactgcactgcacccctccactggggagtattgggtaagcacccatcggaacacctatcccctgacccttctcgtccttgctggctggttgtcatcgcatacccaagcccaagcatgcagtttcagtttgccatggatgtttagttttggacactatgggaaaccttcaggtgccctttcttagtgtaattgtttattctttttaaagaactgtgctaacattattgctacttagcaatagtttttaatctggtgaaaataacaggtcagtgggcagtgaaagttctcctgtcacacttgtcttctcacccataaaaatcacttaaagctctgaagccagctttggctaaaggggcatgatctgccccgcagaggatgaagagcgagcccgctgcaagctgtgacagcagacgctctcttctgccaagacctgtgaaaagccagtcttagttgtcaaaaccagcaccgcggcacatgtcgttcatgtctgagagaatgaactcagaaggaagtctcgtgtacatagaaagctttcgttcttactctaggatgtcacctacgtgacttacaacccagcccagccatcccagacctaaggggttcttccctctccagggcagggcctgcatgcagtccatgctgctgccctgtgttggtgacctgtgtgtagccagcccattatcagcatcctgtggattccaaaccaaatgtatcatcagtggagggagagctcaagtgccaggtggagctgtggcctaaagtcacacttcatcactccagattatgaatcgtcatttgccagatctccaaattgctgagtgtggacagcaaatggattcgtttgtgctggctgggtgcaaagaagcagccagtcctcagctgcacttgaagtactacaggtagtagtaaaggtagcttttccaagccgtttaaataaacgtcattaagagtggccaagttgtttgggggccatggcatcatggtggtggatagtaggtggaaggaaggcaggccagctcccgtttggcctgagttatctccaccaatgacaatggtccttaactggagggaacatcatacaggttatttccacccaagattggaaagaccaccttgatcagagagagttttccttccacatgacacatatccagcctgagtcctccagcccctctccctgcacaacctgatggaggcttgagaaagcacagggaggaacacttagcttgaaaatgttcctaaggaaaaggaaagtgtgaattctgagaaccaagtggcagaattgaagtttcacatctggcaaaagcttaaacagattattatcaaatagatggtttgtgaacgttgaaaagacagctgtggtctaggacaccaaaccaatcctgttggcaagagatcaccaagacctttgacaacatctcatcagcttatgagagatgttggtgacatgcagaatggataatgatagtgcaatgaagtgggtttgaaactgattaaaaatgttgattaaccccttgaacacagagttctgggctctttgacctgacgtgtttgacattttcatcaataataacttgaacaaagttgtagaggtttactaatcaaatttaggcatgatacaagtttgagggagatgattaacagtagataacaaaatgagaattgaaaataattcattttggttgactggaaaatgatcagatggaatttaacagagatatgtagagtcctagacttaaaaggtcaggtaggatttgagagacctgacttgacagcattttatgtgaaaattcctgagtgttttcagcaggcccagcttaactggccacaccagtgatgcagctccttacacaagtgcatgcacaggcacacacaacacatatgcacactactaatgcattcctctgctctcattgaagctaagggcccagactgttggagggcagtggcctcactgccctggtgagaccacacccgtggtgtcacactcagttctgggcgcggtgttctgagacggtgtgcacaaatgggaggggatgggctgaaaggaactggatcctgaaacacaggaatgagcaaaggcagccacagccctcatactgggagttcacagtggtggggagaagctatcaccccacagacacagctgcagggagcccaggacagaaggcagtggggcaatgaggacttcgctctgggggccttctagtctgggagacatggaaaaaggcaggggccccaagacccaccaggggaagaggagtcatcaggctcagggcagagggcagagacagcaacacagcagaacaagccacggtacccacaggcctgggtgggggccgagaaaagccagtgggttgagggaggaaggagagggctgtcacacccgcaaagtgctttatgtaggaaaagagaatagggttgttctcggttacttcaaagggcaaaatcaagagctgtggcattgtgtggatggcagcttgtgaggggcagaacaccagggtggcagcattctcagccacctggcagtgaggccagggcactcagccacagctgatgtgcatatgatgcattagtagtgtgcatgtgtgtgtgtgtgcctgtgcacgctcttgtgtaaggagctgcatcactggtgtggccagttaagctgggcctgctgaaaacactcaggaattttcacataaaatgctctcgagtcaggtctctcaaatcctgcctgaccttttaagtctaggacagtacatatctctgttaaattccatctgatcattttccagccaaccaaatgaattcttttcaattctagttttgttagctactgttttttgttttttgttttttttatctacgacactctctcctctggtgggaaaacaaactagaaggtttctgcctttgctctacgctgtccaccagccctgggcagctgagcatgaatcacctgagggcgccatagtgtcccaggtgctgggcatcttgctgctccaggacagccctccccaccgcaaggcatttggaagacacctggcagcccttcttggcttcctagccagggctgtgcgtcagtccccgtgctaagggttgaaagcaacgttccggggaggagcacgctcactgcgtgcatttgtaagcctagtcctcacccactgagtggtcccatgacatgggcggcaccccccgtttggaaaagccctggctggactccagcttctgagcagtgtccactgcgtgtccctgttggccctcaactcttccctaaggcttttgggggaggagggtctgggtgtctgggcctgggtggtcactgggaggttccctcccccacctgcctctctactctctgcaccttcttcctcaccttgctgagtccttaggttaattttgctcagaatatccagagttagccactaggctgcgggtgaagtgggatagagaggaagaacagcaggctttctggagccacatgcccaggcccatgcccggcccctcctccagccaccccatgccatagtccccattcacacccactgagtcccctgagcagaggaaggggtggtgatactgggccccttctctttccaccatgtagcaccaagtagctcgctctctttcggaaagaaaaattggaaactctgactaagtcctcaggtgaacccacaaaagcctctttaatgcgcaagtggctaaaaaactcaacatgtacaagactgttgactttgatgaggtgttactgcaagtgcagtttattttaatataagtacaaaaaaaatgtattcctgtggcaatctggggccatgaatatttttgtaatatattcttaattgggaaaaaaggttgcaaataagctttagtaacattgccaatttcaatactggagactgcctgtagagaaaagtacaggaaatctccgtattcacagaatcaggatttgtggtcaaaaacaatgcatgcttgttcctccctgcttctggtggctttcactgcctccttcctcagttgctgccccaggctcagccccactttgctgcctgcgtaagccccaggctgcaagtggcacagctgtcaaagtagtctgagcacccaaaggcaggcagttctgtggcagtgacgccaggagtgcgatgccagggccgagcatggcagtgacgccaggagtgtgatgccagggctgagcgtggcagtgacgccaggagtgtgatgccagggctgagcgtggcagtgacgccaggagtgtgatgccagggccgagcgtggcagtgatgccaggagtgcgatgccagggctgagcatgggtcaccaccatagggaatcaaacgacgctgagtcgtgtgtcctcgcagtgagcctgggcagctcatgccgacctgcttccaaggcctggtcccagtaggccactttaccctcagaagccctgtgtccttgtctgtagaatgagggttatgtgcgatcatgcatatatattggctacacatagtgaacattgaaaaatttgtacctggtataacttttaagtatcagattccatattgaaatgaaaattggtttttttgtaaacagttttgacctttgccacaaggctcacatgaagaacatttggggcccagggataagcggcaatgtcagcgccctcaggtttctgcgttttctctgcctgcaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgttttactcttcagtatttttctatcagacttgtacaaataaagccttgttccaggctatacatatttaccagtcaaccaaatcctccgcactgctcgtctttcttcagacgactgggtgctcatttgaagtgagtgaagtgcttttgttcctgtaagtagcactgcccacagtggcattacctgtgcaaacctggaagctcggcctcactgaggctgcctggggccactagctgctcagaggggggtcgaggtgactttcttggagcccagctggtcccacgcacaagcccctccttgaatctgaattgcgccatctcgggttgcaaggaacagttgatggtggtggagatgtccctgacttcattccctaactaggccacagtcaacacctcctgagtgctgagcaaagccgtgtgtgtctgacctctgaggcaaaccaaaatccactctctgtgttccccgtgcaaaggagcacaggcagagaacacccaaaaatacaccccctcctccatgctacccctttaaacagcacctagccaagtaaaaccaaaccagaggcaaaggtatcccttggagacgggggcagcaaatagcccctttgcaagtagctaattagaggccttgattcacacttgccagctgttcttgagtgtttgctaatcaggattccctttggaatgagattgtattttggagacctttgtcctgcccacaggaacctcagtgaccctctatgttggttgtttagagagtagaggattgaggacctaaatagtggcagagctgggagacaactacaggcttggtttgttctctttagttctttcagcctctttcccagttccttacagctgccaagtcctcgcctttgcagtggtggcccgtggttctccatccttgtcatgcaactaccaggccactctccctccatcaccaccctctggacacacacacacacacacacacacacacacaacacgcctgccttttcacgcttgaccatgttttctgtcttactggggttcgcgttgctcacccactcttgcttcctgcaaatattgacacaaaaacatctacacagacattccccgcagaagtttgaatacctgagagcttccacacctcttgtcaagacactgggactcttttttcaggccgatggcacccccaaggaagacctgcggagccatcccagccagaggagggcgccagtgagccacttgactgggcttcctgaggtctagaaaaggtttagccttttgattttgtgcacgtggtaacagatggggcttaatttttgggtgagcagattctagattgtgaattgagaaggtaagattttccatagtgaccccctgctcctgacattaaggaaagcctgcctgtgaagttctgatttgtaaagctagggtgagtttgggttagaaaggtggagatgttagggaaattgagtacaaaattgtgaacacattccagtgtcatttagaatattctgtgagtccctgagtttacgttcctacaattgttcttaagttgaaatggaagtgtctaaaaccatagacttaagaattttatcttaacctgagagcttacctgatacttaatttgtgagaatcaggagtattttcttcgcttccaagttcccctaaccaatagtgtttttgtaaaggggtggaccaagaacgccaaaatgggctttacagctcagactaaaattccagctctgagactgaaatcttacacatgataaaaattgccagaagcatgtgaatttataacctgccaatacagccctgtctgatggagaaacaaccccactagctacattgtaacaatgccacggatagacttggggttcaggtagaagggctggacaatgccatgaatagacttggggttcaggtagaagggctgggggaagtgatcactggatgttggaaatcaatctgaacagaggcggggactagagagtcaaatcacaagtcttgctcttgggatgatggagtaaattgatgaccaggaattaggagagaggagggctggggatggaaccctgaggaactcggcatctggagtggaggaagaggtggagaggtggcaggagtatcaggagagggcagcccaggctgggatgtgggagtgtcaaggattggggggcggcactactgctgggaagggcctgggcgagggcagagtggtggcggcttccagaggaaatgtaaagactagtgagaaagcggaggtggggcacaggctcaaccagggcacttggcagtggggaaggggagagccagggacagggaccgtgagatccaggcccagaatggggtgcactcaggagccacgaagcggggcaccgcagaaaccggaagcatccttcattcagtcccctggaactagaggaaggagaaaatgaaggtcgaagtgaggaccgaaggcgaggaagctcctgtcctggagtctctagctccctaagaggagggcctgggggctaacagagagcagatggacgtcttcaaatgagagaaacacgaaggatctacattggctagaaacaatagctttggcctcttttttattttattttactttattttatttttgttttgagacacagtttcactcttgcccaggttggagtgcagtagtgccatcttggctcactacaacctctgcctcccaggttcaagcaattctccttccttagcctcccaagtagctgggattacaagcgcacaccactacacccagctaatttttgtatttttagtagaaacgaggtttcaccatgttggccaggctggtcttgaactcctgacctcaggtgacccgcccctcggcctcccaaagtgctggggttacaggtgtgagccaccgtgcccggccctcttttgttcattaactgcagtgttgtggtctgctgaaccccctgcctaatgggaatttcaaatatcctagaaatttacacagtgccaagaaactagctggaatgtgtaggccccttatagccagtccataattctcagggaagttgatcagttctgtgacctttctggaatgttctgtgtgagctgccctgggagtctgagtagacttggagtgggagggaagaaagtaacccaggtctgtggaggagtaggggagagaggtctgcaataggaatcttcccagactaacaccagcaaatcaagttacgacccaccatggtcctcacccggacacaaaaatcgtttagggacaggggctgtccccaaatggccagacccacagattccggggcctccaacttcaccacagcgaaacagaagaagcagcaacagtcctgcgtgagctccacgcagaaggactggagaaaccctccagaatcgcacttggcccaggcacggggggctctccccaatctgacggcacccttgcccagcagccccttctccccaaggggccgtctgttctgaaacatagggggctcgcaggtttgtagaatgttggaactagagagtgtttatctggtgtagcccacctcttcaggtgaggagacagatcagagaaggtgccagggtaacttggccgggatcccgagggccatgatggacttgaggcaaagtcagctccctgggccaggcctgtcctcagccctcccctggctgcttcgggcctcccctcaacctgggcagtgggaggagagcaagaaggtccccagggttggccctcaaattcctcttgggactgtgctgctccctcatcccacccacgccatgcccagcagcacccatggctcctctcaggccagccctccttgctgtctgcgcaagaagggaacccagagggatgtggcagcgaaactcaggcccgattctcccctggggccagagttttcttccaaacccactacatctgcctgaagccatgtccacctggctgtcaccacagacagaatgggagactcgggccttgtaatcaaaggtgctctcctgccactgaggaaggatggtggccccgtgacatgctaaagtgggctggtggtgacacagtgtctcctgagattcaactcaccttgaagacaattcgccttcgcaaatgtggccaggtggagcctcagcagaaagctgggtttgctgttggtttctctccccagatgatgtacagccatggagcctctgcacaccactttgcatccaccaaagacagacccaggcccagtgaagcatggagactgcggatgtcagggaaggcctgggagagcttccctcgcttccatccagtgtgttcaccggcccactgtaaagggaggagttgccagaggctctgggaacaccaaaggcgagggccctgggaggtggtggcaacgggccccagggactggcttcttgctccttgggggcccagggaagccacttcttccccttccgatcagccctgccgcatcagagacggctctgctcccgggtgggagaagctcccgccatcctctgccttcccctgcccctagacaatcatataggagcccacgtaatggacttttctgttcaacaaggctttcggtgcttcacggggccatagccagttttgctcttttgctatcttggcagttctgtgtacggggtgcctatcatacaatgctaataggaggttaaacagaagcaccatattatatccggaagctgatcagcctagaactatcgatgcagattttgtaaaacccacattcatgtaacatatggctgaccccagtttttcatatgaacaaagctgtcgggaccacagagatctttggcaaaataggcagtctctttggagggcaggttgcctcctctcagcaggcaggtcctactgtacttaaatgtgcacaaagatgaatgtgatactaacactaaggcctgtttaaaggaggggtgcatttattttgcttaaacataaaaagtctagcaaatacttcaaaaaaaccaacccccttaacagagtgagagcagccaaggcaaacccttctccagccctggggagacgtgatgaggctcctacttggagatcacccaaatgcaaacccaaccgtggctggttatttaatttttttttaattaaaaaagaataaagcggccaagtgtggtggctcacgcctgtaatcccagcactttgggaggccgaggtgggtagatcactggaggtcagaagttcgagaccagcctgactaacatggtgaaactgcatctctactaaaaatacaaaaattagccaggtgtggttgtggcacctgtaatcccaactacttgagaggctgaggcaggagaattgcttgaacccaggaggcagatgttgcagatagcgccactgcactccagcctgggcgacagagcgagactctgtctcaaaaaaaagaataaagccaagcactcactcctagcctgtcttattcctgattatgtgaatggccatttcaaattacgaaatttctaaattcagagctcagaactacttcaaaatgataaaagcaaatcagcatacagttgccttgggggcaggggaagacagtgggtagggctggggcagggcaccccagggcttcagaagctccagtagtttgaatttctgaaactgggtggaggtacagggtgtctgttttactggtttttaaatgtcctacatacctcctttatgtactcttctgtattatgacgtattcaatcaaaagttgaaattctccaaagatatattccctcccctcttttgattatttgccaacttcttccagagattcctatacacttgtgcaccccttctccccgggagagctccagaaccctggagctgggtggacggggtgtagaccaggcagcgtggtgcaagggattccagcctggagcttgagcaccgagagtcggggagactcccgtctgggggagcctctgacaccactcctctcttctcatgtgaaggctctgtttccagcccctgctgcggcctgggagagggcacagcttttcctcggtgtttacccacggattctcacactttccagatgattcctgtttgctcccaaaccttatccctcctgttcaaggtttctacctcgaggggagaagtaaggacactgcggctgaccgtcacccaataggccacagagatgaatgaagagaaaggggcagccttcactttccagacctcttataatccagccatctaatgcactgggactctaggcagagcccctcctgtcccccgaggctgtgtggtttggatgtcagggccttcctgtaagatgggaagacgccctgctcagctccacccgcctggagagctcccatgggtgcgagggagatggggagtgcggctctgtttcctaaactgttgaatgctgagttcgtggcatattcttagtaccactggaaataccaacaaataataagctagggtctgattttgaaagtgaataatagagattttgaaatacctttaattggctggccttgggaaatgttcctgccaagcaggaaaagattcaggaggacagaggcgccgccctccccaggcacttgccagcggtgcaattgtctctgcgcccaccacctcctctcccctgaaaaaaggcttgtgtttaaaaggggtgcttcaggagccctctgtccatcatctcctccttcctcctctgaatctccccctttgcccttattactgacacttccctagcaatttctctggttacaaaaaaaaaaaaaaaagaaaagaaaaaggacaatgatatgctttggctttgtccccacctaaatctcatcttgaaaattataatccccgggcagggtgtggtggctcacacctgtaatcccagcactttgggaggccaagctgcgcagatcagctgaggtcaggagttcgagaccagcctgaccaacatagagaaaccccatctctactaaaactacaaaattagccaggcatggtggtgcatgcctataatcccagctacttgggaggctgaggcaagagaatcacttgaacccgggaggcggaggttgtggtgagccgagatcacgccattgcactccagcctgggcaagaagagcaaaactccatctcaaaaaaaaaaaaagaaagaaagaaaattgtaatccccataatccccatgtgtctagggagagacctggtgggaggtgaccggatcatgggggcggttcccccatgctgttctcatgatagtgagttctcacaagagctaatggttttataaggggctcttcccccttcgctcctcactcctctctcctgctgccttgtgaagaaggtgcctgcttccccttcactttctgtcatgattgtaagtttcctgaggcctcccagccatgcagaactgtgagtcaattacacctctttcctttattaattacccagtctagggtatttctttaacgacaaattccttgaaacaagttgtgacatgcactgtccccattctctcagctcccgaacacctggcctccatcctcaatggccagtttttggctggatgctatggcccgctctcgggctgctggtaaccccctcggctccatggctggagcagcggcctcctgtcctggctcccacaccaccgcctctctgtctctcccgcagcttcctcagcctcttccctccccatgaatgttggtgctcctgggtcctttctagccctccgtgttagccagggctttttactctctgcattccaatgctttcacatcttggggccttgctgaccctggagagacaaaccctgtaccccggggccagccaatccctagagacagaaaaaggcctgaagggagcacactgttcagaggcaaggcagccaacccaatgcctgcacccccgacctccaccacctgtctggggctctcacactccaggccactatgcccctgcccttgtcaagcagtaccaggtaccaggcccctaaggacagcccctctgccccagagcctgcatgcccccctcccgttgatgcttctcgtggaaaccacattcaaggtcttgcccacgctctcctgaccctccctctgcctgctgaccagccctggttctcccctggctggcctgggtggcagagtgtgcccctctccttgggagctgtgagtaacgaactgtcttttcaatggtgctcggccgctgatctgttggcctcatcatacctgagaaacaataaagcctacagtttagagaagcccctcaactctccctgggactgtcgtccacctcacccctcccaaacccgtaccctcaccctaaatcgctcttccagactgcacacctcgtatgtcccactttatactggacacctccatgtgcctgtcctagggctcctaagcccacgtcttccaccctcaaacttcatctgaccccacgctccctatctcaggaagtgacagcaccctcaatccagtcccccaaccccaaactcgggagctctcccagagtttccctaaccccttctccgacgtcagtctccacccagcacctaacacacttcacatgttacgttgtaattgtctgattctgtatgtcccctgctggcctacctgggccatgaggctggagaccacgtctacccactgtgtccccaacacccagaaccacacgtggtgaatgtgggaatgaatgtggaagatgagtattggcctagagacaaaatcataaattactagagatgaagaaggtccccgccctgcccttggtgcacgcatcctctcccatgtctcagagagcagtcctttatacgcggggattgagctgagtcagcctgggactgaagttctggcaatgttctaccttggtcaatttatagcattttacaccttattgcaacctacccaagaggcttatattaggtgttactgcacacacacacacacacacacacacacacacgggctcctcaccccctgagaccagctcccccgctgcctgtcctgctaatcacagagctcagcagaccatgtgtcaagactccttaggatccacagatccaagcctcagaaggtgaagttggcctttggcattagaaaatgtaacttcccagatttctacaattatagtggaacagggcgcccataccatgaggcactcgcgttgcctgaggtgtggtctgacccatgtgctatagggttgctgtgccctcaggtggcacggcctgccccaagcctggctgcccacaaccatcacaggccaggggaacttcttagtctctgtgccatcccgtatgctgtcacttggcgaagtgagaaccgcagtgaaagctggacagtggttacctgcggtgtgcagcagtgcccaggaagtgggactctcggtggaaatgtgctttttggagaaagccaaaagcccatcggaatatgtgagcatctacaaatatgatgtacgaaactttctgttcttcctccttaaaatgtcaagtgattacaattcttaggtgtcattacaccatcctccagccagtggtgaaatccttggacattctggttgggtggtcactgtccgtccccagggaacagggttcaaggcctcattactgtagagcaatgtagagccctggctgacagggcttctcctggcctgtgccctgcctctgtcctgatcctgtgggctgaggaaacccttagaagtggtccctctcatgcttccattttgacacgagattattttgatagggtctgaaaaacaaagcatacaagttaaactttttttttttaaagcaactaatgtttaaaagagacccctctcattccttctccaagcctcacctttgcagtcgggctctgaggcagtgtgtgggggcttgaagtgggagattagatgggactcagagaaagggagagtgtctggaaagaggggtgttcagaaatgggtgggtgttgtgggctgaatcgagtccccccaaaagatatgatgaagtcctaacccctggcatctgtatgttcttaaatagggtctttgtagatgtaatcaagccaagatgaggtcattaaggtgggcctaacccaacgtgactggtgtccttatacgaggagagaaacaccaggtgaaggcagagacagagggggagaaggccacaggaagatgacggcagaggctggagcgatggatctgccaggttggaaacgtcaaagagctccagcaagaaccagcagcctggggaggaatggtaagttctccctaacagcccccagaaggaaccagccccaccagggccgtatctcagacttccagcctccagaactgtgggacaagaagtttccattgtgtttcagcctcacagttcacagcactttgttacagcagctcgaaccaactaccacagtgggccggagtcaggtattggcaaaggtcttcaaaaaggggccctggacctggcctatcagactcactcacattgtccccaaacccacttccccaccaatcattcctatttttattcacattcccatagacatttgaccttgaagtcacctgtgatggttcattttgtgtgtcaccttggctaggctatggtgcccagctgtttggtcaaacactgctgtaaatgtcgtggggaaggtattatttagatgaggttaacatttaaatcagtagactttgggtagagctgattaccctccataagagggggaaggtgggcctcaccccaccagctgaaggcattaagagcaaagactgagttttctggagaagaagcaattctacctcaatcccacaatatagaagttctgctcgagtctccggcttgcctggcctcccttgtggatttcagatttgccaggtaccactcctatggtgcaaacacacacacacatatgtgtgcgtgtgcctgtgtgtgtctgtgtgtgcgttgtgtgtgtgtcacattgcttctgtttctctggagacctctcatatataatcactcactttatttttccaaaaaaaaaaccacaggcgggcctcctctcttgatttcgcctttgaaatgtctcttaaatctcttcttttctttagtgctctggttctcagaataggccacacatcagaatcactggagacctttggaaaatcctaacaccagccacacccacagcaattacatcacatctctggggatgggacccaagtgggcatcaggattttttaaatgtcccccgacgattctcatgtgcagccaaagttgaggaccaacggtttgataaggaaagaaagccaggagggaaacaggtcccgccacctctgaatgtggcgtcttctgagccgtcactgctcaaacacaacccctggaccagcagcatcagtgtcccctgagagcttagacatgcagactctcaggccccagcccagactgactggagaagaagctgcatcttaacaagaccccaggtgatgcctgtgtccacattaaagcatgaaagcttgaagagctttgtctaggacgaacctaaagcaatcagtgtcccagggcaggctgccatagatgagttctgtggaaacccaggggtgcaggggggctgaccatgggtcacgctgatcttgtcatgagcttggggtctgctctcacagcccttttgtgaccagcgtgaatttgcacatgggctttgccatcaggcgtggctttgaatctcagctctgctgtccacccccgtgtgactttgatggccccgtttcctcatctgttgtgtgccaataatagtgatgcctaaatgaaataatcacgagaaatgcaaaacaagatagtctctgtgaatggcttagcacagggcctgcaaaaatcaaagccttggtaaatgggagagctgctgtcaacagcgggcccagcagccctgtcagaaccaccgcgagccccccagcccactgcaggttctcagcagacactggctgcaccaggagggcctgatgggctcggtgtgaccaagacggccctgaggttctcctcgccttgactcggctgtcagcaggctctttcctcattctaggcctttgacctcccttttataggcccctgatgcatttactttagaaaacttgcaattgtcaattctttctctgcctctatgagacagaaatcttctcccagcctcttaccagttgtatgaaacaggactgtcctcctcaaggacccaggagccatctctttgaaatgtcatcatcaaggaagacagtgcctctgcctcctgttccctttggcagggtgggccccttgctccctgcaaaactgtccgccatcaaaagctatgagaagtttatttcacctttggagaaagccacttagcaaacgcagatggccttggacctctcctaacatacccaggacttttctggctcactacagcgtttaaaaaccctccaccctttatttccacagaattgagttccgattgagctttggcctctttgctcttgcagcagccttgagtgaagtcttccctgcctgtataaaatattgcctgctgcagctttactttggtgagttccagcctcagatcttctactcagatcttctgcggctgcagaagatggtcattagaacagggacagttgatctcatctcctaatctcagcaggatatcaagatcagaagccacatctgtgctggaagaactgatgggaactcaggtgggagggtctgtacctgccttaccagccagacggttagggttggggtgctgagtgttcccagccactgtcagctggcctagcagagccctggtgggatttgggggtgagtctgggtctgagtctgtgaccgcctcctctctgcaacttcttgctcctcccacctgccttcaccttctctcctgtctcaacccctttccttcccacagttgaagcagaaaccccctgaccccaccctctgatctgtccaaagtccagaaaacacaaaccctcactacggtcccgctcttccttccttccccatctattcagataatccttgaaatccaccccaagtgactgggagactctcctgctgtcaccagcccctcagcggcagtggcagcccccattagcaagcgcagcacaggcctggcaccctgctcgcggccatcccgtcccccacccatgcccaccaggcacccgcctcagcccctcttctttgatgaggccaggcactgagtccatccccagggctgtggacttaagtggaagatttaggagtgacagtggaaggggcacagccgcctccttcaggagtgaactaaagtgtgcctttgacaaacctcttcaccgtttctagcacctagattccagcctcccaccaaggtgctgcctcccctctcctactgccccctgggaactctgccttgctcccactgcctgcagagagagcagcgctccagcccaggccccaagctccccaagctcagctcagccccagcctccgcacatctcaagacctaccgaactgatctgggactacctcccgccgcctcactgtttgtcagcaaggcactggctctcagcctccattgctcttgggaacctgcgagaagatttcgaaataacctgtgcctctcctcagcaaatgtaaaagaacagaaattaaaacaaactgtctctcacaccacagtacaatcaaactagaactcaggattaagaaactcactcaaaaccactcaactacatggaaactgaacaacctgctcctgaatgactactgggtacataacgaaatgaaagcagaaataaagacgttctttgaaaccaatgagaacaaagacacaacataccagaacctctgggacacatttaaagcagtgtgtagagggaaatttatagcaccaaatgcccacaagagaaagcaggaaagatctaaaatggacaccctaacatcacaattaaaagaactagaaaagcaagagcaaacacattcaaaagctagcagaaggcaagaaataactaagatcagagcagaactgaaggagatagagacagaaaaaacccttcaaaaaaatcaatgaatccaggagctggttttttgaaaagatcaacaaaattgatagaccactagcaagactaataaagaagaaaagagagaagaatcaaatagacgcaacaaaaaatgacaaagggaatgtcaccaccgatcccacagaaatacaaactaccatcagagaatactataaacacctctatgcaaataaactagaaaatctagaagaaatggataaatttctggacacatacaccctcccaagattaaaccaggaagaagttgaatccctgaatagaccaataacaggatctgaaattgaggcaataattaatagcctaccaatcaataaaagtccaggaccagacggattcacagctgaattctaccagaggtacaaagaggagctggtaccattccctctgaaactattccaatcaacagaaaaagagagaatcctccccaactcattttatgaggccagcatcatcctgacaccaaagcctggcagagacacgacaaaaaaagagaattttagaccaatatccctgatgaacattgatgctacaatcctcaataaaatactggcaaaccgaatccagcagcacatcaaaaagcttatccaccacgatcaacttggcttcatccctgggatgcaaggctggttcaacatacgcaaatcaataaacgtaatccttcatataaacagaaccaatgacaaaaaccacatgattatctcaatagatgcagaaaaggccttcgacaaaattcaacagcccttcatgctaaaaactctcaataaactaggtattgatgggatgtatctcaaaataataagagctatttatgacaaacccacagccaatattatattatactgaatgggcaaaaactggaagcattccctttgaaaactggcacaagacagggatgccctctctcaccactcctattcaacatagtgttggaagttctggccagggcaatcaggcaggagaaagaaacaaagggtgttcaattaggaaaagagggagtcaaattgtccctgtttgcagatgacatgattgtatatttagaaaaccccatggtctcagcccaaaatctccttaagctgattaacaacttcagcaaagtctcaggatacaaaatcaatgtgcaaaaatcacaagcattcctatacaccaataatagacagccaaatcatgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccatgctcatggataggaagaatcaatatcatgaaaatggccatattgcccaaggtactttgtagattcaatgccgtccccatcaagctaccaatgactttcatcacagaattggaaaaaactactttaaagttcatatggaaccaaaaaagagcctgcattgccaagacaatcctaagccaaaagaacaaagctggaggcaacatgctacctgacttcagactatactacaaggctatagtaaccaaaacagcatggtaactggtaccaaaacagagatatagaccaatggaacagaacagaggcctcagaaataataccacacatctacaaccatctgatctttgacaaacctgacaaaaataagaaatggggaaaggattccctatttaataaatggtgctgggaaaactggctagccatatgtagaaagctgaaactggatcccttccttacaccttacacaaaaattgattcaagattgattaaagacttaaatgttagacctaaaaccataaaaaccctagaagaaaacctaggcaataccactcaggacataggcatgggcaaggacttcatgactaaaacacaaaagcaatggcaaaaaaagccaaaattgacaaaagggatctaattaaactaaagagcttctgcacagcaaaagaaactaccatcagagtgaacaggcaacctacagaatgggagaaaatttttacgatctacccatttgacaaagggctaatatcgagaatctacaaagagcttaaacaaatgtacaagaaaaaaatcatacaaccccatcaaaaagtgggcaaaggatacgaacagatacttctcaaaagaagacattcatgcaggcaacagatgcatgaaaaaatgctcatcatcactggctatcagagaaatgcaaatcaaaatcacaatgagatactatctcacaccagttagaatggcgatctttaaaaagtcagaaacaacaggtgctggagaggatgtggagaaataggaacacttttacactgttggtgggagtgtaatctagttcaaccattgtggaagacagtgtggtgattcctcaagcatctagaactagaaataccatttgactcagccatcccattactgggtatatacccaaaagattataaatcatgccactataaagacacatgcacatgtatgtttattgcggcactattcacaatagcaaagacttggaaccaacccaaatgtccatcaaggatagactggattaagaaaatgtggcacatatacaccatggaatactatgcagccataaaaaaggatgagttcatgtcctttgtaaggacatggatgaagctggaaaccatcaatctgagcaaactatcgcaaggacagaaaaccaaacactgcatgttctcactcacaggtgggaattgaacaatacaacacttggacacagggtgaggaacatcacaccatggggcctgtcaaggggtggagggctggggatagcattaggagaaatatctaatgtcaattatgagttaatgggtgcagcacaccaacatggcacatgtatacatatgtaacaaaactgcacgttgtgcacatgtaccctagaacttaaagtataatttaaaaaatgaattaaatgaaaaaaacataaataaataacctgtgcctgagtccctctcctagagatgctgactgaacgcatcttggccagtggttctcagacttgggcactaggattttccaaaggtccctcgcaaggctggtaaaacagtgcaggccccaccctagtggggcagactcagcaggtctgggcagggtctggagtcgctgctgctgctggtccccagaccacagtctgagaaccactgctcctgggttgagggagtggcctgggtgttcacacctaaccccagtaacaagaaaagatgcactgatatccccagtgacgtgaggtggtctagcaccccttacaaatatcagtggccacaatctgtttccattttaaatgagttctttagtgttaagtaattgacacacatgttgctccatggaaaccccacaaatattccacgtgacaaatacaatagtcccttgtgcagatattacagtttccttttacagatgaggaaagtgaggtgtgggtgtgtgtgggtgcggatccttggcaaggtgcctcctcccatcgccctgggttagtctgttttccttgatataaagaaatgtctgaggctgggtaatttataaggaagagtttaactggctcaggttctgcaggctgtacaagcatggcacctgcatctgcttggcttccagggaggtctcagggaactttgactcctggtggaaggtgaagcgggagcaggtgatcacacggcgagagtgggaacaagagagagaggaaggaggtgccaggctctttaaacaaccagatctcacctatctgagtaagaagtcactcatcaccatggacagggcaccaaaccgttgatgagagatctgccccgtgacccaaccttggggatcacatttcaatgcaaatagccaaaccatattcagaactgagacctctctctctgtaaatccaacccatcgtgggcattcctaaaaagaacacccgcctccatccatggccagtacagcaagcagacgggcatctcggctgtgctttctcttcccacccagttctacctcttcttgccagacttcgcgatctcgggcctctttcctgctcctgtttcgttctcaaatgccctctggtatgactgtctccttccggcttcctcatgctcataactgcggggccccacgcagctttggagctgagcagcccagcgtgcaggccgggtcaggtgtgagaaacgcttgagaggtggcccaggaggatctgtaatgtccggaggcagccagacctcggtgtccctgctggaggcccctctgcagcccctgggcccccctcctcatcacaccactggctggccagcccctctcgtaccttcatgccctgtgagaagtgctcggttagtgcaaatgcatcaggggtgtgagctttgcttttaatcccggccaggtgtggaagcaaactactgggcacctacaggatttgctcagagcagccaccagcggatgcagaggggacctttcagctgaggttcttcactcctgaattcacagggccccaagagcagagttccaagttctttgagactttgagcctctctgcctccaagctggaagcagacatggagaagaagtgtgcccaggacctcaacatgagctcctgagggtttttcgtaggatttgacaaatcagacttcataagagaaatgatcctcatccattcaaactagtgggggcatctggagcgctagctccctgcctggggtagtgccagctgtccggggcatcaagcaagggtgccagagcagacatttccttcaggaccttgcagtccagttgccaggatgtaagtggaaaaaaagtgcttttttatacaccaacaaccagttctctgtggacaccaactggatgtcccacaatttaattcgatcctgacactagctactcagagttagtgcaggcccccccagggttagggccccatcccacaagactgccccccacttcagatgccagtctcaagtagtgggccctcaggttaccacgcttctgtccaagttggctacaaatcgagggttcccctcctcaggttggataatttgctatgacagctcacagcactcaagggacactttacttactattaattaccagcttattcgaaaggatataatacataaaggatatagacaagcatcccgatgaagaggtgcctaggttgggaaagggcctgatttcaggggcttctgttcccacggagtttgacatgtaccatcctccaggcatgtggagttcaccaccagaagcttctagaactgcatcacttcggggttttatggagggtccattacagagatgtgattgattaaatcattggtgattggactcaatctttggcctgtctcctttccccaggagctaggggatggggctgaaagttccaaccctctaaccatatggtggttcctccagcaaccaaccttatcttctgggtccaggcaagagttgcctcattggcataaactcaagtgtgatggaaaagggctcatgatgaagaacgaaagatgccctctcacccctgtctcttggaaaattccaaggttttaggagctctatgccaggaactaggggaaagaccaaatacgtatttcttattttatcacaacgtcacaggatgagacattccccactcaagaaagtgtatgtgaagttctgccttgaagagagtcaaatgtccaaaacgtagccggaaattggaagatgcaagaagcatcaggagagaagagggtctctgggggacagcgactggggagggcttgaggcaggactccacgcttattcctgtctgaaccgccggagtgtggggggacggtgggggcagagggaaaggccagggactgtcgtcaggaacatgcgcttggcaggaaagcacacattctattaggttggtgcacaagtcacggcagaacagcagttttgcaccaacctaatgctttacgaaacacaaaatcacccacgtcaaaatgctccataaatggcatcagacttggccgggcgcagtggctcacgcctgtaatcccagcactttgggaggctgaggcgggtatatcaggaggtcaggagttcgagacaaggttggccaacaaggtgaaaccacatctctactaaaaatagaaaaaattagctgggcatggtggcatgtgcctataatcccagctactctggaggctgaggcaggagaatcgcttgaaccggggaggtggaggttgcagtgaggcgagattgtgccattgcactccagcctgggtgacagggcgagactgtctaaaaaaaaaaaaaagaaaaaaaagaaaaaaaattgcctcagtaagtctgaagaagttgcaatgaaacttctttcaaagttcggtcttgcaaaggtttgtttcgatctaatgtaagcagcatttaaatggatacagcctttctgacactaaacaaatgaaaaaaaaagggcctgcttttctgactgtttcctttccccctgttcttcccaatgacacgtgcatccgtgaatgctttcacattgcacaagatccaaaccaccacacaaaagcacacgaagtcccttccccacttggcacagtccctcccgaccctctgcagaggcatcagctcagcgcctggctgtgcatcctccctgtgttttccaagtttttcagaaaaaccttgacattttagtaaatgttaaggctaagaattgggaagtttctctgtaagagaaggggaagtgttcttgctctttacagcatttcaccccccaaacgggaagcatcctctaaattgctgatctagtgctcagccacttctttcaggctcttctgcatttaccatgaaaatagacttttcctggaaaaaaacaccccacacccctttaggggcgaaggaactccactaccatttactaagagatattagagctgtgtttgtcaggatactgaagtccaaacttcagggctccatccttacactgtcccttcaaagaccctgtctctaattttgtatttctttctttctttctttcgttttgagacggagtcttgctcttgtcgcccaggctggagtgcagtggtgcgatctcggcttactgcatcctctgcctcccgagttcaagtgattctgctgcctcagcctcctgagtagctgggattacaggtgcccaccatcacacctggctaatttttgtacttcagtagagatggggtttcaccatgttggccaggctgctctcgaactcctgacctcaggtgatccgcccaccttggcctcccaaagtgcggggattacaggcgtgagccaccgcgcccggcctaattttgtatttcttattctgtattcttttccttaaaaaaccttttgcccaaattgtatcaacttcaataccccaacgctggacccctccctagatacagtcataaagcaaatgacacgttagaccacgtgctccgctaagaacatagaacctctggcctgggtgatacttggtgtttctgaagaagcttttcctggggtggaggaggaggaggaggaggaggaggaagaccctttgagctttaaaatgcccaggagccatttcctgtaatgggtggatgcaaagaagtaaatgatggggtaatgccacagttcatgttcatgagggccacggtggcctgaagggacagtaagaaagccctccgctcggcacaggatggcaggtggagcatccctctcgccatgaactgcttgatgttgaggtggtaggggctgaagcagaccaccacggccaccagcatcagcagcgtaagcaggcagcctcgccagtggcgtcctttcctgctggtcactgggtcctcccgggctgtcccgccggtggcgtcctttcccgctggtcactgggtcctctcgggctgtcctgccggtggtgtcctttcccgctggtcactgggtcctcctgggctgccccgccggtggcgtcctttcctgttggtcactgggtcctcctgggctgccccgccggtggtgtcctttcccgctggtcactgggttctcccagctgtgctgcacagcttccaggtgatcttcatatagcaggacaggatgatccccactggcccacagaagccaatggcaaaggccaccaggaccatgaggggcagcccgaggactgactccatgctgctgtactccatgcaggccagcttgcccaccagcggcttggtcatgggcatcaagagcaagggcatcgtctgcagcagcaccaaggtccagatggccacgcagaccagcctggcgcggccagccgtgcggaggcgcgggccccagtgggcacagaccacagctgggtaatggtccacgctcacacaggccatgaggtagaccccccgtaggtgtcggtgtagagcacaaacgccgtcagcctgcagagccccttgccgaaaggccagctggagcccagcacataacacaccacccttcccggtaaggccacggtgaacagcaggtcagacacagccaggtgcaccaggtagatgcctgtgcagttgatcttcctgctcttttgacaggtaaggcaaagggcaaggatgtttcccagggcactgaagaccaggagggctgtgtagaacagagagcgtcatgcgggccactggggccaggaggtgaggacggcaagagctggcattgccaggaagactactcacgccagcagtgccggaagccatctcacgtggctgcctggggaggaaaaaagaaaaaaaaaacactgtatctgtggggttatgcctctggaattgtaataatgaatagttttgctgaggcaacatgcacaagtataataaaacatgtctttttcagtaagctttttgttgaagtgcaacatactgttctggttactatggctgtgtaacaaattaccccaaaacggcaactggaaacatagttttatcatgtttgtggattctgtgggtcaggatattgaagagggcacagtgggaatgatttttctctgctccctaatcttggaggtctctgctgaaaaggatcaacagctgggggttactctggggcacgggttggggcctcctggaagcgactttgctcccgtgtgtggctgttgaagctgactgctggctggaacctcggctggggctgtccacgggagcatctgcctatggcttctcccagcatgccagcctcagggtaatcagacttctgatacgacagctcgaggcactgaaagagagtgtcccagcaaacaggacagaagctgcatgtgttaaccacgtcttttattttctgtattctgatgctttaacatttggggaccttgctgactgtggagggactgccccttcccgggttagccaattcctagagacagtaaacaactcacccatgaacacgctcttcagttcttcaaatgcaaacctaccaatccagagtccttagcttccacgggctccatttacagctctcacacaccaggacactatccacctgccctaaacaccccagggccaggtaccacacaaatggggacagtcctcatgtctcagagcttgctgaaatgattcaaaccacccaatcttaagcctgtgtaccctaaaaccactcttgcccacattttcccctgctcccttcacctcctgaccaaccctatgtctccccggtggccctgcgtgatggggcgtgccctcctcttgggatctgtgagtagcaaactgtccttcaatggcagttatctgctgacctgttggccttcttgaacctcggcttttctttttctttttttgagacaaagtcttgctctgtcgcccaggctggagtgcagtggagtgatcctggctcactgtaacctccacctcctcggttcaagcaattctcatgcctcagcctcctaagtagtagagatggggtttcaccatgactcctgacctcaagtgattcgcctgcctcggcctcccaaagtcctgggattataggcgtgagccacagtaccggaccccagattttctattaatacactctattctaaaacactgcctcaccttttctaacctagtcctgaagtgtcatatcatcacttccagtgccttctatcacttacaagcaagtcacaagctcatctagaatcaagatagtacaggggcatggggggagaatagcctccacttctccatgggagaaaagtagaagaatttggagcctttttttttttttttttttttttgcttttgagatggagtttcactctgtcacccaggctggagtgcagtggtgagatcttggctcactgcagcctccacctcctcctgggttcaagtgattctcctgcctcagcctcccgggtagctgggattacaggcacgcaccaccattcctggctaatttttgtatttttagtggagacagggtttccccatgttggtcatgctggtcttgaactcctgaccttaggtgatctgcccacttcagcctgctaaattgctgggatcacaggcatgagtcaccgcacctggcctacagccattttttaaaccataacacatacatagaaaaatgggtgcagatcataaaagcacagcttgtcgattttcacaaagtgaactcacccatgtgatcggcacccagattaggaagcacaacctcacagcctcccagaaactctcctctgccctcccaacctccaccttcactcaagcgtggcccctctcctaacttctaaaatcacaactcagttttgcatgcttttgacccttaaataaatgaaaccatgctatacgatcttatgtgtgtcgcttcttgggttcaatgttagtttgtgagcatcacctgcattgttgggtgtagttgtagtttgctcattctcattgctgaatggtattccattgtatttgcatttgaagaactgaatagcgtgttcatgggtgagttgtttactgtctctaggaattggctaacccgggaaggggcagtccctccacagtcagcaaggtccccaaatgttaaagcatcagaatacagaaaataaaagacgtggttaacacatgcagcttctgtcctgtttgctgggacactctttttcagcgcctcaagctgtcgtatcagaagtctgattaccctgaggctggcatgctgggagaagccataggcagatgctcccgtggacagccccagccgaggttccagccagcagtcagcttcaacagccacacacgggagcaaagtcacttccaggaggccccaacccgtgcctcagagttacccccagctgttgatccttctcagcggagacttccaaggtcagggagcagagaaaaatcattcccactgtgccctcttcaatatcctgacccacagaatccacaaacatgataaaactatgtttccagttgccgttttggggtaatttgttacacagccacagtaactagaacagtatgttggacttcaacaaaaagcttactgacaaagacatgttttacacagccatggtaactagaagagcacagagcaccaccatttatttatccgttctactgttgctgcgtggtgcagttgctgccagttgggataattacacacagtcctgctctttatgtactttatgtgtttggtgaaacttgtctacatgttgctgagcatacagctgggagtggaactgctgggtcacaggctctgcatgtttctacttttagtaggtcctggcaaacagttggtcaaagtagctgttcttaatcgttccagcagtgtgggggcactcccgtggctcctcttcctcaccaccacttggtgttgtcagtctttttcaggttagctgttttggtgggttgtggttttaacagcagttccctgatcactactgatgctggtcaccttttcacatgtttattggccatgtggtaatctttctgtatgcctgtacaaattgtatgcccctttttctattgggttgtttgttgaaaacgtgtacatattttcctatttcaaatgcacttttcccagtctgctaagtaacctagccttgccttctttttacccacctccatttctctcagctgcattctgatcatcctttaagccttaatttccaaactgtgacaaaaagaagagtgggagtgggtctatgcagtgctctgtgcacagcaggttggggtcacgtgatggtctacgtggtgcacacataggcaccaaagtgtacagagggtgtacagctcgcccaaggaccactgtagctcatgcagccagcactgagatccaggttctgaatggcttacttctgcagtcagatgctgacttgaagggcaccaggtccatgatcccctaaacctccctcgattcaggacatagctgtcccctcctgaacaatttgaggctggctggtggggatcctgctgtagattgtgcctcatgtcaacccaggtatagacatctctgtctcatctctgcaaatagagaaggagcttctattcaaatggaaaggaagggaagcaaggctgaaaggcagagagaggagcaccagaaagccctttgaacctcaggatgggtggatggatggatgcatagatggatgaatagatagagacagagatgctagattagataggcaggtggacagatatgacagattacttagatatagagatgatagggatgctagagatgccaggtggctgatagatagatggatatagagataatagatgaatagagggacagaggatggatggatagatagagagatagattggatagatagatgataagtagatagatgatagagagatatagagatgatagattacataatggatagatgaatagagggatagaggatgaatgaatccatagattagatagatagatagatagataatgtcagatggatatagaggtgatagattagataatggatagacgaatagagagatagatgggtgggtggatagataaagataggtgaagatagagatgatatatcgacagaggtagagctagtcatgcactctgaaaattgaatttatacatatttttaactttatcaagaattccccaagtgctgtgccagctactggttgcatttggaagatgcaaaagcatggtctcctactgcctgcggtagagtgttaggacctgtttgagaagagaagacgtgcaggggaaacatcgctaaagcaaagctgcggctagagctgttgaggttttgctttcttctgagtttggccctgataaaatggcaacacagtaagaaatatgtaaaaacccacgcaatgatccttttgctactttgttttatattgttctttcttttacagattacactcaagcaagagttttttttctagcattctaaccccttaactaagtaaacagacatgtcctggagttggtgagagaagccacctctgccctgtcccaccttcagttcatgagctgctcccagggaaggagagtgcagagaacaaaccgaaggaatggcaagatctcggagcacttggcctagctcaagagtcaaggacagcccccaggtggctcctgcctgccctgggaaagcagccaggggaagcgatttcccaggaccaaagcagcccagcttacaggggaggggccggtgagggacgctgggcacaggcctgccatctcctctgtctgggccagccccaaaccccaaactgcactgcctacacacacacacacacacacacacacacacacacacaccattctttttgaccaaactttagtaaggcttccctaagccttcttctttgggctttcccaactttgggcgtccatacggaaccacccagccttgatctctggtcacctctcttatctggtcaaattcctcacccccgccctcgacatcagatcaccctggctttcagcaggaatcggcttaggtcatcttaacaagaaccctcatgtttcctttcagtaatttcccatcccccaactctgctccttggggatgagccccattttcctcgtccttttgggaatggagccccgctctgtcctgaggacttttctccaattgcaagagttcctgagcaagatctgcgtccaccgctccaactgctgtcggctccagttttctttaataacacccacacccactcacacacgtgcacacacccatttacacacatacgtgcacatgcacacccactcaccctacatacccaaacacatgcacactcacacacccactctacacacatgcacaaccacacacacatgcacacaccctacacacccactcacacacatgcatacaccctacatacccactcacatgcacacaccctacacacccactcacatgcacacattcaccctacacacccactcacacaatgcactcacacacccattcacacgtgtgaaaacacacccacagatgtgcacacacacccactcacacatgcacacacttccccacccatacacatatgcacacattcacacatgtgcacacatacccattcacacacttgtactcaccatgcagacatgtgcacacacctactcacactccactcacatgcttgcacacccactcatatactcacacgtgtatactaacacacacctgcacttgcatacataacatttccactcgcttacactcacacacatgctcatgcacacacacatccactcattcacacatacccactcacacgtgcacacacactacacacacccatcctcacaggtgtgtgcacacactatatattcgcacactcacacagacacacacactccatacacaccccacatatgcacacatgacacacacttattcacaaacatgcacacatatatacacactatacacacacccactcacacccatgcacatgcactccacccacacacacccattcacacacacactcattcactcacatacatgcacactcacacccactttacacaccaacacacattcaaacgtgcacacacttgcacacccactcacgcatattcactcacacacactgacgcttctcacacacttgctcacacactcaaactcactctgtggagaagtgacccgggagccccaggggtggggcaggccaaccagcccgcactgaagtgaccgctctttggaagagcacacagactccaaggccctctcgtgagtttcaccagctcccaaccacgagagaaggttcctcttcctcctccccttctttcctgaacaacttgctggccgagcaaggtgggaggctgtggggaaggggcctgaggcctgagccgacctagggtagctcaggtggtgcgaaccacaggtcccctcaccttctagaaccgacttgaccaggcacagagccgctatctggtgcctttggaaagttgtgtgttcattttttaatttgttcaggcctcacagggcaaagagatgggactggctcctgacgcacccccaacccttggcaatgggccccccttcctgatttttcaggggcctcttccccagggcacatctcccccagcctcagctctgcctggccctcaggaattccagcctcagggttcaccgcgtgctgtggctccctgcctcagccggggtgcctcgtgccccctttgctgccaggacaccgcactagcctcgaggcccagctaagggctacctcctctctgaagcctccccggctcagcagcatttgtgagcccctccacccttggcgcttgcttggtacttggtggggactgagcctccgcagtgactcacaggcctctttcacgcctctgcacgctcagcaaacccttagcccttgaggggctggcctcgtcttcttccttttcttggtatttggcacaaaacaagtgcccaggatgctgggccctgctggaagccacaaaaaagtcacatccataccccaaggagggggtggcaggtgctgtcaccactgctgtgagtctggggaggtcagcagggttggacagccacatagacccaaagcaggagccatcgagagaggccaagccgctaagcctcacaccttaatcctagctacctgtcctcctgctggtccatcccattcctttgctcattgatgtcggtagacatgaggacgcagggcactgacagctcccggactgtgctgcgcgggctgtggccccacacctgcccaaaggtgagctcctctgcaccccgtgttctgcgtctccaccccatggggtctctccccacaagcacaagcaccccacccttcccccatcccatctgctctcaggaaaggacctaacatcagtcatttgtgcctttatctgaagttaccctgttacaaggtcctttgccttctgaggctcacagtgctgattgcagcgtgccaggcgtgcctccgctcagagatgatcaatcagtgcagtcatgaagggggagaattaccaaaagcgcttccagaagtgttctaaaattctcccccgggggtgacacagcaaaggtagcctggtcctatcggtggctggaggctgacgctggcctctgctccttctggcctgacagcagtggccgggatcctggagcgtccacgcaggttagggcgtgctctacaccccgcgtaggctagggcgtgctctacaccgatgacgggtggaagcagagtgagctgcagctcaccaggccatgggggcagagcagctgcaatctgagccgttttcttggagcccaagcacctttcccatgccctgggaagaccccctggcccgcttacctcacccaccaaggacatgtgcaaggaggccagcagaggcctgtgcagcagccagcctgcttcctaggtggctccaaagcctcgaagggtgtcccctgcacgctgtcctctgcagaaacggaatctgttcatggcacaaaactcgacactcttcctccctttacacccctgctggaaaaaaaaaaagagagagagagagagaaaaaacacccagggtgccagtcaaggtgatctccccgccacaggatgcctgcgcacagcccccaccatcccctagagaagagaggaggaggaaagtcaccccaggaggccaatttcctttcagctccatttccctgcacacccctcaggctgggattcagaccatagatgtgacagtgaagccaccagagtcaggaaattcaaaagcagccaccattctccccgcactggggcagcgagcaagggaaagcaagaaacgccccctggggacccagacactctcagctccgtgtgtgaaggtggaggggagaccgccctggctctggatttcctgggttttgtgacccaggcaaggtgccttaatggggcctgaaaggtgcatttgcagcccaggcaggcagcgctccaagagcagcagttagcgggggctgggcagcgggactgcaggttaaacccacccctccccagcagggaaaggctgcgggctgaggccaccgggccaccgctctttttctcctctcatttcaaagggcaagaatggttttccctgccacatcactggctaataaatgaggcatcgagcagctcctttgattaagactatgcggccctcactacgtcattgtcatcattgacacggtaagtgtgcctgttctttctgaggctgcctgtgaacccagcgtgaagcccaccccagtcagcagccagctgtccagcctaggggaacagctgcccccagtccactgtgtcccggcttcccctagtctagaatgtggtcaacacactcccctacctggcctcccattgacagaggctatgggacccaattttccccatatgtaaatcgggccttcaaatatgcccccaaaactccaggcctgttggagataacttagatgaaaaggtcctatcttatcatacacctttaccataaacttcccctcctgccacccccagaaggaagagctgaggcagtttccaaaggtgcctgacttgtccacagaccacaagccccaggagaaacgtcctgggcgtcctcacaacatttaggattaaatgttaaaaaaaaaaaaaagagacctagaaggcccccacaaaagggcaagaaattatagaataccacccacacggggtttattcctgattcactcaataagcatttactgaggcacagctgggcgcagccacgggctctaagttgactgtgtacaagtgatggagggctgcaacccacacacaggagggcctggggtctgccccgccccgtgccaagttatcatctctgttgcccatcagggaccttgtctaagcgggagctgcagcccccacaggcccagcgaacctgacagaaccagaccctgccccaagttctgtggatccccccaccactcttgcgggtccttccttctgtgtttatcgctgaggccacgcactgaatgtcacattgtcttgggttattgtctaattgtttcctgggcagagacatttcatttcagccagctgagttccatggggtagaaacggcagcaggctcttatataaatcatctgctggggtggaagagattatccagcccgtggtgggggccagaattcaggggggctgtgaggctggatgggaaaatgatgccatctttgtttccattaggccccagctgaaatgtgatgtttcagttgtggacacgagtggccagccacagtggcgggagagtgcctgagacttgggtgctgtttgttagaaaccacagcaagtcttttcatcgcccagtgcaggtgatccaggtaccttaaggcattatttatgctcgtcactaccttgaaattacagtcactattagacatgtcagtagtgaataaagaagtgtgtaggacattatattaaaaatctgcttttctttggccaggcgtggtagctcatgcctgtaatcccaacactttgggaggctgaggcagaaggattgcttgaatccaggagttcgaaactagcctgggcaacatagcgagagtttgtctacaaaaattaaaaaattagacaggtatggtggtgcatgcctgtagtcccagctactctggaggctgaggtgggaggatcacttgagcttgggaggtcaaggctgcagtgagctgtgactgtaccactgcattccagcctgggtgacagggagagaccccccatctcaaaaaaaaaagtacttttaaacattttgatcactatattttaatatgaaaggtttcttttcatcttaggtgttttactttatacatttaaaaaccaggactctgggaaggggtccacaggcttcagccaaaagggttgtggctcaagaaaaggtgaaggaccctcgatctagtctaaccattttgccttctaagtggggacactgaggcatgggatgtttccaaagcctcccagcttatccatcagacttgattagagcctcagctgcctgaaaccccctccgcttcagatgcagtggccttccatccctgcactccacaccctgagcccgacatgtgacttcctgacccactgactaccctggttcctcctccaggtgcttcatcagcccccttcatcttagtccatctgtcctcttccacctggccctggacaagggtcaatagagcacagtggtttcctgttcactcaggtcaggaaaccaatggcaagaaaagtgacaacgatggcacccatgattgaggacctcctctgtgtcagacactcctagctttacttatttacacctcactttatccgcaaagaggcatcattatccccatttcacagatgaataaaatgaggcttagaggagttaagtgatttgttcaaggccaactgcatggagatacgggtcctccaggtgggttcagttacaaggcagtcgaagctggggctggagtggggaggtggccgaatataggctctcccagatctgaaggatgcagagactttgggccagtgttcctgaggacaggtagagcaggggctgcggacagtgcaactgtggctgagcccacctaccggctgctacccttgaagtggcttcacaaggtactgatttctgcctcgctctgtgcctgccccgggaaagcggagctggcaccgctatcgcatctctgtggtttgcacgtctgtgttcccagagctgcttcagccccacacgtgggcagagcagcagtgtggttgagctgtccaggtgctgccgtttttgctttttctttcttttttaatgatgaagaggaaaaggagtgtggggtgggcacagatgtacttgttcctctttttttacatttaatcattgacaggactgctgacgctggagtaacacactcactcacccatgtagtgctcaccaagtgtctacactatgctgacctcccagaaccacctaggtcttcggcactgacagaccctcccttctagcaaagtagacaggtagacaggtgagagctctatggggtgacaggcacgccgcagagatagcaacttcagggtgccaaggaacacacaggaggaggctcttcctggtcccaggtggccgaggaggtttcccagaggtcaagcttgaggatgagacaatctgcccaacccctccagctgctgacacagagggagggagagcacagggaatggtgtgccggaccgttactctcccacccagaggtttcttgtcactttctctcatatttccttgaacaacacaagtcacgtggccacacctaacttcaagaggtggaatcctggtggggcacagtggctcacgcctataatcccagcaccttgggaggccgaggcaggtggatcacctgaggtcaggagttcgagaccagactggccaacatggtgaaaccccgtctctactaaaaatacaaaaattagtcgggcttggtagtgcatgcctgtactcccagctactcaggaggctgaggcaggagaatcgcttgaacctgggaggcggaggttgcagtgagctgagatggtgccactgcactccagcctgggtgacaaagcaagactccatctcaaaaaaaaaaaaaaaaaaaaaaaaggtggaatcctgccgtgtgctgggagcagcacaagcagtgtggaccacactacaaatgtgtcctctccagccccaaactcatgtggattcgcccatccccacagagcacctacccacggccatcctgcccgccccaccttgctcttcctcatgtgccatgcccgcccccgccgtcaccccagttttcggtcctcattcatcacctctgctgcattctcgtggctgtggcctcagcccagtcctcactgtctctctccaggacagccacagcttcttgcttcctggtctccgatcttaattctccaatccagtttatattctacatcccactgaggattgcagaatgagtttgctaaaggcacaactgattgtgttattcgctacctaaaatcctttgagggtctttaggacaggattcgatttccatgacctgggatatgctgttctctctgtccagaatgcattttccctccccatgaaccctcatcaactctgcttaactccttctcacacaagactcagccctcctccaggcagtcttccttggctgccccacaccctgcatctcattttggtgctccccttctagtccccaaatgtctctatattagtgtacaccataaatgactagtgtctgtcagactgggagctgtttagggaagtgacaaagtctcaatcatcaactcctagggcctccacaggggtcagcctggtgggtgcgtgctgaatgattgctgaatgcagggccagtggtagttactgttccaaacctgccctccacagcctgtcttcccacatcatccagagacttcttcccacaggacacatcaagcatctgcttagctccctgtgctggccactggggagggggtgtgaaggcacacccatggcctgcaaggagcttaaatgttgaggggaaagttgagaaacccaaaagtcactgggaaccacatggcactcaacgtggggacgacagctggggatgagacaccacccttatgtcttcccttggcctcatagagtcaccacatagaggaacctgatagaggctcctgtctaatccgaccaggttgcagatgaggatgctgagacccagagaggtgggctgagtcactgcggtcactcaggtagccaccaacgtcactgcaacccagaccagcctcagacctccacagcaaatgctctttaggaaaaagcagacgtgggcaccttccacttctatgcaacatgctgtgacgtaagacaaccctcaaatatctcaaaccagcggtgtttttctccctgcactcttccttcaagaggaagttgcaatttaattgaattatttcttctttctctcctttagtcaaaaattgtgatttaagcaccttttatgtttaagccaccctgctggccaccaggtgataatccaagagaaacaaaaccaccctcacttcagagcttggggacaagacacatgtcccttacatcagcgaaccaagatcgggagggaaatgccgaaggagtggttcaagcagttggcaaaaattttacaagaaaatgccccaaggagctatttagtcagaaaagcaacttctggggagatccctggattcaacacaatcccctgtcctgaccatccccgacctgtgatcctactgtgcggacagcttcagagcctgaaaggcgcagagtcggtaacattaaatgagagtctcttcacccggtcagacttcgttagggccaagctcttcgagcaagatggaggtgccgtccttccccagtgcctgactcagttgccagcacccagtgtgtgcactgggtgaacgcagacactcttctttctacagttcccatggcaggggtcagggcccatggagtatgatggggttcaggccacgctatcccaaaacatggcatcttggcatttaagaaaacaggaggagcaagaaggtcactcctacccccaccatgcccctccccacccccgaagcagcttatagaccctcgtttgaaagttcccctccacacacccagaagaaaggaacatccttacctctgaaggcaccagggtcacagggaggagcctgaacaaacaagccttgctaagtcccccaggggttccccattcgatcacacccttgtcttcctccaatcttatttctccaaaatcatccactcttcatctaacctaagcatggaaaagtcacaggtctctctgtttctttaggtttcttcaatttcctttttcattttttctttctgagatggagtctcactctgttgcccaggctggagtgcagtggcacaatctcagctcactgcaacctctgcctcctgggctcaagcaattctcttgcctcagcctcctgagtagctgggatgacaggtgtgcaccaccatgaccagctaatttttgtatttttagtagagacgggttttcaccatgttggccaggctggtctcgaactcctgacctcaagtcctcccaccttggcctcccaaagcgcttacaggatcataggcgtgagccaccatgcctggtcctggaaggaggatcttatgatctgttttctggtgaagtaggtcagaggattcctttatggccagctgtcacatagaagggtgggggaagggtctcatgatcatctcgtttctttgttttatcagttgccaaggtgccatgttttggggtatcaggcactgagcccaacaggtggaactcatctacattggtaacagttgtagttcattcactctcattgttatatactattcatttgtttggctgtaccaacacttacacattcatgctcttttattttttctttttcttttttctttctttctttctttttttttttttgagacaggctcactccgtcacccaggctggagcacagtggcatgaacatggctcactgcagccttgacctcgaaggctcaagtgattctctcacctcagcccctcaagtagctgggaccagaggtgcatgccactatgcctggaaaattttgtattttttggtagagacagcgttacgccatgttggccaggcaggtctcaaacttctgagctcaggcaatctgccagcttcagcctcccaaagtgttgggattacagttattctccttttgataaacatgagttgtatttcatgcggggctattacaaacagtgctgctgtgaacatttctgtacacatcatttggtgaacttacatactcattttctttaggatgtacccagattggggaatgctgggccacagggtattttggtttagcttcagttgaaactatccttggttgattttttaaaaagaaaacattttaaaacttgatttttttaaaaactgaaaataaaatttaaaatgatcaatgttttgtcaaagcggcacttttcctctgtgattgaacaattaggtttttaaaaataattggaggagaacttaaatatgtgtagtctggtatttttcaaccattgggttaaaatccacaattagttggtttaaaaaaaaaaactgttttgggccaggcaaggtggctcatgcctgtaatcccagtactttgggaggccaaagcaggaggatcccttgagctcaggagtttgagaccagcctgggcaacacagtgagaccccatctctacaaataatttaaaaattggctgagtgtggtggtgcatgcctgtagtcctagctactcaggaggctgaggctggaagattgcttgagcctgggagatggaggctgcagtgagccatgactgccactgcactccagcctgggtgacagacagagcaggaccctgtctcaagaaaaaaaaattgttttaattgtgataaaatatacataaaatttactactttaataatttattgtgggtttcgagatcattttagtgggccatgatcagaactttttaaaaatgagatagaagagaaaaggaaacagaacagaaaagaaaatacatcgtaataaggacaaatactgtttcataagacttctgtttccgttgtgtgtgctctgtgttttaaaagtttgtaaaacacgggtctagtccaactcttttaatttacagagagggaaatatactcagagacagaagtgatatcccaaacagagcttgaactagaacatggcatcaggcttccaattcagagtctgatattttccaactcccatctcaccatctttgctgttgatctctccaaactcacgtgctagatcaggctagaccttcatggccccatattttcttggtggaaaagggtctcctgttccctgccccttgagttagtcccagacaggctgcagagaggagccaggactcagccagcaccttctgaacgccactgtgataacccaaggatgccccatttgaccttgtctactctggggtcaaccaggaatagtacaaacctagatcttaacggaagagaggggaaaggacctgtggtttgacatttttcagaatttttctcttctgtgtgtttcaagagcacttttctcgcggagctcaagagaggaagcgctataaatagagggcctggaggaggggcggccgcgggaggaagaagtt

SEQ ID NO: 391 - DNA, 83393 bp, Homo sapiens
cccaagggatagagctagggtcaccccaccatacactcatcatagtcaaaccactggggagaatcagaaactcgggcaaagcacacactccctgcaagcagccaagaatctcgcatgaccagtctggtcctctggatctccacatgtggccacgtgtggcgcgtggcatcccctccaccccaatgcctggtatggtcgacctggaaatgacatctaggaaactgagaatggaaagccatgtgggggcagcgctaagcttttttttttctttttctttttttgagacggagtcttgctctgttgcccaggctggagtacagtggtgcaatctcggctcgctcttgggttcaagcagttctcctgtctcagcctcctgagcagctgggactacaggcacctgccaccgcgtccgacgaatttttgtatttttagtagagatggggtttcatcatcttggccaggctggtctcaaattcctgacctcgtgatccacccgcctcagcctcccaaagtgctgggattacgggcgtgagccactgcgcccaaccagccctaagcttttttttttttttttgagacatagtcttgctctgtccccaggcaggagtgcagtggcaccatctcagctcactgcaaccttcgcctcccgggtccaagcgattctcctgcctcagcctcccaagtagctaggattacaggcatgcaccacaacacccagctaatttttgtattttcagtagagacgggggtttcaccatgttggccaggatggtctcaaatctcctgacctcatgatcacccgccttggcctcccaaagtgctgggattacagatgtgagccaccgtgcccggcccctaagctcaaagagcttgtgagatagaacctcccccttccccggtccttgcaaccccctaggcagtaaagtaccataaaaagggaaaaaccggagtggtggctcatgcctataaccccagcactttgggaggccgaggcaggcggatcacttgaggtcaggagtttgagaccagcttggccaacatgtgaaacacaaactctactaaaaatacaaaaattagctaggtgcagtggctcacacttgtaatcacagctattcgggaggctgaggcaagagtattgcttgaaaccgggaggcagaggttgcagtgagccaagatcgcgccactgcactccagcctcagcctgggcaacagagcgagactctgtctcaaaaaaaaaaaaagggaaagaagttgaggtcaaggaagaccttgaggctatgcaattagggagctgaaatctcctagggaaggtagcttcagggaagggtgagatggcaggaatcctctcctcataaaagcaagtaatttgccatctggcagccttgactccaagtttctggagagctgggaccaggccaggtgaatgcctgctttctttctcgggaaaagaaaaaagggggttctcaggtgtgtctccctggggaggctgcccacaaggaaggggaggctggggaagttagaaaaagtctcccacctgtgaagcagattacctgcaagccaagctctgggttggtgatcaaatcagacctctctgccggcccaggcctgttcccaggcccacggtgggccttgctgagcacagcggctgctcagctgtttccagactcaggatgaagcctggggagggcttggagctgcttcctctttctttttttttttgagatggagtttcgccctgtcacccaggctggagtgcaatgggacgatctcagctcaccacaacctctgcctcctgggtgcaagcaattctcctgcctcagcctcccaagtagctgggactacaggtatgcgccaccacacccggtgtagagacggggtttgagacgggtttctccacgttggtcaggctggtctccaacccccgatctcaggtgatccacccacgtcggcctcccaaagtgctaggattacaggagtgagccactgcgcccggcctgctgcttcctcctcctcagggagacgccacagctctgcggcaagcaatccaccaggcaccagatccccagatacctgcccttcagggagaaatagcctgggatacagagaggcccagaggggagctctggctggacttggcttctcagcgtggggtctgggttcacaggtttgcttctctgctttgtggggaactggttggaggcttgtgcaagcctcttcacctctcagggtttcaggcccccccaactccttcccgccttgtccttttttcttttttaaaaaaggaagtaaagtacagtgggaaacgggccaagctggcagcttgagagatccaagtgcccgccccccgacccgcaaccgtgggaaggggaaccatcttgctcttggccaatcctgcctctctgagcagggatgcagctgggggagtttctggagataggatcaaattctttagaaagggagaaggggaaaggggtctggagaaaggcagcctgggttgggggaagtgaatgacaagaatgaggggggcaaaggccttggaggtgaggggggcagggggttaggcgccagggaggacagaggacccattgtgcggcctggaaccggggccagagggctttgcccttcgcctccctcccgcggggccttccagagccaggaggggagctggggcccggaggcgttggataaagagcccgtgccccgcctccccttgccaactcagtttgcagtcaaccccgcccccgcccgctccgcggactcaaggctggtggtagtgggcctggaggcgcaggatccgacctttctggggccccaggaggaaaaaaaaaggggggaccctgaaccaggtgggctttatcaccacgaactcacagtgcttccctgtgcctcagtttcccctcttcagactctatggctaatgacagagcttttcagatttggtggaaatgctctccggggcggggagcagacggggaaggctgccccagctaatctccgcagccagtaccctcgaaggctgagatctcggggagcacagcctccgattcgcgttttctaggcaccaaagtccctcgctggaggaagaggaggggaagaaggcagaggagaggggaggggcggacggatctggtcctgggctcccgcgcggagccccctcctcccacagccgccgctcgcgtccccgcagcgcatgaccgcggcactgcggctgcagggctctctcccccgcccgcgccggattcctggagcaagggggtggggggctcggaggtgcaggacccatcattccgacacgcgccgcgacgccaggagtcggggatgacgcccctgctccctcccctcgttcctgtttctcggagtttttcgacccctgagcgcgtcgctgagtcaccttcccggaacgcgctcgggacgctctggacccagcggggactgcccgggggccgcgcaaggcgaaggcgcacccgccgatacgcgcgcggagctgcggccccagggaccccgcgtcccagccagtgccccccgacccgcccggggactctcgggtcccgcccgtctgaccccccaagtgttgggaaacggggccgagctgcctgggtcctccggaagagaagacaccgcggaggcgtgccggagttcagggcgccgcccggctaattggctgcgtgctcctcctggacctgcctcttctcgactttaagaagcgatgagagaggtgtgtgggggcgggtggggccggcgggggcgcgcgagccccgcagcctcccgcaggggcttggtttctcctaactctggccctacctgggcaggtcaccaatgggccttggcaacttcttcctccgtctccgccgtaaccccccagggatctaactcgaggtgctcgcggacacgttctgtggcttgccgcgataagtgtatcacaaacacactgacaaacgcgtccctactggcctccaaagaagtgacaacttctgagcgcgtttccggcgccccttcttcacgctgagccagagggggcggggggcacgtaccacatgcttggctttccaatcccgacgggggcccccaggcccatctacactgtcaagcctcctctccggctcggagcccccggcctgtcgcctgctctacccgggacagcgcgctaggcggcctcaggctcggtagcccagctgcagcgtcgggaagttaaaaataacctccgtgggagcgcgggggaggaagaaagagggaagctggtgggcggcgggcgagacgccccggcctggagaggcgccccgggtggcgtgcgggcctcgaatttcgggtgggctagggcagagcgcgcaaaaggggcgctgcatcccggcgccgacagcacccgcgggggcgaggtcgtggcgtcgaggtgaaaccaagggtcccccgggagagcggagccgcgcgcgcccggcgctcgctccgacacgagttcgcgcggagcccgcgcctccgtctgcgctgcgcggtcgctttcgcgcgccccagacactgcgctcgcggccgggcccgggactccgcgcctcgcggcctgccgcctcagctcacccggccaggtcgcggcgccgccttctagccagacgcctaggacgagcggcgggggcgcgcttgccgcttcctaggacccgggcgggaaccagctcgtggcccggccgtgggcgcgggccgtgccggaggcggcgcgctgaggccggaggcgggcagaggccgaggccgcgccgggctcaggttccacccccgggagcgcggggcggagccaggccggcgccgaggctcagtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtgaggagctagtccgtcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacgaggccagaagccggccgaatctgagccaaggaagggggtggcaggggcgccgcgtccccaccccaggtctcccagcaaaggccgctcctctggccagggtcaattaccggggtgtttcgggcaccaagttcccacactagtgccccattgttacccgtggccccctagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactggtgagtacctctcggagggggtttcgggagcatcccctggcaggggacccccccagtcctgatagctgccggtctccctgcagagcggcggaaccacgcgcgggagctggtgcggtcggaggagctgggccgctgggacgctctggtggtcatgtctggagacgggctgatgcacgaggtgaggaccgcactgcgcggctaggcctggggcttggcgcggtgcgtcccaggctgaggccacgtgtgcttcaacaggtggtgaacgggctcatggagcggcctgactgggagaccgccatccagaagcccctgtgtagcctcccagcaggctctggcaacgcgctggcagcttccttgaaccattatgctgggtgagagcccagggccagagtaggcctgtttcccgtcagtgctcctctaccgcgggggttttcttgtctaagctcccataggctgagatcatttccatttccccttctcccttagtcctggggccctctcctggtgaccccagctgactgcttccatttgctccatctgtcacctaccagtcctgccaactccccagggaccacatggcgctttgccagctcccactccccgggaggaggaagcgggggatacatgggggctcctgtcctgccttatctgactttttccccctgcagctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgctcgtcctgtcctggtgactggggagagaatgggttctcgttctggccgggactatagaatttaatggtaatgatggccaatggtgccccctgggatgggcaatggattttactggccccaggcatagtcattctggtgggggactcaggaccagagctggttcagcctaatggtgggggggcctctaccaccctgataattatagcacctccaacctgaagcagcctcagagctcagccagctgcctgaccacacacaggatgcagctcggagctggcatgtctcagccagggccacacaagcagctagtcccagcaaatctcatcagagccccatgtggatttagcaggaaaggggaaatatctgagttaagggcattagaaaactgatgggccaggcgtggtggctcacacctgtaatcccagcactttgggaggctgaggtgggtggatcacttgagcccagaagtttgagaccagcctgggcaacatggtaaaatctcatctctacaaaatgtgcaaacattagcagggtgtggtggcggacacctgtagtcccagctacttgggaggctgaggcaggagaatcgcttgagcccgggaggttgaggctgcagtgagccgagatcgcgccattgcaccccagcctggctgggtgagacagagtgagaatgtctcaaaaacaaaaacaataaaaccactggccaccgcccccgcccccccccaaaaaaattggcaaggagcaggagacctcagaagtaaaaaatggcaatatcttgctttttttttttttttttttttttggctcactgcaacctctacctcccgggttcaagtgattcttgtgctcagcctcctgagtagctgggattacaggtgcatgccaccatgcccagctaatttttgtagttttagtagagatggggtttcaccatgttggccaggctgatcccaaacccctgacctcaagtcatctgcccgcctctgcctcccaaagtgctgggattacagtcatgagccaccacacctggtatcttacctttttaaaaggagtctgtcatccaccacaatggtctagggttctagggttctcccagcctccctcagctgtctcctttccctacctgtccctgtggaggagtgccaggcaggagtggaaagaatgtggcagggaaggatccatccaagtctaaactgggcaaccattttggcttagcgtccaggagttgtggcacctgtccaccgccaggtgctatgacgtcggctctcccagaacctggaaggagctgaactggtcagttgtaggtctctggagactacagctgctgggaggctgctctaagctggctcctgaggggcacaccaccggccaggaggaggccagaggactgctccaggacaagaagtacaaaaggcatgcaagcaggtctggcaggcagagggcagtgtgggcgggtgggggtgctgttcacagtggcccccacctggccaggaaagccaggacccactgccacatgccttccctggcaacaaacaaggtctttccttccccaggaagggtgtgtgtgagggacacaaaggcaacggagcccagatgaatggcagagggaggtttaatggtgtcaccttgtcttgctaatgagccaacacaaaaaaaaaaaaaaaaaaaaatgcaagtaaaaaaaagtttaatcacacagcactttatacagatatcgtaagcagtaggcattcacatctccacatgtacaatgcactgggaagcacagccccaccagtcactccgggtgtttctcaaacaagataccgactcggttccaaatgccacggtgtgtggtccggctccatcctcccgcagctctgctggctgggcggtcacagcacagcacaggtgtggagcccacttaaggctgacaagacgcatcatgctttggctttttttttgtctttttttctaataagagttaatatctttgcttttgagttttttttccaaccttaaatattacatacatacaccaaaaattacatagctgcaatgtgctcaacagcatcctctcggcctggagcttcacattatcaaaagcttagaaaacttgtaaacctctgggcctgtctctgggcactaggagagcccccgccggccgtccccttcggattgagcctgcagtttgtaagcgaagggctgacagtaggccttctagtccaagagagggctggctcgcttggagttcagtgagctgcacgcctgtcccagtgtgaccatgtgatgggggaggggccctagcacttgccctggccttgtgcagctgctcttgcccccagcagcctccgacagaagagcaaggcacctatagctgttgctttccctgcagctccctggtcctcaactccatgtgcatgtgtgaaggccaccacctctcctgggcgtcacccggaacctagcctggtcccaacctctcttagagagcaagttcaacaggcctgagggctataacgtggtcgacaggccatgtatagccgggagtcagtgacagcagctacaactcccaagggatagtgttgacgctggaggactagggaggacctgggtggtggtggcagcaggagggtctgggacacagggaggcttgagttgaactaaacaggttgaaagggaccaggggaattgttggcgcaacccacacttcatgcaaggcacatgtgctctcctgcgggtctgcagggaaccggcccagagagccccgcggcaggccctggaacacccgcctctgacctgagaaggggcagcaagggagcaagtgccggacattctgctggggtgacaaatggaaaatcggcaacagggttccgattttctttgccacaggggacccgcctgttgaaagctcgcttcaaaatagaaacggcagcatctcaacacacttcttgcacttcagcatcaaactcaccttggggagaagagggcagtgggtttgcagtggggacagaggggcatgggaagaggggtgattccgggggggagtgagcaggcggcggctggcctctcccacggtgatgctctttcctctgtgcctggcagctacttgtcctctgtgcactccggcatgcctgcctctagcagggcagcccggaactgcgtcaggacaccccggatgctcttgatgaaacccttggaaagtgggaagagggggaagccgatgtcagggtagccactcttctcaggtaagaagctccggtagctctttctccgcttctttggtttcacactgggtggcaccgatgcgtctggtgcggtctccgaagtctggtctgtgtggtccctgctagctgaggccaggccctgggcaccgccctctgagtctgagccctgggaggcctctcctggggctggccctccatcctcaggttcttgttggccggagtctgacagctcggctacagctgggggctctggcgagctgctggccttgggcaccccgttgggcagtgcctgggccttctccagcagggcatgggtttccagccaggactcgatacggttcaccagccgccagccaccagtgctaaagtgttgcctgatctcctgctcaaagacctcggggggccgccgcaccagctgggtcatggactgcaccacgcggatcagcgccatctcattgtaacagcgactgttttcatagccttcctgcaggcctcggtcactgtcgaagccggcttcgttgtagtatggttcatttaccaggatcagacctgtgtgggcgggacaccttccctcagtgggtgagagaggcccacaatgcaggcctaccctccacctgccagggggactatcagagtcactttcctccaccggccctcccttgtccgcacccccgcttcagcccaactgtaccttggatggagatgagcacctggagaaggctggacttgcttgtccacctctctgtcccctgaaacacacagggcaccatcaattctgttccccaggcccctatccaccagtggctcttcctccttcttggctgggggcctggccctatactcacctttccaatccaggtgcccaggaggctgacacacaccttcccattgtcatacaggttggggttcaggcggccactgcattgggagaggtagcagaagtgggggggcacggctgggtagatgttggggagctggatgtcaaacaagtagaggccatcctcgtagggggttcgagtggggcccttgatgagagctgagaagaggtcctaggtagggagggagggagggaggccaaggttggcaggggtggaagggggtgtcctacatgtggcatctgcatctgcacctgctctttcccaggacactgtgcagatcacgcaggaagagcagcacctgggactccagatgccaccagcagtggagaagctaaggacaaatctctctctgcagaacagcctggaatcttttttttttgagacagggtcttgctgtgtcccccaggctggagtacactagtgcaataatggctcactgcagcctcccaagtagccgggactacagtgtgggccaccgtgcccagatgatttttttattttgtgtacagacagggtttcactatgttgcctaggttggtctcgaactcctgggctcaagtgatccgcctgcctcggcctcccaaagtgctgggtttacagccctgagccgtcactgtgcctggcccttgcctggaatcattgaaccctggctaagagaaatactcgaagtgagtttttatcttatcaggtgtttttcctcataaatcattactttaagactgtattccagctgggcgcggtggttcgtgcctgtaatcccagcactttgggaggccgagacgggtggatcacttaaggtcaggagttcaagagcagtctggccaacgtggtgaaaccccgtctctactaaaaatacaaaaattagccaggcgtggtgatgcatgcctgcagtcccagctactcgggaggctgaggtgggagaattgcttcaacccggaggcggaggttgcagtgagccgagattgtgccattgaactctagcctgggtgacagtgcgacgctatctcaaaaaaaaaaaaagattgtattcctcagccagacgtgatggctcacacctgtaatcccagcacttttgggaggccaaggtgggaggactgcttgaggccaggaggtcaaaaccaacctgggcaacatagtgggaccctatctctacaaaaaataaaaaattagctgggcatggtggtgcatacctacagtcccagctactcaaaaagcttagatgggaggatcacttgactccaggaggctgaggctgcagtgagctatgatcacaccactgcactccagcctgggcgacagagtgagaccctgtcttttattttttggcttatgtgtttttttgagatggagtatagctctgtccccaggctggagtgcagtggtgtgatcttggctcactgcaacctctgcctcccaggttcaagcgattctctgcttcagtctcctcacgcccggctaattttttgtattttaatagagacggggtttcaccatgttggtcaggctggtctcgaactcctgaccttgtgatccgcccaccttggcctcccaaagtgctgggattacaggcgtgagccaccacgcccggccaaccctgtcttttaaaaacaaaacaaaacaattcctctaaacacctgctccaacccttatccccaacaaggcaagtagtacaagcagtttcaagctgaaaggcagttccaggctggtgaggcctggggaaggggggatggtctcacaaccagaagctgacagtgagggtttgaactccatgggggaggttgggagaccaccgctccacagacatctggaatctgtgcatctatttgcgtgcatctgtgcacacacgcgtgtgtgtgggatctcaactgacagggcaatgggcgaggtcagtgatgagctgagaagcagggaaggcagagcgctagctggggcgagggaacctctgcacatgctcttatcggtgccaccctgggagcctccagggaatgcactacttttcttctcctgagtgagatgtggggaaaacagaacaaaacaaaaaatactgtttccatcttccctcagcagagctgagacaggctagaattttcaaaaggaattttcctacaacccaagaaaaaaccaaaagcgttattaagaatctcaagcagcactgggccttaggactctgcctagccctgttccagggttgtggctactccgggcccatctcaacagcatcccgcttggctgctctcaggatcgcttggctgctctcaggatccctgctctttcttttcttactcccttccttccaggacagggccagaactggggcctcagactcagattcagagtctagcatagtgcttggctcgatgcacaggcccagtaagggactgcggagtcaacaaggtggcaggcaaacgggcttgcctgttccggaaggatgcactcagcgctgcctcagtaaacatgactcagagacactaggccccgtccacgaacagaggagtgggaaaatggaatgtggtgtggccacatgctgtcatcctattttgcaggtaaaaaggaagaaactagatcattatgaatcaacacaggttggtcttaagcaaattagagatgatgtgtacgacgacatattctgtgtgtaaacaaatcatacaaaatattatgtacttatggtgatacatgaaaatgtaaaaatatttttttagtgtataaataatgtaaaagtataaaaaaaaggtcatccgtttggaaggagacccactaaacttccaacaatcctctgggtgtgggaagaggcctatgattcggggagaaagggaagtgaggtctggtcaaaggcaactttagctcttccatttccactcaaaggatctgtaatgttctaatttttcaaaaagaaaagtaggcttgaggagtaatcataatataattaatttcaaagtaatttttttttttttgagatgaagtctcgctctgttgcccaggctggagtgcaatggtgcgatcttggctcactacaacctctgcctcccaggttcaagtgattctcctgcctcagtctcccgagtagctgggattactggcacccgccaccacatccggctaatttttgtatttttagtagagacagggtttcaccgggttggtcaggctggtctcaaacttctgacctcaggtgatccacctgcctcggcttcccgaagtgctgggattacagtcgtgagccaccgcacccggcctatttcaaagtaatttttttttttgagacagaatctcgctctgtcacccaggctggagtgcagtggcgtgatctcggctcactgcaagctccacctcccaggttcacgccattctcctgcctcagcctccagagtagctgggactacaggcgcccgcatggtggcgggagagttttttgtaattttttttttttttttagtggagacggggtttcactgtgttagccaggatggtctcgatctcctgacctcgtgatccacccacctcggcctcccaaagtgctgggattacgggtgtgagccactgcgcccggccgagaaagtaattttttaaaggagggaggaaagaaagaaccatctggcctggacacacggctgagtcagccctcacctgactgagcctgtgaccgcccctgtaaaaggtgggtgggtgagtgtcctcgcaggtgccagtcagccccggaggtttggggacccaaggttggtggcctcttgggcactgggtgcccacacagcacatctgcacctgcccatgccaagcctacttgccattctatcttcaaaagtcttgaccatgatgccctcaggcagtgaggtagccagcagcgccatctccttccgcactgtgctgaagaacttcttggcttctggaggctggaactcaattttcttaaaagaatgatttgctagaggggggaagagaatagtcagtccctcatggagaggccctggagctccatctgccaacctggctggacaggtgagcacacccacagacttcccactcgccgctgctggcctcagcactgtgaccacacagggaaatggtttgccctggggcagtagctggggtctggcgaggggactaaccaccctgcacccagatctggtgacacaaacaggagccccgagaaggcgggggaaggcgaagaccaggcaagggctgactcacagggtgcaaactccagtacggagaagacctcgcccttggcgctggtgaaggtgacgccaggcttgccgccacactgctggcacagcaccggggtttcgctgggccactcagccttcacaggtgactgcccctcgggcttgtcctccttgcgctctacgtcgggcactgcttccatcttctcctcctctacaatggccacattgtccagggtcttcttgaggttttcctgtagcttcttgatgtcatccagaaacttcttctcccgagttggcttctcaggctccacagtcggagaggtgggcgagcccgtcagcagctgctccacagtcatgttcttgaggctctccaggatcttgatggcctctttcaactcccggaagctcttgggtggcccgtccttgccagccttctccatcagcccggccatgggggcagccatggccacagccccctggacggcagctgtggctgcctcttcactgatcaccactcccttgtcctcaggggccaccggctgctccaggggtgggatggggggctcctctatcttggggtgctcgtcctccaccagcccattgtccgtctcccagctgtcactatcatcttcccattcatccgaggatgccccgctggtgctgccttctaccgaatcgtagtctgactcctcaatctcagactctatgttgtacaagtgctgggggcagaagggaagtgccagggtaagcagacaggaagtcacctccccaccactaaggaggagctctggggatccctgatccgcacagctgatggcgactgggctcatgaggccttggcaacctcattccaccctttccctgacctctgctctggcttttgcagtccctaggtctctgggagaggcccttcacctgtcccaccctccagctggacccaaagccccagccagtggtctgttccagcctctcctcctgctctgtgcacttcgtcagcatctgtccaaggcgttaggggaccttggcaggcccagtcccacacctgaaaagcgcagggtcagctaatgatgcagccaaggaggcctgtgtggggagctgggaacatatgacaagaggggacatgtagaagggccgacatatcctgctgcgttccctggaatggccgttaaggtgatggggcaagccattcccgcccccactcctgccccctgtgtggaccaggagaggagagctgggctgtgtggctccaaccaggaggcgagggaaggagagcccgtgtagcccttctgctcaggacccagcaggtggggctagaactgggtcggctctctcctttctctccttctctgttagagctttctaaaaagggtggtaggaaagtctccatctccttttaggagggaacttgcattcttcgtagcatagtgagctgacaatccaggaaaatcctggaggtttgtgaaagtctacatgcacccagagatggacgtgaagagattgctgggagaagcgaggctggtgggccaactgcaggcctgcaccaagggctgtgtggaatgcctgcctttcccctcacgctttcgctgagatctcaccaggaagacctgagagcccatcttctggctacacgcctgtggcccccggcccaagttgccatagtcacaagctcagcaggggggtcttgccagagcctcacctggggcaggatgatggtctttgagttgtcagcccacaccacctccaccttgctgctgacgtccacacgggccacctggcccaccgatggctgctgggcaaaggggacaaagtcagggggcccagctcaagctccagctccccagcccctcctgtgctctgcagtgactgacatcatgcccacctggcttgtgacaaggaacttagctcctctggtaaatgtaaccagcggcagctcaagaagcctgaccccagaagggaggcagggaaacaagtccttctgcagctgctagtgctgagcggcagcttgactctggggcagctgcccttctgaggacactgagcccagaggactttcaggtcttgtctcctagagccacctggtggcagcatcagggactgcagctggtgcacagggcagtgagcagccatccagaacttgaatttgaaggcgtacctcatcctccttgtgaggagccccatcctcagtattgccgatgcggatgacgatgtcagttgtacggaacctaaagtcagggtggtcagcaatgtcgtaaacactcacatcttcctcttctccaatcagctgtggcacaggacaggttgtcatgagctaggggtcctacacccaaccccagagcccacctgaagcaagcagtaggggctgcacacacctccacgtcgtccccactcggcctcagcttgaaccacttcaccatgcaggtacggccgatgtggtccccagactgtaccacaccgtagacagcagggtctggacagctctggactagggaaccagagaaagggaagtgactagctaagggatcccggctaaggagcccacatctcaagccagtgcagagtgcagaaccctgaccttcccccgtcttggaagtggtgagaccccttcatgagggcagtccccttctggacctcattttagctctgaccccagatccactgcccattctccacaagccccaacccgggccctcattggcgaccaccctgctggctgcccttccagagctggcactacctcgcttatctaccacgaagtctccagggcagaactcgttgttgtccaggtggtgcacagggaagaggtcgttggagcggatgttgcattccacggagccatcctgccacatcacgtcggctgaggtcatcgtggtcaccacctccactgccaccctgcgggtgcaggccagtcagcaggccatgcaaaccccaccccctccgcggaaagggcagagagtctttctgtcccttcctgtccctgtgggcttggtaacctgaaactctgaatcccaggttggcaggatgagtctctggtgcacaggaagctcacccagggttccaaggccacgcattctctgagaacaggatccacttgggagagctcaggcaaatgtggttccagaaggccaagcttaaggccaccaccatcccaccctctgcaccactcctcagtctctgctttccaccagggcctaccccaggcacctacgttgtctcgggtgggagccccggagccactacaaggcatgcagaggtgtgtgtgcgagcgcaggcacgcacaccgaggggacgcgcactctgcctggcttcacgctgacgccattggggaggggcacaactctgagtttacctgtcccctggcttgaagtctcgagtgattttattcttcttcctcttgtgtttgcgctttaagttcttgatggacaaggggatgctctttttgcgactcgtgccgctgccgctctgggaggaagtggtggagctggcagaggaggtcaccgaactggtgtcgtccgtgtcatcagcagcctcatcatctgcgtcctgctctgccgagtgcagcctgtcatctctgccttcttttagcaggaatgggggcagctgctctcctgcctcgtggggctcctctgcaccctcgtcctgcatctccactggactggcagagccatcgggcgtctcctcagggctggcagactccgcttcgctcttggttttggattcccccttcttgtctgggtcttccatggaatggtcccgggaacactgggtgtctggggagcatgacatgatccgcacaacctgcttcttcaacaggcgcttcacctgcaagggcggagcagagaggacagggctgtgaggtgcacctgggcaggcctggccctaggcatctcaggctggggggatgacagctgtatacacctgagtagccggcaagggtcatcagggctgccccccaaggcctaaagcacagactgtccttcttggccatggaaatggctcaaggccagttcctcaaatgcccaccaatccccaaccccaaggacataccttcttggccatagagccctccccctgggcgcagtttttttctggacattcccaggcaatcttggctggctctaccttggctgggaagacatacagacagcgctccccaagctgccgctgagcatggtcaaagcatccgagacgcttcaccctggttggggaagaagtgggggtgagctgggctggactcctgggaggccagcagtgttcttaagcctccccaggcatgtgaccagggcccagagccctgtcccacgcgtgcccctgggttgctggcagtaagggcatgcttacctgcctaggttttcctgggtgatgacagagggtggggggctgacgctgtccgtgccccctggacagaaactcttggtaatccatgtaactttcaactctacaacctgcacctggggatggcaggtgggacacgccagtcagggcaggctctgacagcactctctttagccagctgcccaaagcccacttgacctccagagcaggaaactgatcttcctagtgcagcaccaagtacagacacatcagagcaggccccaactgtaaccacggcccccacccaatgcccaggaccagtgtcactgctcataccagccaggggccactggaactgccacttgccaccctcccaccttgctcagcctgtacaggctgggctggggcacatctgtcttttggtcactatgaccagagcctgggttccctttatccccaaagccctttgagatcaacagggtccagatgctgaggagcggggctcaaccctcaagagcaggaaggaaaggggcagcagctcagctccagggtgtggaggtcaaggactccatctcctacccttgggcccggacccacctcttccaccaccactcggaacttgctcttggtgctgagcacgggcttgacacctgacagccactggacgctggagaagatcttggcagggccaatgagcacctggcctgggtagaagccataggaatcatcgaagaagagaccctgcgggatgtggggccaaaggaaagtccccgtgagcggtgtctccatgggtgaccatgctctccacgcctgtgcccgctggctgcccacctgcagaagcccactcacacacacgccccacacgccctaaaacaagtcctgtggctccacatcagcacttcccaaaccctgggtccgcagaggtcatctggcgcccttgttcaaacataggtgatgcattccatgctccttggtcaagggctcatactctgaggaataagactccagagagcagtggtcctgaaacctgtttgctcacgcaccccctgtatatctacttgtttgctgtgtgtgtccatgtactattgtaactaacacatcatcctgtactgagagagacaaagtggaaccttaaaggatgagaaaaaaaagctaccaaaaatgcaaataaaagttctaatactgccgggcgcggtggctcacgcctgtaatcccagcactttgggaggctgtgggcagatcacccgaggtcaagagttcgagaccagcctggccaacatggtgaaacctcatctccactaaaaatacaaaaattagacgggtgtggtggcacacgcctgtaatcccagctactcgggaggctgaggccaaagaatcacttgaacccgggaggtggaggttgcagtgagccgagatcgcaccgttgcactccagcctgggcgacagtgagactctgtctcaaaaaaaaaaaaaaaaaaaaaagttctaatactttctgcctatacccaaacttttagaccctctggcgcgcacccgccccttttctaggaaaccgctctgtttagctgggtccaggtctttgctacgaagtcctccttccagaggactgagcaatcagagaagggtgctggcctggatggagcacactaccgagtcgctgacgtgcgggcagacgtcgtagagcttggcgccatcttccgtgttcatggagcacctaaaacagagaacagaggtttggtctccaccaggggacacagtgagtaccaaaaagttgcgattctgagatgccaatgcgcccacatgccctaaatagcacaattcgtcttctaccatcaactcagcccgaggtagtacaagaaactctcccacaacgaacaagaccccaagtgccactggagtgcttgctcagcaccatcacagtgcctcaagtaaagcatcagcctctagcagatatcctcagtgaaaacgtttctccccatgccaggacagatcagaaactgagcaacagaaataggccacggcagataaggagaacggtacagggttaggccctggatgcctgcaacatctgtcactgcccttgatcaaacctgtcatcactgtccccaggaggaaacaccctcctcctcccctctttccaagaggctatccttcccaagccgatggctctctggtggtgagactctacctggcgccgttggatagcttcaggatgatctggttcttcaagtcgtagaccttccccagccagcagtcataggcaatgtagtccccatacatgaagggctgcagaccaaggaggcaggggcagtgagacacagcagacaacgttcatgtccagggcacagattcctctatgccccaccgaagacaggatgggggaggatctagacagctcactgactggaccggttggctactagccctaaacagctgctgcagcaggccctccctacaagttctaggctgcatcccagctgctcttcccagtgaggaggaagtggtggtggtggtggggctgcctggagggaacggggtgggtgatgcaggggcagagaggcctgatggcatccatggacatgggacatccatggacacaggacacctggcaaagtaggctgtggaggtggcaggcagaggaggcagccacaccactggggggtggctacatggacagtgctctgagtaaatacgttaacacatcaaggatatcgagagccaagtccctcattgttggagaaggtgcccaggtgtttactaacagaaagggagcaggaaggagaagaaggaagaggagtctgaggtgtttaggtggaagtggatctatcaggatgaactcatatattttattttactttattattattttttttagagacagggtcttgctctattgcccaggctggagtgcaatggtgtgatcttggcttaatgcaacctccatctttgggctcaagcgactctcccacctcagtcttctgagtagctgggactacaggcatgcatcaccgtgcctggccaattttttcatatattttggttgagatggggtttcgccatgttgcccaagctggtcttaaactcttgagctcaagtgatccatctgcctcagcctctcaaagtgttgggattacaggggtgagccactgcgcccgtgaactctgcctgaactcatatattttaatatacacatagagcaggtagtgacatatttagatgtgtgtatacatataatacatatgtatttcctagtgtgtcccaaaagagccaagtagcaattagcacacctagcatccagatcttgggttttaaaaataccattctctgaaaacaatgaggcttcttggagaaatggttgattctggggctggatcacaaaaagtacaagatgagcctggcacatctcatgccagaaagaaagaaagttcttaaaaaaccaacaaaaagggccatgtgagaaggacatgaaagccagcttgaaggggttcccactggctaaatctgggaccatccaagcaacagaacagataatagtagtaattaattataaccaatgaataaaacagaaatctctaagtccatactgataaaaaaaaagaatacataaatagggcagaagataaagctcttctacagagcagaatgccagctaaaagaaatgaggggaacaagggagtcatagaaccaccatttagcaacatcagagcaatggctggcgcagggggaactgtgaatggaggccaaagctggtggatttcagtttgacaaatgacaggttatagacataatctgggactacgttcccacaaaatacaatcacttaaagggggtaaatggtgagtttatggtggagagacctggtggacaccaacatgaccaggggtaaaagtgaacaaccccagcactttggctatggggtaccatgaaccagggcagagctctgcggcgggcctgccaagaacacgtgggcatgaggcaacaccaggaagacccaggctgagggtcaaattactgaatgtatcactgttcagggcatggaagacaaagaaaggctgggaagcgattccagattggagagaaaatgaagagatgacaactcaatgcaagatgtgttcctgaattgggtcctggatccgcaaagaagaaaagagtagtgttgggacaactgcatgtggtctgtggactggacagtaattatcaacgttgatttcccaatctgggggttatatggtggttgcacaggaggctgtcctcatttttggaaaacacacaagaggtgtgtgtattccggggtgggtgacagggcatcacatctatagcttgctgtcaaatgttttgggaagaaaaaagaccggagggggatctcggggaaaaggagggagggaaggtgatggagcaaacgaagtgaaatcttaacagctgaggaacctggatggagggacacaggaatttacaacttttggtaagtttgaaatcattaaaaaaataaactatttccaataatttatttttttaaagaaatgttagaggagaaaggaaaaacacttaaagataaccacactggcagcctatgctggggttggggaagggcacgtcctgacctcatgtctaaatggcttacttgaaagcagcgaaaacaaggctacaggagccagctggctgctgtgctccgccttctgacccaggaaggctgtgcttggcaagagcacggaggaggctgtagcccagaggtcgtgccgccgagagaaccagagggcccagaaaggatgatgagaagacagggccggctcacccagatgtgctgcaggtccttgctgttgacgggatagatgatgcagttggtgccgatgagcttgacggcacagtcgatgttgacgtcgatcaccgtgccacactgactgtcctgggggaggggaggagacatgcaagtcccgtggtgcagcagccctggtcaccaggggagacccagcccaggcaaccccagcgcaccccctgcagagctggccagttctcccacatgcagagtgcgaggtgggcaggctcaagtccctaaggtggctgcccccaggcccggggctggggtggggacgcaggactcacggtggatcgcatgtgccggaccacatctcggggcaccacagaacggtcctctagtttcagctgtaaaagaaaatacaggtgtgagagaatggactctgaagccaccacagaatacagttttcttccagcttctgaaggaaagcgtcacatccacactgctaagtgcacaaatcctaagcgtttggctagcagtatcttcacagaccgcacacacctccgaccagcacccagacccacaggcagagcgcgtcacgcccacaggcctcctggggcccctgtggtcactgtctcacccaccagaggcacttggcttgccggaggtagccttcctcacactgaacagtgcagctcaatgacagatcacataaggctgcactttaatgaaggatttaacagcccattctacagagagcaaaacatttgctttgcgttcaatcttttttctgccctctgcaagtgcctgccctagctgatcagtgctgagggagagtgggctgggggagaagcaggacactgggctgcggtgggtcaccctgaagcctggctatcaccggacaccatgttctaatctgggttatcctcctgaccagctgcggcctgcaccttatctgctgcgcttggagccctgcaggctgctaagtaaccctcaggatggttggctcttggagcccggccaactgcacgagcacctgattgtctctttacgcacagctggcagcggccactgcctcctgctgctccatcgcccaaaagcccaggcacgtgatgctcccaccaggccagcctgcgtcttttttagctggttcctcaaacctggggcagctcctctatggttcttcactgggtcataatcatggatgggtctctgtgtgtgtccacctccgagaccccaaaccacatggctggagagctgtttcctcaaatagccaaccagacactcctccgtggtggcctctcttgacctgggggcactgagaggtcaccaccaagaaaggagaactgagtcgccgaaaaaggaagatactggctcaaggtcacttaaatgctggcaatgacaactaaaacaaactctgctagtagaagaacgtgactcacaaaaaaaaaaaggaaagaaaagcaatgaaccccaccaccaaccagcagtgcagagagtcccatgggaactcatgagcccaagttgtttttttttttttttttttttttttgagatggagtctcgctgtgttgcccaaactggagtgcaatggcgcagtctcggctcgctgcaaccttcgcctcccaggttcaagcaattctcccgtctcaacctcccgagtaggtgggactgcaggcacgtgccaccacgcccggctaatttttgtatttttagtagagatggggcttcaccatgttggccaggctggtctcgaactcctgacctcgtgatctgcccacctcagcctcccaaagtgctgggattacaggcgtgagccactgcatccaggtatgagcctgtttcaaatgacaacttgcccagtccttaaacgcagggttcttgagtcagacacaggaacgtcaggcaaaccactcctgccgacatgtggaaggagagatgatggcagctgtctcagcatggctgaggtggagtcaccaaggcagcggaccgcaggtggcacatggtgcacggtacagagtaggtgctcagcaaggtcggcagctgtgatcactggccctgtgagctgcagggtgaagacccctgaaaggtcaggctctccttatctctgctccaagaccccaggaggctggagaggcatgctggcgtgacggtgccacttttctaaatcaaagaatattctgtgcctgtaaccctctgtgcccaaatctccactctgagatacggcatttttttgtgctgccccaccctatcttaatcccctgctcccattttagacttcaaaaagccacaattgctcccagagaagccagaagcggcaggacaggagaatccaatgcaaggggggctgcaccatgtgtggcaggagggctgcctccaccacttgggggtccctgagagagcagccaggaaaggaggagagaagaacgcagacacagacctaaatcagtgccgtcactgatgaaacaccctgttcagcctaacagcacccttgggagtgcaggggaaaccgaggtgtcaactctgaggctgaagcagaaaaaaacagctggtgaaagctggcatcatggcaaggccagaggctggcagggcaggcagtgcccagtgctcccaggagagggaggctggcagcaaatgccattcttcccgtggggtctccagacaacagcagctccacctcaccaggatgctgcctccaggggctcttctgacctttctatgacaaggagttacatttctccaaagacctgatggtgctgggagcagagtgggagcgacaaggggctgggggatggtaacatggtggctacactcccttccactgggaattagaacccaagacaacggcatgtggaaggacttaggatgacttgggaggctcttgtgactttccttcctaacttcctataccccacccatactgggcactggctttctccaaataagcccataccctcccatctgtgagccactccactgaacagttacttccaaatgtcctcctctccctgcccccgtatgcacaacctgcttcacaaagcctttcagtgcccccgtcaggaaggaaccgacgtgctcctggcgaatgcaagagctctggagtttttcgcctcatgctaaccaggtgcttcctacctggcagacagttctccaagcgtttcactgtcttcgcccatgaggtgctccacaacccatgaagcacatcactgccatgctcattttgcagatacgcaaactgagaccaagagaaaataagcaactcattcaatgtcacaagtagtggagctgggacctgaacgcaggcagtttggctccagagtccattctcttaaccaaataaaaagctcatctctccccagagctacagagacagggaaagacttctggcaggtctacacatttaaagacagtgattcttctgcttatgaaagaaagaaaaactctcttcatttctgaggcaagtggaaggcagcaatggtggccactgactgcggatgcctgctaggcacagtttgccctccacttccccttctacctccaaagagcaaatgacaggtgccagccggcctggcaggtgaacactagagggcactgtgcccactctgggaaagcaccagatttgtgaacaaaactaaaccttggaataaacccaatccctactgttaaggggtgccctgcttgtagtttaaaaaaaaattgttactaggaggggatctggggtcgggggtgaagagatttcaactgtcctcatgggctctgaaattctaaacaacctcagagttggtgagctatttattgtctaacatttcttttttttttttgagatggagtctcactctctggcccaggctggagtgcagtggcgcgatctcggctcactgcaagctccgcctcccgggttcacgccatcctcctgcctcagcctcctgagtagctgggactacaggcgcccgccaccacgcccggctaattttttgtattttcagtagagacggggtttcaccatattagccacgatgctctcgatctcctaacctcgtgatctgccagcctcggcctcccaaagtgctgggattacaggcgtgagccaccgcgcccagcctattgtctatttcttagagagtcgtaactatcagaggtttctgaacagaaaaaggacaagacaagatgccaaaatgctaacagtgtctctaagccagaaggggtggtggctggtttaaaatgaacacacactactttttttttttttgagacagagtctcgctttgtcgcccaggttggagtgcagtggcacgacctcagctcactgcaacctccgcctctggggttcaagtgattctcctgcctcagcctcctgagtagtgggattacaggcatgcacaaccatgcccggctaatttttgtatttctagtagagatggagtttcaccatgttggtcaggctggtctccaactcctgaccccatgacctgccctcctcagcctcccaaagtgctgggattacaggcgtgagccaccgcccctggcaaacacacaccactttgcacacatgtgactcaacagtggggctgcccagtggaacccaggaccgacatcctctgtgcctcctctggaaacaggagcagcaaacaacacagttgccctccgaggagagggattctggcacatgctaagcgcccattctcctgcaggggggatgcagacagacagacgcagagaaggtggtaccaagtgccatgaagaaaaactaggccacatgggggccagcagagggagagcacagtgaagaattttaaatgtgtggtcaggaaaggcccctccgaggtgatgctgaaccagagatcgggatgagatggggaatgagcttaccaagcagggaggagtagctgtcaaggtgctgggtggggtgactggcacaggccggcaaggcttcaagaaggcagaaggcatggtgctgttattcaggccttagagagccacagggagggcttgagattctatcctgagcaagatggaagcccctgaaggcctccactcagagccctgcctgatggtgatatccaaaacattacctgatttttgggcagggaacgtgctgagagagggagcacggaggctggttagcccagtggttctcacctaggggtaattttgctcctcaaaggacatttggcaatgtctggagacactttcggtggtcataaagggtggtgggggttctggtatctagtgggcagaggccagaatgctgagcatctaacaacgcacaggacatccctcaacgaagaatggcgtggccaacgcacccgcagtgccacagctgagaagccctgaaggtgctctggagacgcaggtgctgagacccgaacaatggcagagaaggtgggtctgcggaccagcctctggatacatcaagtaggaaagcaatcaaatggtaagtgaggggtcagggacaatgccagggcagagggcaacgtggcaggaggctgggcacttctgttgtgccccatttgagctccccgaagctatgctgggggccactcagagcaggcattcaggagccggggaagctcaccgggggcctctcctgccaggagcactctccctccacggctgcctgactcccaaggcacatgctgcttctctgagctgcagtcttgaggctgacccccaataacacagcaaaagcaactagctcgtcctgcagctcctggtccagactctcattcataacactgaccttgactgaccaggtggaatccaaattcactgtataaagtgatccaggaatagaaaacacaaactgaggctgatcaacatgttgaaaatacaaagacgctaaataaagaagctacttttttttggtgtggtgggggagggggtgggtgggaagaacagagtttcactctgtcgcccaggctggagtgcaatcatggctccatcttccaggtaatactcccacctgtctcctgaatagctgggactacaggcgtacgccaccatgcttggctaatttttgtaattttttgtagagaaagggttttgccatgttacccaggctggtctcaaattcctgggctgaagcaatcctcctgccaccaaagtgttgggattacaggtgtgagccgctccacctggccaagaagctactttcaagtgattttgattgtcatgtccctgtaggagcggatggctcctaaaggctgggctgctcctggaggccatgcccttgccccaagggaaaaggcggctttgtgcctggccactagcaccagcatttgaacactaaatgggctcccagttcaaaaaggggagctggaagaagtccaaaagcaggggcctgcatggagcctaagcacttacagctcaaggctggaagccaccagccatgccacagtcatctccaggtgtcagacaccagggaaggccaaacaggacgagacatgggtgctctcttttaatcccggggtaaaaggcaaccccaccgcttctggaggttagtgatgtaatcaataccagattttttcttttttttcttgagacagggtctcactctgccacccaggttggagggcagtggcgcaagcagggttcactgcagcctcaaccacctgggctcaagtaatccttctgcctcagcctcctgagtagctgggactacaggcacatgccaccacccggctaattttattttttttgtagagactgggttttaccatgttgcccaggctgttcttgaactcctgagctcaagtgatcctcttgcctcagcctcccaaagtgctgggattacaggcgtgagccactgtgcctggccccaatactaggttttcagctcacagcttgcagtagtctcaaacagaaaaggtccagcatcatgccaagtgcccgctgaggcttcacagacagcctgggacctcaaggacaagcggacgaccagccccacactaggtccctggtgagtgtgtagacaacaggtcagcttgcaatggctcctggatttgtgttcaaagagtgaggctttccctttgtaggactaagccagaccctagacctctgaaggtccagcagccacacacaggactgaagctgttgacctaggccaggactcaaagaccagattcctaaaaggaagatgaggttagaccagcactggaaacttctaaattccaacttgatacttcccaaagagtaaaaacaatctgagaaacgccactcctccaccccctccctgaccccccatctcttattgtctgagctgggtctgagtcctaggtgtatagaaaaagagtgaacttgacagtggccaactgggggtgtgggagagacagagcttccaattgtgctggggacctcaggggctcctaaccagcctctctccctcccctcctgtctcagctgaggcctctctggctctttggttgtccctgagcttgaagggtctagctccacgctgccatgtgcccactccactgccagcacaggtgtggcgccactatagttcaagacaggggtcacgtgtgttagtgcatatatatttttcaaactaagaaaaccaactcggccgggcgcagtggctcaagcctgtaatcccagtgctttggaaggctgaggcagacagatcacaaggtcaggagttcgagaccagcctggccaacacggtgaaaccccgtctctattaaaaatacaaaaattacctgggcgtggtggtgggcacctgtaatcccagctacttgggaggctgaggcaggagaatcgtttgaacccgggaggcggaggttgcagtgagccgagattgcgccattgcactccagcctaggtgactggaagacagggcaagactctgtctcaaaaacaaaacaaaacaaaatgaaacaaaaaaacccaactcagttttgcgggggtggaagcaggaaaccttgctgaggcctaggatcccacttttttagtgattcctatatattcaaggctagacaagaatacaaacataaaataaggtacacatatggtctttaaagattttgcaagaatctgacgtagggatggggtggaggaagtaaggaccagtgacattcacccccatcccacaatgttaatgcagcttgatggcctgagaagctacttacaccagattggaaagtttatcccagtgtggatttctgaaaaagctgcggaaatcgtagaatggcatattccccaaagcagcactttttttcaaaccatgtgttgtgacccattagtgggttatagaaccaatttagtgggtcatggtcaacactggacaaaaaaaaacctgagtgcattaatatacatgtggtaagaataagtactattaggttggcaaaaagtaactgcagttaaaatattttgaaaaaacccgttcagttgcatatataacacgtatgtgtcccgggtcatgatataaaatgtgtattttaccgtgagtgactgctgagaagctggagaatctccactctactgaattctctgcccagcacctgcgccgactctcggtcctttctggccaggcttcagggcagttacatcagagggaggacatccctctcatgagaagctggtcttggaaccaaaaaacatgcaaaccaacacaaaacccaagacccacacagtcacactcaggcacttttagggtgaggaactttaactttctgacctgacttaaaatgttactaaattggctcaaacagtaaaaccaggagaggcagaaaatggggcctcctgttggagctggactcctcttccagcttcttcctaagcccgagtttccagtttggactggatttgaggatgtgaatggtcagtaattccggctggtgccagtgtaaggactttctcagagcagttgaccatcatgtggctgagccctgataacccggcaatcagctcactgcccacctgaggacagaaggttttaccagcaaagcacaaatggccagggggcctcacatgcttgggggaggggagggagaacctccggaaatggctggaagtaaaagaaatgttggtgcccctagctggaaaattctgtcaatcatgagctacggaagccattcaacagagaagctgtgctaagactgaggtcaactgattgaatagtttttgagtgttttctatagacttaagacaagacaagaatacaaatatataattaagaatgggaattagctttctagaacttacactgagatgagggaggtaagatgaaattacacctgaaaacagttatacacaagtaaatagagcactaagctgggtggggagaccagaaactgagtcctgtctggatggcggtgggggaaggcaggaggaccggggttgcaggggaactgcacaccagggacagcccccacgccctcacccctgacaccctctctgatctcacaacgcagactctcaggctgggcaatacagtgctgctgcatcaccgcctggaaactcggctgcagctcgccagcttgctggaatggcctggaggcacagcctgcccgagggacagagaaaggggactgagtccaactgcctgctaagtgagggggaaggactgcagagcttggcctggcagggggccagcgggctggtctctgcagatgctgcggtgtttgataagcaatatgtgcacttggcggcaggagctgggagccgaggagcccagccctgcacccctctgtcttggctctgggcttgtcaacctggcttaaaaaaagacaagaacagcccaggcctggctcctgcatttgaagggaggggacagatgggcatctttaggagaaggccgcctccttcctcaaaagtataagtagaaggcagaaaagtgatcagcatgattccatgttctgttcttgtcaggcctgactgggtatcactacctaaccagtggccccggactgctccatttcagatgcgacaggctgcggtcctgtggctgccgggcatccctgagaacaagaagggagtcggccagctggccaggcacagagcaagttcacagcctcaacacccctcagtgtctgatgccatgttagttcacggaatgaggacccaggctgctaatcacacaaactgatcctgacggagcctgccaggaaagaaccccacgtgcactgcctctcccaaccctatgacccccacgaaggaggcaccactcttgttctcattccacaggagactgggtggcttggagaagtaagtgagctgcctaaggtcacccaagtgccaggactccagagcctttgttttgctcacctgcccttcctcatttgacctgtctggtctccaagcatggcccttgctacacctggaccaattggaaccatgctgccattcaagtgtggccctgggcctggcgaggtggctcacacctgtaatcccagcactttgagagggcaaggcggttggatcacttgaggtcaggagttgcagaccagcctggccaacatggtgaaacctggtctctactaaaaatacaaaaatcagctgggtgtggtggtgcgcacctgtaatcccagctacttaggaggccgaggtaggagaattgcttggacccaggaggtggagtttgagtgagctgagatcacgccactgcactccagcttgggcaacagagcaagactgtgtgtgtgtgtgtgtgtgtgtgtgtgtgtgtgcatacacatatatgtatatacaaatatatatacatacatgtatatacaaatatatgtacatacacgtatatacaaatatatacacatgcacatacacgtatatacgtatgcgtatacatatgcacatacacgtatatacgtatgcgtatacatatgcacatacacgtatatacgtatgtgtatacatatgtacacacacgtatatatgtgtgtgtacatatgtacatacacgtatatacgtatgtgtatacatatgtacatacatgtatatgcgtatgtgtatacatatatacatatatgtgcgtgtatagatatataaagtgtggctttatatacacatacgtgtgtgtgtgtatatgtatatgtgtatatgtgtgtgtatatgtatgtatatgtatatgtgtatatatgtgtgtatatgtatgtatatgtatatatataaagcatggccctggactggcagcccagcatcttccctgagcttgctggaaacgcagactctcaggccccatcccagacctgctgcctgggaatcatctgaaaaagttccccaaatgattctgatgcacaccccccagagaaacagctaaaagggactgcatccctctgagctgcttctgggaaaatttgggggaaacagcggtgttcccctgtagctatgctccccaggagaagaggagccctggaggggctgtgtccaagaagtggggcagggcctgctctcagccatgacagaccgcacgtggaagagacacaacctccctgagcccacaccaacctccccgcgcttctcaaacacctgcagttactatttcaaggcagatgaaatgaataccatcccgggatgctggcatcactgggacaccagctggcctggagagtgggagttgaccaaaatgtcacttcttggctgggtcattaggtcctaagaccctcaactgcccacctttgcacctccatctctcccaaggcacaacagcaacaagcagctcatctcaggacagtgaaacaggactcaaatactaactagaacagcaccatcatggagactgggaggagtttctgcccaattctgcaggtgcagtgagacaaagctgcggctggtcacatggaggctacacactgcaggggacagagatgtggagtataagcttcagggcacagggaccaggtcctgcaggggccacagagttgccactccccagctgtgtgtgctggagtcatgtcacatctctgggcaccagatgcctcatcagggggttgggcaacactgagctgaatgagctccaggcccttccggctacagctccagagcttgtcccctaaacacctcctggggtcctgatttccacctgcctggcacctctccctgactcaggggcaggcttctgctcttcacatgtgggcacccccattgaccatcagagcaggccagccgaaagtcaacgacatccctgggcagcatggcccaaggaggcccccatggctggggcaccagggcaggtccctagacgaggacctcttccctggagaagacgataacatttacaaagaacagaacacaatgcaaaatttcatgtatgggcacatcaggatttaaatgtattattacagtgaggggattttagatacaccaggagagctatctgaagagaaccaacaggaaatcttagagtattaaccacctccttgttaatatggtcaaaattctctaccccctcctttttatgagtgtggacacacccaccaccagtgataagaggacatggatggaggccaaatgagagtgcactgggtggctgaactgagctgggtctttagaggccatcactaaaaccacctggcagagagcaccacgaagggccttcgactacaggaggaaagaatgctaagcatgtccaggggcaggaaacagctattgcaggcccaggcgagacaggaggaagggaagaggagcaggtgtttgatgctgcatggatgcatcagcgtccgcgaagagacgtctgggtgaagagatgaatgtctcactgcacctgcagaattgggcagaaactcctcccagtctccatgatggtgctgtttccgctggtatttgagtcctggctcactgcatttagaggagctgcttgctgctgttgtgccttgggagaagtggaggtggagaagtgggcagatgaggttcaatgctcttcaccacctcaggaggaaggcgcagggggaggtcacagagctgggacacgtggagtgggcctacacccagtcccaccctggggtctgggatagctgccccacactgccctgggacgccctgaagaagggataatagagaacagacaccaacatgtgagacctggaacctcagccttctgacaatgttttctatactattaggcaaaaaacttccctcttctaggagcccacagcctcccggagggctctccaggcctcacacaaaaactcattttatcacagtcctgaaggaggtacacaattcctgaaagtaacagactaaactgtacttggactataggacaccctcttccaggagccatgccttacaaccagcaactgcgaggcgccatttggctgtctgcaccctgtgctggcctctgaagggcaatggtggaagccaacagttggaggaagtttagatattcaattcagcagtgctgaaagcaaaagaccatgaagctgtggaaaatggagcagcctccacaggtcccttggaaggaggaacaggttttttttttttttttttgagacggagtctcgctctgtcacccaggctggagtgcagtggcgcgatctcggctcactgcaagctccacctcctgggttcacgccattctcctgcctcagcctcctgagtagctgggactacaggcacccgccaccacgcccggctaactttttgtatttttagtagagacagggtttcaccgtgttggccaggatggtcttgatctcctgacctcgtgatccacccgcgtcggcctcccaaagtgctgggattacaggcgtgagccaccgcgcctgtccggaacagattttaaggcagttgtttatcagcttgaaaaacacggatttttcaacccaaacccattgaataaatttctgggtggagagattaatgttccctaggtgaatctgatagttaaaacagttcaacttctgactgccacggtgactcgcgctgtaataccagtactttgagaggctgagctttgagaatcacttaagcccaggagttcgagaaccagcctgggcaacctagtgagaccctatctctacagattttttttttttaaattaggcctggtggctcatgctcatggtctcagctacttggggggctctggtgagaggatcacttgagcccagggggtcaaggctgcagtgagccacgatcgcaccactgcactctggcctgggtgacagagtaagaccctatctcaaaaaaaaaaaaaaaaaaaaaaaaatccctttctcctgaaacaaaatatactctgactacttaggaatatttgtctttaattaaaaaaagtttttaagtttactgctgatatgggggtgtaatgaagaaaaaaatagaaaaaacattttaagttaaatccagggatcaaggcgtaaaagcaaggtgactgaaaataactaagaaagcgagagttgactgatgcccacccttcggcactccctgacacacccttcctgtggtccagcccttgggaaagacacagaggcaccaggtcctcaaactgatatggccccaaccttgacccacctctgctcaggtggtccagatcccagcctgggccagtttccatgctgacaagaacaaggccccgggccagttgctgtcacagtggcaaagagcagatcccgccagcacgcatccttgggaacctggtggacatggtttcgccaccttgaagacttccaggcaggaaggccatgctgtggccctgagaacccgatgctcagagctgtgactagaagggagcgagctggtgtgaaagcgtggctctacccacgcggaaacctcagagtctgagaaagaagcatgccggcagaaggaggcatgcctgcttggccccattcctcggccatggccctcgggaccctggtgctccctgcccctccttcatcacctccctgcaactgcgaatgcacagaagcatgacataaccttggggcagcagaaagctgctgcctcactcctgccacagctcatgatccggagcctcacccctacccagcgcagcagtggcccccttcgcaccacactcccccaaatgccaagccttggctgctaatcaacagccacactctgaaaatgcaccgtaccttcctaggcagactcatgctgaaaaggagccactcagcagtgctatttttaaaaatgcaaatatggtaggaaaaggcagtaaaaataacacacaagagccctgatccaaggccagttgtttccccgggggccaagttcccactgaagtgggagcagggggctatggaggagcagggggctatggaagtgcaggggggcctatcttcccacagtggtcctggcttcctgcatcgttttgttttcctaatacctgtgattttagatcaatcccagtggccagaaatgttacagactcgcccacatctttacccaaacacaccaccgagcaaccctacatgcaggccaggagaacctacactagaggcactggcaggtttcatgacccaccctggaatgactatgtcaaaacaatgatgattctccactccttacaactctgtaactacatctttgcgagacaaactgggctggggcgctgcagacatttctttttcacagagaagcaggagcttgataaaggcatgggaagccaaggaggaagagacacaagacgtcctgggatcgagtgcaagctggggtcttgcaccaccaggtgttggtcctgccagcattcaaaatcggcctgccacacactgtttatgtctgtggccacagaaagcccgagacaggctgaccccagtgagttggcagggacggccttgtcactcacccccctagacttccaaatgctaaccttgacagtaggagtcctccctttcttcagccccccacatccctgcaattaggtcaggacaggatcaggtagtctgctttctaagccaagatttccaacaaaaataaatacaaacacatagcagcatgtatttgggctgagttcctggtaaaaggcatggatgggaaagtgaacaggactcagcaccacccatttgctaagtgggtgcagtccatcagtactgcagacttcgctccaaaaggccgttgctcctctgacaggaaatgggaaactcacagctacagtgagctccctagagctgagcccaaccgtagggaaacactgcagaaagaagtgacggcctgctgtcagcgctcatggctgacaccacatggtcaccattcttccagatactgaaacactggagtcacccacattaaagacactagagcatggaacataatttgagtgactattttcttttgtctttttttttttgagacggagtttcgctcttgttgcccaggctggagtgcaatggcgtgatctcggcacaccatagcctgcttccccggttcaagcgattgtcctgcctcagcctcacaagtagctgggattacaggcatgtgccaccacgcccaactaattttgtatttttagtagagatggggtttctccatgttggtcaggctggtcttgaacttccgacctcaggtgatccgcccaccttggcctcccaaggtgctaggattacaggcgtgagccaccacgcccggccctgagtgactattttctattttcccagggatggagtaattagcaccatttgagatccattacaactggtaactgatgccttgggactgctggctgagaagggcttgtggcctttctttcatggagtaaatgccacgtgcttcccatttctcccatcctggctggctctatttccctcagtcactgggtcccaggaggaagtcaacaagtcgctggccaggagtctggaaaagacaagatgacgccaccagactgcatctgaggacccatcccctctccaatggatctgcatccagagtgctcaaggaccacaaatcccaggtggaggaaaatgggaagatggagatgtctcaaaggatctgctgtgtccttcctttaagggacaaccaagccacaggagggtcaggcaggcctgtggtgatgtttttgagacctctatgtgtgataagtaatgggacgtgtgctaagtaaccccaaaatgctagttctcgtggcctctctctccggcttttcctcaatggctcccaactatttcagtcactccactcattcacagcctgagtggtcctgaaagggaagatgatgtgtggaagcacgacctaaatgaacaacacggggagagggcatgggcaaagggcggctcactttaacctggcttttcccaggctgagctcaagtcccatctctcctccagcaagggcttgacacagacacaacctgctctgtcataaggtctgggcacccagtggcctcttcctcccgttcatcatatgctgtagaccatccattcagttgttccctcgcccattcagcaaactgaataaccactgggtgggcagacgctgtgccagatgccaatgaaacatctggaacacgagacagtcctgcaggtgtccgagcaggacggaggttccatctgcaatgaagccgaggcacgccaggcttggggaggtgtggccaccacagggaacagccatggctcaaatgttcccccagatagctgcacccaagtttctgctcagatgtcacctcctcagaagggcttctctggccaccctgtctggaattgctcctcctcattctctatccacctgctttatttttcttcacagcacttactgttcccacacctgcagtctgtgtgccccatgggggttagaatgtgaaccacacaagggcaggcactgggcaccagtgcaccccagcaagtgcctggaacacagaagggtgcctctgaggagtcactagagacagctgaaggaaaagccatgggaattgggaacaagtgtcaagaaaggagtggctagcaatgcctgatgctgctgagagatccagtgccacggggaagtgtccctgctgacctgggctcagcagtcccaatgggtggcgtgggcagaatccccaatggcggggcctggagaacatctggcaatgcaggaaacaggaatcacagcatggagctcattcaggaactacggctgaagagcaggaaaaggaggaagaggtaggtgagggggtggatgtgggctgaggaagggtctcttttcaagacattaaaaatggggtcaagctgggcacggtggtacgcacctggagccccagctactcaagaggctgaggtgggaggattgcttaagcccaggaattcgacgctgcagtgagccctgattgtgccaatgcactccagcctgggtgacaagagtaagaccctatctctaaaaaataaatacagtaaaaataaaaatgagggcccggcgtggtggctcatgcctgtaatcccagcacttcgggaggccgaggtgggaggatcatgaggtcagaagatcaagaccatcctggctaacatggtgaaacccagtctctactaaaaatacaaaaaattagccaggcatggtggcacgtacctatagtcccagctacttggggggctgaggcaggaaaatcgcttgaacctgggaggcggagcttgcagtgagccgagatcacaacactgcactccagcctgggtgacagagggacactccatctcaaaataaataaataaataaataaataaataaataaaaaataaggtcaggcaggaagctgccaagggagagcctgaagattcaggcccaggacataattgatagaggtggcctacggcacagtgtccgcaaaggaaccagaacacaggagaggagacttcctctcttcacaccaggtggctctcagctacttccaggttgggttctttttttttttttttttttttttgagacggagtctcgctctgtcacccaggctgtagtgctagtgcagcggcgcgatcttggctcactgcaagctccacctcccaagttcacgccgttctcctgcctcagcctcctgagtagctgggactacaggcccccgccaccatgcccagctaatttttttgtatttttagtagagacggggtttcaccatgttagccaggatggtctcgatctcctgaccttgtgatccgtccgtctcggcctcccaaagtgctgggattacaggcgtgagccaccgcgcccggccttttttttttttttttttgagacagaatttaacttttgttgcccagcctggagtgcaatggcacaacctaggctcactgcaacctctgtctcccaggttcaagcgattctcctgtctcagcctccccagtagctgggattacaagtgtgagccaccacactctgctaattttttgtatttttgtagagacagggtttcaccatattggccaggctggtctcgaactcctgacctcacgtgattcgcccacctcagcctcccaaagtgctgggattacaggcgtgaaccaccgtgcccagcccactagtattttttatattcgttacattctgaaatggtatcttggatatatactgagttaaataaaacattaaaattaatttctggctgagtgaggtggctcatgtctgtaattccagcactttgggaagccaaggtgggaggattgcttgaggccaggagttcaagaccagcctgggcaacagagtaagaccctatctctacataaaaaaatggcagcaggatcccttaagccaggtgtttgaggttacaatgagctatgatcgagccactgcactccagcccgggcaacagagcaagactccatccacctctacctccaaaattaatttcacctgtttctttttttttttttattttttattttttttttttgagacagagtctcgccctcaccctgtcacccaggctggagtgcagtggcgcgatctcagctcactgcaagctccgcctcccaggttcatgccattctcctgcctcagcctcccgagtagctgggactacaggcacccgccaccacgcccagctaacttttttgtatttttagtagagacgggatttgaccatgttagccaggatggtctcgatctcctgacctcgtgatccacccgtctgggcctcctgaagtgctgggattacaggcgtgagccaccgcacccggttcacctgtttcttttaatgtttttaaaatgtggtcacttctcaaggtcctttcgacaaaaaaaaaaaaaaaaaaaaaaaaagtaaaagaaaaaaatgtggtcactaaaaaattttaaaggacctacttggctcatattgtatttttttaaataatagtttagcttaattgtatcaaaacaatgcatgcctaagttaaaaaaaaaacatagtactaaaaggcttaacaaaaacaggcagtcccccatcttaccctctcaactgtgctcttttgaagcaaatactttttaattttttagctgtttgaatatttacctccatacatataaacaacatgcttgcaccctaattcctaacttattatagacattatctattgacgtcctgttttggtacctgatgacctaactcttaccctcccctctgaagccctttgcctgtactccatcctttcaacagttccactgcattaattgaaaaatctaaatgtgttatgatggaggacagagctcacagctgaaccaagtggtgttccgtgtcctcacacaactatgtacatattgatacttttgtcaaatacctatccataacttttctaaatatcttcaaattacctacaaattatcgatcaggtatctttgggctttgtgtctttttcttgtcgatctctctccctcctgcagaattccatcctgtctctctaactcagactttcctctgccgctcacctgtgtcagatcccgtttcctggatcctgggaaaagtccctggttttggtgaagaacaactccttctatctcctccccacaagaggttcacaggaggcactttttttccagcccttacatgcctaaaaggagggtctcactctgtcacctaggctggagtgtagtggtgtgatcatggttcactgcagcctcaacctcctgggctcaaatgatcctcttacttcagcctcctgagtagctgggactacagatgcacaacaccacacttggctaatttttgtatttttttgtagagacagggttttgccatgtttcccaggctggtctcgaacggggctcaagcgatcctcctgtcttggcttcccaaagtgctgggattacaggcgtgaaccaccatgcccagccaaaagaacttttttctactctacttgacgtagttgggctggatacggaattctctcagaatgttgcaggatttgctctgctgtcttccagtctgagtacctgtcttaactggcacatataattgtttactttcattgtgatccatgtggatttatttctactacctttagggctttctggctaccatattttttctttgctctctttcttttagacaaatgacctagttttaaaattccatatttttaccctctgtgagtttgaaagctttaaacactatttctattcttttggtggttacccttaaaattggaacatgtctacttgactcagaaagtttgaagtcaatcaatatccctcctacacttcccaaacagttcaaagaacttaagagtgtgttcattcaaatcaccccctcactgatttccattttttgttgggactttggtttttaatcctctccaaattagtgacgatcactttcagaagcgaatgcttattcagatttacctgcacttcccaacgcctctggataccattactgtccgcatttctcctttctccttacttccttcttcccgaagtacagcgaaggtctcttagtaaatacaacttttttttttttctgtgaaaatgtccttatttgttcccattattgaacgataatttaagctggttgctgaaaactaagccaacaactgattttccttagcacactgaagattttacttccttatggcctctactgttgctacttggcatttcctgagtttcactgttgaacctggggagtaatctgcctttcttctcaagctgcctttaggatgctatttttcccactgggccctcataccaccatccatgtttgtaatgtctcttcctcacaagcatctcttttatctctgcagaattctaactaacttctgcagatctgttttccagttcccatagttctctcttgagaatttatgctatttgctgtttaacatttccactggggttttaactcaatgttttcactctagaggctttatttgattctttaaaaaataatcccttttaagatgtattctgtcttattctttcctttgacatctatttcttcttttagcccttcaatcactttagacatttctattataatctcttctattatttgaattctcatgttgagaatcttgtgtttgttgtgatcgctgactcatgttctaatttctacatgcttggtaatttcctagaacaagctcatcatctgtgggcatcctaggattccaaaaggcctgtactgtgcaagggtcactctagaaaagttctgcctttgttctgcaagcaagaagcttcaggggtatcgccagtctgctggctggtctggtgccagctcgggcattcctgcaacatgtagatgttataaacacagacttagaacttggatgttttccactgttcacagaagacttcctccaacacaatccagagtgtggggcaatgatcagctcccttgacatttctctgatcccatgggggaaattttcttgcatcccttttacctgggaatggctcttttgaggggatttctgtttcaactccatgcttcacgtgttcatgcaaatccaaacctctattattgttagggtcgatttcagggtccaatgaacccaccttgcccctccccagagctgcctactctgctctggctttatattcctgctttgctttcggttctctgtttttctttcttattctgttgttatagcttatatagcattttaagtgattgtaatgggagcggttctaactttagctcaagctaccatgtcactgaaacaggaaatccaccccattgtcttctggcttccaatgaggttgaaaaatccaatccatcttcattcccagtcttttgtatgtgacccgtttttgctcttcggaagctttatgcccagtgctctggaatcacacaatgtgccacaggacattttccatttaccatttttgaaacttatgactgtccattctgaaataattcttgtttctctgatacattatggtccttaattttccctttctctctttatagacttcctagatgtcagacgtttttaatctgtttcctgggagccttcgtcaacttcaaagaaaaagtaatggttttaatttccgagaactctttcttgttctgatttttatagtaactttttatttcatggataaaatattggctcttctttctgagtatatttgccatgtgctttaaggctttctcctacctgaatcagctctgattcctcggagatacatttttctctttgctttctctggcctctaccttccatactggaagctttctgaacatatccagttattcttggcatccattcctatttaaaagtgaggcaataagagatctttgtggtgatggaagagttgtgtatcttgactgctgttacatgtggttacatgaatccacagatgtgataaagggtgtgaaactgtatgcacatattgtgtacccatgtcaattccctgattttcatattgtctgtgattatataagacatgaccatcaagggaaactgcatgaagggtagaggggacccctctactatttttttttttttttttgagatggagtcttgctctgtcgcccaggctggagtgcagtggcatgatcttggttcactgcaacctctgcctcctgggttcaagcaattctcctgcctcagcctcccgagtagctgggattacgggcgcatgccaccatgcccggctaatttttgtatttttagtagagacggggtttaaccatgttggccaggctggtctcgaactcctgacctcgtgatctgcccgcctcggcctcccaaagtgctgggattacaggcatgagccaccgcgtccagccagccctctactatgtttgcaacttcctatgcatctataattatttcaaaataaaaagttgggctggggatggtggctcatgcctgtgatcccagcactttgtgaggctgaggtgggcagatcacttgagctcaggagtttgaaacctgcctaggcaacatggcaaaaccccatcttgacaaaaaacacacaaattagccaggagtggtggcgcatggctgtaatcccagctacttgggaggctgaggtgggagaagtgcttcagcctgggaggcagaggttgcagtgagccaagattacaccactgtactccagcctgggtgacagagtgagactctgtctcaaaaaaaaaaaaaaaaaaaaaaagttaaaaaagttgaggtgataaaaagatgatagaaaccctgtgaacataagcaaggctctggacaggtgaggaccacattagatggagtagaaagctggccactgctgtgaggagccactacatactggcaatggcaggtcttgttgctgacatgctcattttttccagactggaatccaatgccatgcctcatgcctggcctcagcactccaggagcaggcaggggcatggctgggatttgctcttttagtgtgcagacgttcatgaatccctctttcagtccagcgttaccctgccccttgctctgcccaaggtacctcaatctggtgcataagcctctgctctctcactcgccagcaaaggggattgagtattttctggtttgcagaattcaaagagatgacttgggaagtttcatccctccctatacagactgtcaactaatcataatccctctgcttttaggcccaaaccttattcccaccttgagtgccaccaattgcctccaattcctgatgctttctaaagtgcttttccttggtgtttttccgcaggtaccaacatttcagcctctgctctgctcagtcttctgtttgccttccaccttctagaaattggagatcttttgttattgttttctctcccattctgtgtccttgtgggtttatacatctaaaaacaattattttgctgttattttagcagagtttctaggggaagtagatttaaatgaatatgttcaatctaccatgtttacctaaagtatgctaaccgaagattttttttttcaatttgagagcaggtactatttattaactgaccagattagaaaaataatcacggtagacaccgcagttcattcttctaagaagcctgtggatctggccctccctgttggcagcagctccattttctacaaaatgggtggtctttttcttcattccactttgtggagaggataacttgaagggccacagtatagagctcatgaatcagatcctcgatgcagatgatgccatattgaccatgagactgatcaatcaaagtgttatctgtcaaagcaattcgcttcttattgattttgccacggccatgcttgtagatgagtttatttactgatttcagatttgggttccccttgtaatacatggtttcacaatcctcagcatgttaactgaaggtctgctgaacttcacaaaggttccattaaagatctgacaaaggcaaagaagctgcaacatcttttggccctttgggctcacaccactgatacctctgaccctgatgacaaatgccaattcgggttctgcaggcacaaaaaagttgccagcttttcttgccatcctagcctttcaaatttcagttctgtacatctgcctagattccttgtggtagtgcttcacttcttcgtgcataagtttcctccctgccttttgaagcatcttttgggcaaacttcttattcaggtgcttgatctttagttctgtgaaattcctttgctttttcccaagggtttctggcacaacaggaagctgctgcttctcttcgacaccctccatggttccagccaaaaaagaggcaaccggaggtttttaatctttgttttgcaaagtacttatatacaactagatctgaagatgaaggagaagtaataagtcaacaaaagccggccacggtggctcatgcctgtaatcccagcactttgggaggctgaggtgggtagatcacttgcagtcaggagctcaagagcagcctggccaacatggtgaaatcccgcctctactaaagatacaaaaaaaaattagctgggcgtgctggtgcacgcctgtaatcccagctacttgggaggctgaggcaggagaattgcttgaatccgggaggcacaggttgcagtgagccgagatcgcactccagcctgggcgacagggtgctctgtctcaaaaaaaaagtcaacaaaacccaggaaatcacaaattcaaaaattagccatccttagttcagacattcacctactcaccaattcattttgatggactctcctcatgttgctattctgagatgtgaaatagtgggtagggaaaagaaagactattagggccagacactgtggctcacacctgtaatcccaggagctgggaagcccagcgggggggactgcttgaaaccaggagtttgggaccagcctgggccaagactccatctctatgaaaaagtaaaattaagaataaaaaattttaaaaagaacagctccattagaaactcccccagacacctgaaagggccacacatccgctcctacaaatggctttttgtttcaaatgttaaagaaagtttaagtcccatggattgctgtgatctaaccatgacagtcagaactgatccaggcttagggtggaagacactccctgtcagtgtcacgcagcaggcatggataaatccacactttacacactcacaaaattagattagattcttaaaaggctaaactaaaaacaatcactgagaaagtcaccaaacataaatagcagcacatgtgcccctcagcagacagccacacagcatggagaatctgtgaggcagcagcagccaagagcctttggaaactcaaggccccctatcgccaggcacacacacccgacactctcatgcacatttcggcacaaccatgtcttagacccgtcaaactgctacggaaaggactcagttatcaaagtatgttcctgtcaatccacaaatatttcatcatcccactgtgtaagaagtactataattgtactatgagagagactcaaaagaaatagattgtatggtctccgccttagaaagacttatacccagcatgccacggtacatgtgactggtaaatatttgaaagcttgcccactgtccaagaaaacctatttagcaacccctttctcatcctaggatgcttgtggagccccagatttaaaacaattacatctgtgttcctggaaagacttaggacttaaagccctttcagtttctaagggtcttaagcatactgaaataggaaagggggttaaatcccaacataatgcaaaatggctagcacagatcccaatgacactgacaggcacctgccacaagaggtagcccacctgcgagactccatgggagagagggaagatccaaatgcagggtgtaataagcagaccaacagaaaactcagttcaaaaataagcacaggacttatttgaataaacatttatctaaagaagatatacacatggccaataagcacatgaaaagatgctcagcatcactcatcactaggaatgcatgccaaatcacaatgcaatacccatgcatgcccactaggatggctataaacaaagtgacagtcacaagcattggtgagcatgtggagaaactggaacccaccaacattgctggtgggtatgtaaaatggtgcagttgcttcagaaagcagtttggcagttgctcaaaatgctaaacatagatttacctaccatacgacccaacaactcctctcctgggtataatatccaagagaattgaaaatatacattcacacaaaaacgtggacttgaatgcttatagcagcattattcagaatagccaaaaggtgaaaatgacacaacaacaaatgtccatcaactaatgaatggatacacaaaatgtgatctatccatatgatagaatattattcaacaataaaaacaaatgaagtactgatacatgctacaacatggatgaaccttgaaaacatcacgttaaataaatcagtcacgaaggccacatctagtatgcttccatttatatgaaatgtccaaaataggcaaacccacagagacagaacatggcttccaggagttgggaggggtgcagggaaatatggtatgactcctaatgggtatgaggtttctttttagggtgatgaaaatgttctaaaattagatagcggtgatgaccgtacaaccgtttgagtatactaaaaaccacttgaactgcacactttaaaagggtgaattttatggtatgtgaattgtctcaataaacctttttttttttaagagatggggtctcgatcgcttgaacccaggaggtggagtgagtattgcgccactgcattccagcctgggtgacagagcgagactccatctcagaaaaaaaaaaaagagagagagagatggggtttcggccagtgcggtggcctgtaatgccagcactttgggaggccaaggtaggaggatcgcttgaggaaaggagtttgagaccagcctgggcaacatagtgagatggtgactctacaaaaaacttaaaaagaaatgaaaattagccaggcgtggcggtgcgcgcctacaggcccagctacagtgtttcctgtaaatcctgtgctatcaattctatttttcaagtcaaataccagaacttgtctcaaactatactcaccagaagacaaaaacgagccctcctaacatcttctactcttagaaattagatgagtgtcctcctatagacttttatttcctaagaaagaagtctgttttctttgtctgtggcttccatccatcttacttaaccacgtaagcctctctgggcctgactataaaataaggggctccagcgaaatgaccccgaggatcccttccagtcttaccactatagacctagacatacatggaaacccagcacacagtcctatctcagaggttcagatgaagaccccacctgcaataagcacacggtggctgaaaactccttcttattctgatgttcccagcacagaaaaggaaagtgagaggggcaagggtctatgggagaaacggagaggaaggaaaccccaacgcgtaggaaacacagtcctaccctggaaatcacagggcacatttgtcttcctggaaactgtaaaggacacgccaatagtcctgccatgaactgtgttacctgagatatgtctcacaggaatcacatgaagaaaaaaggattccaagcatgaattagggtgactcctcgtcctggggaaaggcaacagaacccaccttatatggccgtggtttgcttttgggttgtggagagtccttttaagagtcttgccttggcttctgcaaggagctcagagtggtcccacactgctaacacaaactaagcaattccgacatggcaaaggtcaggagtgaagtcgaaaggcacctgcgatgttctggaaatgctttttcacttaagcttttttttttttttttttttaaaaaaacaaacaaaaaaacaactttgtctctgccctcacaaaggtcttctgggtcaaatacctctgttatagtccttccacctccatcggtggtacctctggctactgagaaaaccctgccccaatagaggggctcgggcgcgcccatccagggatcatggattcctacactatccccaaaatggcagagctgggctctccctgcagtggcacactaggctggatttagcccaacagcctggcacaaaggacaacaatgaggagaggaaaggggaggtgacgcacctggcaaggcactaagggatgagatgcaccaagccagctgtgagtcaccacgaagcaaacgggaaggtcaggatccagatccaggtttgtctgaatccaaagctctgacctgccaaatacagagcagttgtacagaaagctactatttatgtaaaaagctaaaatataaaaaaggtatactcacacacatagagtttggtcacagtggctatccctggagagtgaaaatggtaggagggagacaaacatttcactacatatttgtttaaaccttttgaatgttgtgatatttgcatatattatctgtttaaatatacagatacacacacacacacatacacacacacacacacacacacacacacacacacacacaaagattaagatttagttttcaggttggccttacgaggcagacaagctaattcgcaatattccccccgtttactgcatgggcttggaaacacagggaaacagacgcagagctaaattatcccccagcagcagtgaccactggtcaggtgctgtgctgagccctctcgaaggtgatctcgtgcaatccccagtaactacaagattctgtcttttctagtcatggacactaagcaatcacaggtctacatgccctctctaagccctgtgtctgaggccttctctggctcacctaacgcctctcagtccagccctatgctcgggagccacattccctgagctgaaggcacgacagaccagcctgtcccgcaaagctcagtgacaccccggcacagaggggacagaaaacagttagcaaaaggcccagtcagctggccagagttctagccctctagatgctgctgactagctggggatcctgcagatgtcacatcaaattctcatcatcgttaggccccgtgcggtggctcacgcctgtaatcctagcactttgggaggctgagacgggcggatcacctgagctcaggagtatgagactagcctgggcaacatggcgaaagcctgtctctactaaaatacaaaacattagccaggcatggtggtgtgcacctgtaatcccagctactcaggaggctgaggcaggagaattgcttgaacccgggaggcggaggttacagtgagccgagatagcaccattgcactccagcctgggcaacaagagcaaactccatctcaaaaattaattaatttattaattaattaacaaataaaagactagaacagccatccactgaaataataaagagaagttatccccgagtggtagaattatgggtgactttttttttacccacctttcctatgtccttgcacttttgtattaagtatataaataacttaatagaccaatcaggaataaagctataaatctaaggcaaataagaggatgactccagcaatttttcttcggtgctggattgtcagagactgaagaacagactattacacctgggactttccctccttgctggaccctgaatccccgagagcctagacgatgcctccaggcccctgccctgcacgctgtccctcgcctgctgctgctctggtgtccagccaccacctctctactcaaaagtgctatccaaggttcctcacaactcccaaactgcctctctttacaaagcatcctacttgaccccttgccctgacatcaaaagccactggctagcaccctccttctgaacaaaattcaaaaaaggtaacgcctcttaggacagagtataaaatggggattagtgaaagatcaacgaggagcatttatttcaacatttaaaaggcaattatgctaggctgggtgcagtggctcatgcctttgagaggtcaaggtgggcagatcacttgaggtcagcagttccagaccagcctggccaacatgttgaaaccatttctactaaaaatgcaaaacaaacaacaacaacaaaacaattagctggcatggtggtgggcacccataatcctagctgctcaggaggctgaggcaggagaatcgcctgaacctaggaggtagaggttgcagtgagctgagatcccaccactgtactccagcctgggcaacaaagtgagactccatctttaaaaaaaaaaaaaaaaggtggcagggcacagtggctcactccggtaatcccagcactttgggaggccaaggcaggcggatcacgaggtcaggagatcgagaccatcctggctaacacggtgaaaccccgtctctactaaaaatacacaaaattagccgggcgtggtggcgggcacctgtagtcccagctactcaggagcctgaggcaggagaatggcatgaacctgggaggcggagcttgcagtgagccaagatcatgccactgcactccagcctgggcgacagagcgagattccatctcaaaaaaaaaaaaaaagaaaaagaaaaaaaaaggcaattatgttaaatgcaatgtagtatcctggattggatcctggaaaagaaaactaatccaaataaaagtgtatggtttagataacagtatgtggctgatgttaatatcttttttgcgagatgcagtctcaccacaatgcccaggctggccttgaactcctggacccaagcgatcctccctctggcctcaacctcctgagtagcttggattacaggcacgtgccactgtgcctggctcaatgtcaatttttttactttcgacaaatatatatcatgatatgtaagatgtgaacattagggaaaactgggtgaaggggatacgaggactttctgtatgatctttgaaactgttctataaatctaaaaaatgtttgtttagaaactgcaattatgaggttatgaaataggacagcaataagaattaaaggaagatgggggacaggctaaatacacgcttcgaagggaggtgtctctcgttgcctggatgcctccaggcatctaatttgcaatgtgttcaaaacggaatctccctccccactcctctgtccacactgctattaccggcaggaccagccacctggccatgctcatgagaagcttgagtctctgccacgcttccctcttcttactgccttttggtaggtgaccacatgtctacatccactgcttttagaaaaggtttttctaaaagctataaaacttaatggtttgaggagttattatttaattgagacagagtttcagtggggaatgatgaaaagttctgggggtggatggtggggatggttgcacaacaatgggaatgtacttaatggcactgaactgtttatttaaaaatggttaaaatggtaaattttgttatgcatattttactacaattaaaaaagaaaaacttaaaggctcctcgtcgctcttctgatcacctcaaagccctggcacactaatgtccctactcctgctctgtctcccacctcccccactacaccccggctcagctgtacgtgcaaggctgtgaaacacatgctttacctgttattcctcaaacgtccttcacacctttgcgccccatctgagaaaccttctccaaccacctcacctttctctctacctcactactctaataattgaaagctttattactgttctcttaggttcgatagatttcagattttactggggggttaggtactaagtcaaattgaacatcattaaaattatccttgaaaaatcccttaaatccatcagtaagaccaacataaccagtgtttcctcttgcactggaacagatcactgcttcttccactgaatacggaatgaagatgtttgttcacacttccgggtcattttgtgtgagaagtcagcacctctagcactccacgccatgcatgcataggtgacgccatgcacaccgagggcacagaggacacaactcatctgccccataaaatcctcctaactggcctccaggcttcctagctccccacattccaccttgtaaactgccgccaaatcacccattgtaaactctgatgtaagtcctctttatgtaaaaaacaaatcccaactcctgagtcagtcatccaaagacctgcacacacacagcaagcatgacaccagtggcctttccaggggcagctgacggcgtggtttggaggcgcttgcctggctttagcccaagcctttctgctcactgccttaacctctcctcctctgtgaagtaagaacacctacttcacggggttctccagtgactgtgcctagaacgcggcaggtgccaacaaacctttgttgttatcgttatttacagtcctgtgcagcctcgcctgccagcactctctcacctgacttcttccaccccacctctagctcagtggtcctcaaaatatggcccagggatccctgaaaccctttcaggaggtccaaagtcaaaaattttctataacaagaccaagacgttatttgccttttttcctctcatcctctccaaagtctgcagtggaattttccagaggctacatgatgtgtgatgacgtcactgctctgatggccaatagaatgtatgcccaggcattcttggtttttaagtttgttttcttaaatggtagatgttaatagaaacaacccatacaaataaaagctcacaaagctaaaaaattattgtggtcctcaataatttttaagttaaaggagttctgaggcctaagtctgaaaccactgaaatgaacttcctgcctctcttgcctttatgcgcactggacttcccgcccaggacgccctgccctccactgctgctattccaagctcttatctttcaagagtgaactcaaaaggcacctccatgacagcatctcctaatgctccccaccacatccttcagcatctcaactgtgtcctgcaggtggaactaggctctcgctcccttatgtgcatcagtcattcacccactaattccactcattcgcatgtgtgcaatctgccatttcccaagtgctcactaaacaaatctctcctagcacctactttgggccagtcactgaggatatagcagtgacagagatgcttctgtgcttctcttaccttccggctggggacagtaaacaggacatgaagtagtataatctcaggtaatgccaggtgctatgagggaaaaaagctgagtaggagatcacagcgatggttctctctcctatctaagtctctgaagcagtgctacccaatccagtagccactatggtaaaaagaacgcacagtctctcattagtacttatcatatgagttatatgttgatataatattttgaatacattgggttaagtaaaatatattaaaattaatttcatctctttgttttttttactttgagacagggtcttgctctgttgcctaggcttaagggcaatgggtcgcacgatcacggcccattgccacctcgaccgccaggactcaagcgatcctctcacctcagcctactgagtagttgggactacaggcgtaagctgccacgctaagatgatttctgtactttttgaagagatggggtttcatcatgttgcccaggctggtctcgaactcctggcctcaagtgatccgcctggcttggcctcccaaagtgttgggattatagccatgagccaccatgcctggcctctatttacttttttcagctgtggctcacattgtatctctatttttcaggatccttccagagcagaggtgggaaaactacagcctgcaggtcatgtccagcctactgcctgtttcttaaaattttattggaacatgaccatgcccattcatttgcttactgcctctgaatgcttttgtgctataatggcaaagctgagttgttgtgaaggagacagtatagcctgcaacactaggacatttatcatctggccctttacagaaagtttggctggccccttatctagagggcagggcctgtgtgggggtatctctctccccacagcacccagcacagtgcagggggcacccgtgtagtcagtgaagagaacctgcattcgggcagcacaaactggcctaagtttgaatttgggttggcctcccacttgctatgtggccttggtgagttataagctttctctgggtttcagtctttccttttctaaaatggggcactggccactttaagggaagtgagatgacacaggtaaagtgtgagttaacatgcctggctcacagcaggaatccattgacactggctggataaaagacagcaatttcattaaaatgctgaataatcattctcctcttggattgggtgtgttatactcaaaacaactaccatatttacatcctaaaatgaaatgaaatcaaatgaaacttcttagcaacagcagtgcattaataataaccaccagcaagcaatggggaggaagaaagaggcaagcctttctaacactaaagcactggcggatgatgagtccgcctcatccctttcctgcccctcctgcagcccacctttggacaattcccggttcattaacactggcactagaagaataagcagaggggagagaaaaagcctcgaaccaaagacgtactaaaactgaacccattgacatcaacgaggtttggaagggcccatataagtgcaattcaaaagacagtcccagccagcagcatcaatgtcactgggagtttgttagacacgcagattcttcagcccaatggaattaggacaatttgcattaggagaccctaggtgatggcatgtggcattcaccttggaaaagtgctggattagaatccatttattcatgctctcttcacttccccctccccctccactgataaacaggggtggttatatctactttcaatagatggttcctgactccttcaaagtaataggcctggcatagccactgcaactccaggccccgcccccaagggtcttggtgcaggcagagtgcatagcctaagctgcgttcctgattcatttgcagtcgggtggggcattctttttccaatagagagcctcgttcgtacttagccatcctcctaaggtgaggactgggtgctgataaccattcaggaaacccacgtgtgtggaatctgccatttgtcaagtgctttaggcggggttcttacaggggaaatgcagccagaagcagcttcatttcgaccacaggtgacaccagctctagctagctctagcctagtccacaatgcacgtagtctgcctggggagcccgcgacggaagttgccaaagtagtaactacaatatggtgtattctgattaatctgctcttcctagtattaggatgcccatacgtcccagtcctggagtaattattcatagtactctcaaaagaacccaacttgggcaataaattactgtacatggtcaacacacctagtacggggggtgggagacagagtggtctagtaaggggcccatacagctccagcacagaccacagggcatctggaagaagactaagaatactatttgtagtaagtgggagggagcaaactggtcattcatgaagatgtttcccaagagtctgcatgtgcgtgatagcacacaagctttaggatttgctgtctctgtttctcaaggagcttcccatccaggagagaatgtgggtgtgccatggggcatgagaggaagggaacggcacaattgagttggggaaaagcagtcagattggctggaatcaactgaagaggcaggagatagagcaggatgtgtaggtgaggggccctgaatgacaaccaaggcatgatcagaggctgggtcctgacacaatccaggcgatcacttgggaggtcagccctttggaggtcagttggcggcagcgctgttcactggttgaaggaggactagaggcagggagaccagggagaaggctacacagtgcaggcatgaggcaagcagagagcaaaccagggttgtgaaagggaaatgcaggcacaggatgcaagaggcctctcaaagaactgatgacaagttagaatgagggccaaagaaggtaaattaaaaatgaccccaaatgctctaattttgagaagattcaagcttaggtatttaggggtgaagtgctatcatgtctgccactaacttagcaggagttagtaccagacataattcaggaggaaatatatttacataagcatacagataaggcaaatatggcaggatgttaacaactgctgactcataatggttgggggttagcaattactggctttcaacattttggtatggtcaatattttttcctattaaaaagttgggtcttgggttcagaaccaaaaacaaaaaaagttggggaatatatatatatatttttttcctcgagaaagagtctcactctgtcgcccaggctggagtgccggggcacgatctcggctcactgcaacctctgcctcctgggttcaagcaattctcctgccctagcctcccgagtagctgggatcacaggcacccaccaccacgcatggctaatttttgcatttttagtagagatggggtttcaccatgttggccaggctggtctcgaactcctgacctcaagtgatccacccacctcggcctcccaaaatgctgggattacaggcgtgagccactgtgcccagtcagaacattttttttttttttaagtccacagacttggggatgggaagggcagtcacaatcacaagattttatacccacaaagtctacatggcacaatggagctatcaagtaagcagctgggcatgtgatgtcactgtggaagtcacctaaatacaggtaccagatgcagctacaagcagggaggtcactccaaaaaactggggaggaagagataaagaaaagagaggtctttggaaaagctgcacatctatgggtaagaggaagaagacaaaaggcaaaaaagagaaacatttggtatagtctggtataatagaaccccaaggaaggaaataccgttaagagggcatggtcggccaggcgcggtagctcatgcctgtaatcccagcactttgggaagctgaggcggatggatcacctgaggtcaagagttcgagaccagcctgaccaatatggtgaaaccccgtctctgctaaaaagacaaatattactcggacgtggtggcgggagcctgtaatcccagctacttgggaggctgaggcaggagaatcgctagaacccagaaggcagaggttgcagtgagccaaggttgcaccactgcactccagcctgggcgacagactgagactccatctcacaaacaaagcaaaacaaaacaaaacaaaacaaagagggtgtggtcagctaggcaccgtggctcacgtctgtaatcccaacactttgggaagctgaagtgggaggatcacttggggtcaggagttcgagaccagcctggccaataccatggtgagaccctgtttctacaaaaatattttaaaaagccgagtgtgtagttccagctgcacaggaggctgaggtgggagcactgcttgagcccaggaggcggaggctgcagtaaggtgtgatcacgccactgcattccagcctgggtgacagagcataaggctgatggatcaaaatgaggacaaggactgagaaaatgtcagcaaatgcagtgatcagaaattcactagtcatttgtgaccttcaggggagccgtcacactcagtggtgtgagaggttagacagaaaatgactgaaggcgagagcaggtcatgaggaaatggaggcagacatccatttcccccagtacagtgctgggatgacccaaaagcacactgggggaccagagaaatgctttcttccttggcttgaagatgatgtcatcaaccttcagggccctcagaatcccttaaataataaaacagtcagagcacatgaataccgggatgctttcagcactgcatatgtcaagccctgaggctcccagaatccctggagacgtatttgtgtgtctacacttcccacctgcactagcggtgaccacacacacagtccggtgaccacacacacagtccgctgaatctgccggtcaaggtatctatcttcaactgccctcttccagagggagctcccacaaaaaggaccagaattaaaaggaggaggaagaacatcatcggagctgctgagtgtgaaaagaccagctctcttgcaggatgcaaatgaaggcctctctttttaagggtgcctgcaggaaatctctctgtcagtgctagctgggaatattcatgtcattgttgggtaggactgactgcctttttttttttctttttccaagcatgactcagtgttttaatttttttttttactttcaattatcatagtcagactgtttcccaggtatagttatgctatcaatttaaaccaaaagtgacctgaaaaatgtcttactcctttgacttagctgcagaatattaaatattgctgtggcctctctaaaaatgcaaaccaactcaaaatcccccaaccaaagaaccagattaaacccaaaaaggacattcattccaatccttattgcccactgaatacttctgagtggtatgtcaactgactgcaatgtttaaaccataaaaatgtgcttttcacaatactgcttcaggagaacacagcctacctgtgtctaggggtgacctggacaaagctgacccaaggatccatccaatacagtcagcctggattgaaggacattaaatcctcaatcacagagtatagctaacgaatgaaacaaaggcaaataacttggagtagataaatccagagagttatccagtaacacaattcaattttattctcaactacagcaaattccaataagcattttgctcttccctggctataactgcacacatcaagtggctcctgacagagtccccccgtggctggctggaatgtcagaagatgaagcaattccgaacgggcactcttgctcagtaagagctgcaaatgtggatgggcagcatttagaccatgaccttctccaggactggcacccattcatgggcaagtggagcctcaggaaggagctacagttaaaaataccgagatcctattaagtgagaaaagtgatagcctcttgtaaactggaaagcacattatagacgttcctgattgtaacttgccccttttgattgtcattttaaatcagcaactccccatcgccatccagaagcaggctaagccttgggcaaggaaattccaaaagcttccatcagaataggagcacagatcatatcctcctgggtgaaaacccacatgtcacagaaaaccaccctgactccaactctgaggggaccgaccaccagcggcagctgacactgatcacgtgcccaggactgttgtgctggcaattcatgttatacacgacaattgcacccttttaaaaagtgctggcccccaacaggttccactggattccatgagcccccatggtgggttaagtagtaaaaaatagaaaaagttcctcttagtataacaggaaaatgaaaaaacaaaaacaaacaaaaaaaaaaaccaaacaaacaaaacagagagaaacagggataaaagtgaagtagagatggggaaggtgcaaagaggcctctaatgtcctaaagcaaaaacacacggaaactgaagggaacagaaactgaaattgaggtggaactcagcctctccaaggaatccttcctgaacctgtctcatgactcagcattcccagccgaaggatgacagcagcagagcggacaggaggtcaagttggagctcctaatggagctgaccacttctgaggcaacacagaaatgccagttacgtggagtgtctgcacacttgttttgctctaggaggtggagttggggaataaaactgaactgcagttcagtgttggaatgaatcagactacagaggttgcttcattcaacattgaggggcagtcaaaggttctctagaaatgcaatgtgtttttgacagttattttgagaatgactgaggggtcagggaatgaaaagagtggaatctgcagaagcacaccgccagtgcgaatgcagtgttcctcccgtcctgctccctacccatcatctccctccctcctgcctgcccactggcacaacttccacctatcccaacatcctgtgcctctctccttcctcacttgtagtacctcctattacactaagactttcaactgtttaaagaagggatgattaatgccaaccacaaggcttgtgattcatgttggatcagggcactcggtcacgtatagtaatgatctctgaatcctgaacttaagtattctcaggtgagaacaaagtacatttagttcaatttgtattcagattcctccacttagaagtgtgacactgggcaatttacttaacctctctgttcctcagcttccttctctggaatatggggctaataatagcaccacagggttgttgtgagcgtgaagtaaaacatctaaagcactaagagtgcctggcacacagtaacagtatcctggatcatgactgctcttattaccttaaaatataaagcaatactctatcatctttgtaatttataatctcattaccagtcttgagaatttcaagagacctttcagactctggaaacatacatacatacatacagattcattccatccccctcctggaggacggccggggttactttaaatgtgcattactgaatttctcacaaagtaacagaggtaggaagttcatgagtatttctagaagaggtttaataaagtcaaacctataatccatctggtcactagcaacacgagccattaggaattcctatgcccctgaaacaaccaccttccccacaacccgcctcgtgcaccttttgcttcccaaggtgcctctttggtgcagcatcaccctctttctcatggaagtgatcttctgaaggcacagggctggctctctctgacagacatcagaatgctgtctgctaataaccaagtggccatcctaggcttgacccagctacacttctggttattccatccgagcaggatcatatcggggttaggaagatagacctcttatttcattgcagagggagaaaatgaggcagtgacttggtcaaggtcattcagagtaggtgacagccaggaagagcacccaagggttttggcttccaatcacagtacaaaacacacacccttcatctggggaaagtacccttgagtcaggcagcagccagacagaagcaccatcagggcactgaggcccgagggctagaaggggaaaaatcaagggacaaagaataaaatcacagaacagctgttaagagtctacaagtgctgtgatcctatctgaataaaacgcaatttagattcacttagtcctgcatcttggttaaccttatataacttcttcacattacatcactaagaacaattgcttttaatgggcccagcacccagacaagtgagacaaacttcacgtgccatgatgctacacctaaatagctttccccatggaaatgctggccagcgtaggagccaaaaataaactgcaaagccaattcccgagggacctgtcatcagggatgtttcacacacacagcttcataaaagcagggtgatcacagacagccctaatttagaggcactatatctcaaacctggtgaaaccctgaatgtcatggcaacttaaaacaaaagacaatgcaaaagagatgaaaaagcacaagaaagctaaagcataaacgctttgcctccgaaacgaaggctgaacttgaactgacagacagcagtcctgctcccttacctcgcagggggctgttctgcccaaccatgacaggtggagaccagaaggacccaccacgtctagccagtgctcatgaaggtttaagtggctgctggcatttggctttgttacaaaattttattcaaaggatgactggtgatggggaaggggcaagcctcctctaaggagatccatggccagatggacagtttcaagtggctacctcgctgaacaggtcagaagactggagaaaggaagaagcatataagagacactggccactagctccttttgagtccttaagaggcttaattttggtggctggaagcctcaggaacacgacaaattccatagcttcatggaagaacttactttgtttctgttgctattttcatgaaggcagcagggaaaggacatgacttgctgcccagtctcttcatctctctttgtaaatttgttcactaaaaacttgagactaagattaagcctttactcattgccctccaatttacagagaaaactacaaaaatacgccacaccctatgaaacactccacattaaatagatactactaaaaaatttcaatggggcaaggcactgtggcttatgcctgtaattccagcacttggggaggccaaggccggtgaatcacttgaggccagaagttcaagaccagcctggccaaaatggcaaactgccgtctctactaaaaatacaaaaattagctgggtgtgatggcgcatgcccataatcccagctatgcgggaggctgaggcacaagaatcacttgaacccgggaagttgaggttgtaatgagctgagatcgtgccactgcactccagcctgggtgacagagagagactctgtttaaaaaagaaactcacacacaaaaattttcaataggtagcagcttattaaaaaaaataagtttcgggcgggtgcggtggctcctgcctgtaatcccagcactttgggaggccgaggcgggcggatcacctgaggtcaggagttcaagaacagcctggccaccacggagaaaccccgtctccactaaaaatacaaaaaattagccgggcgtgatggcgtatgcctgtaatcccagctactcgggaggctgaggtaggagaatcgcttgaacccgggaggcagaggttgcggtgagccgagctggcgccattgcactccagcctgggcaacaagagcaaaactccgtctcaaaaacataaataaataaaaaataagtttctcaaaaccatcactactgtagtcccagctacctgggaggctgaggcaggaggattgtgtgagaccaggaattcaaggacacctgagtaacagtgagaccccatcccaaaaataataaacaaaccagtaactcaaaaaaaaaaaaaaatctgccactacattattttgtcaataattgggttctcaaatctcataactagattagtcaatcttggtctaatggtctttcctttacggcatactatcaccttgatggaattcataaggagcaggaggtgagaagaaaaatcatcctaagccacagttctgcaaggtcccaggacccaccctaccaccctgcttggtggtcagtaacagaccaggagacattcagctaatcagtcacctgtatctatagctcatggtaacagagctacctatcaggtataaactccaccctccaaaacaaacctattctaaatcctaaaagaactatatcttgccacccataaatgggcatcccattccaccacttccttggaatttctgcgtcccttggcttttgctaaacccagatgctacaatgacaaaataccaccaccgagccacaaaacggatttcaacaaattcaaagcaagtcacaggaggccagctgcaaaatctatccaaagtggtgcctcaaagttgttgttttttttttcttttcttttgagacagagtttaactcttgctgcccaggttggagtgcaatggtgccatctcagctcaccgcaacctccgcctccctggttcaagcaattctcccgcctcagcctcccgagtagctcaggttacaggcatgcgccaccaagcccagctaattttgtatttttagtagagacagggtttctccatgttggtcaggctggtctcgaactcctgacctcaggtgatccgcccgcctcggcctcccaagtgctgggattacaggcatgagctaccacacccggccgttgttttcgatttaactccaaaataggtatttcaagtcaaactctgtataattacacatagtgcaggaggcaaacggagcataactgcaaacaaagttaaccaccaaagtcaagacggacgggaacaacaactgataaacatagcggctcccagtagtgagctgggcctacctccctgagtcctagggcaggaggccacaacacagaggatgctgcagtcaaatgagttgcgttccaaaaatcacgaatctctcaaatagatgggtggtgaaaaacattcttaaaaactcacagaaagacaccagcaatcatctggtgtcacacagtatacagcaataaccctcttttactgacacaatactgggtaatttttaacaagcattctgttgcacaaaagtaatattttccaaatactcttgtaaatggactgataattttccttccaagtctcagagctgttgcctgattcacatttctctgaggggaagcagggtcctgtgtgtggatttgtgtctgtggatgtatgtgcatccccaacaaaaagaccccgctggtatcagcagtcacttctgcctctaggaaatggatcatgtgctcttctctggagtggggcctttttccttctcaagccgttgtcacagaccccgctttgtagtttgacatgaaaccccgttcctctgtagtctttgtctcccactgtgtgagaaacccagatcaacttccaaagtgccctcccctgaaatcagacctctcaacctcccaaggacctaaaacagcgtaggcctgattcctgcttagaaatgttttcttgaaggggaggggaagtaggagagaaagaaggggtgtgagatacaggggggtgtgtgtgtgtgtgtgtgtgtgtcaattactgataggaattcacattctggaaaacaagccaccaaaccaacccgggttcaaggtttcgggtttatgatgacaagcctctttgttttgtaaaactgctatactcactagcatcaccccaaaaaccatacgggagtcagatgtctgcttaacagcttcaggtcaagaaaaaaccttcgggtttccaaattggtgactcccctctacccagggttctggattatttttttcaaggagtccatatgcacttaggagtcatcaatcccggtcgcagctgtcagaatcctcccccccaagtactattcataccggggctctgattgctaatgattttactcacaaagttccctgcagcaattaaaaggaggcagcagggtaaaacaaaaagaggctgggtggcttcaccataatgcagcctgtaagctagtgaacttcttgggttcggctgggattttcacctctatctttgttttggaatgcccacaacccctccctgcacggacccggcacggccttcatttctggatgcacaatgcagtaccgagctccttgggggtcagcaaaacgccgcactggtgtaacgccgaacgcgccccagaacctgagtccccacgggagtcggtccacgtctctaaatctcgaggccgacaccacagcataacatgtcttagaagtcccctcaagtcgggaagcccagggcccgcccggtcccgggccagcagtgcctggctggcgtgtgcgcccagagctgctgcaatgactttgcatggagtgtaccctccactggggctgtcctcccgcgtcggccactgcagtggcaccgctccgggcagggccctgcacgccgtccttccctggcctcggcccggccgccgaccccctgccgcccgcgccgcccagcccccgcccgccgcaccttggtctccttcacatgctgcttgacgccctccgggtaccactggacgcgcacgtagccgcggcgcagggggctggcccggccctcctcgtggcccgcgcccccggcctcggagcaccccgagctcccgcggccctcctcctcgccctccgagtccgagtcctcgccgtggatgaggcgcaccagcccgaagtgcacggagccacggtaacggcccgacaccaggtcgtgagaaaacagcaggcgctgcgagccggcttctgggccggagtccgaggacggcccggaggccgagtccgaggcgggcgccggcgccgggacgggggctgcggctggggccgggactgcctccggggctggagccggggcctgggctggagcgggagctgcgggcgtgggggctgcgggatccgccataactgctctgcgcgagtctcgggcggcggcggcgacagcggcggcgaacgaggcgcggggaggcgggaccagcgggcgccgggggcggggccatagcgcgctgacgtgtccctgcgtggcgccgtcgtcagggagccgggatgcagttgctaggagccaccgcctcgtcgctaggggacgctgaagatgccgcggggggcgggggcaggatggaatccactaagaaggggcgagaccagtgaggattcaactaaagggagcgagaaggggcggggacccgggaggaggaagtggagtggccaccgaggaagaggggagtggtcggggtggggcacaggatggtggagagactgtcaacaacttttaatgagctcccttggcgtcctagcctagcccccaggcactgggagcattgcagaaagagaaagatactgtccctgtcctctaggtgtttccagtctagttggggagacaaaacaaatacacattaaatagataacaaacaactccaacttgtaaggctataatagatacgtgtagagcatatgtataatgcactgtattcaggaattccaagcagttcgaacgtcatgacccctcagaagttgacccagaagctggtgaaggaggcccagagaaaggtaacaaaaggatcagtggtcccagtggtttggctacaaatccatgcagataaattcaaagctccctgaagccaagaatgaatggcaagaggtagtatagtaaggtagctaagagtggggaccacggattccaatttttggcactgccacttactaatctataaaaataggcacactgattaacttattttcatcttaatttgctcatctgtgaaatagggatgataatagcaatactcatctcattgggcaattggaggattaagtgaagtagaacagtgcctggcatttagctccttcgataagcttaaccattgttgtactatttccaaactccctgcctagactaaattccagactggcagaactgttatggtctgctccatattgtcattttaaaatataaaaagtaggccgggcgcggcagctcacacctgtcatcccagtactttgggaggctgaggtgggcggatcacgaggtcaagagattgagaccatcctggccaacatggcgaaaccccatctctactaaaaatacggaaaaaaaaaaaaaatagctgggcgtggtggcacatggctgtagtcccagctactcaggaggctgaggcaggcaaatcgcttgaacctgggaggctgaggttgcagtgagcccagatcgcgccactgcactccaccctgggcaacagagcaagactctgtctcaaaaaaataaataaataaaaataaataaaatataaaaagtaactctagggccaggcgtggtggctcatgcctgtaatcccagcactttgggaggcagaagcagatggatcacctgatcacctgaggtcaggagttcaagaccgccctggccaacatggcgaaatcccttctctactaaaagtacaaaaattagctgggcgtggtggtgtgcacctgtagtcccagctacttgggaggctgaggcaggagaattgcttgaatctgggaggcagaagttgcagtgagccgagatcatgccactacactccagccttggcaacagagcaggactctgtctcaaaaaacaaaaaacaaaaaaaaggctggatgtggtggctcttgcctgtaatcccagcactttgggagaccgaggcgggtgggagacccgaggtcaggagttcaagaccagcctggccaagatggtgaaaccctgtctctactaaaaatacaaaaattagccgggcgcggtggcagccgcctgtaatcccagctactcggaaggctgaggcaggagaatcacttgaacctggggagtggaggttgtagtgagcctagatcgcgccgctgcactccagcctgggcgacagagtgagattccgtctcaaaaaaaagtaactctaggccgggcacagtggctcacgcctgaaatcccaacactttgactgcgcctgaaatcccaacactttgggatgccaaggtgggtggatcagttgaggtcaggagttcaaaactagcctggccaacatggcaaaaccccatgtctactaaaaatccaaaattagctgggcaaggtggcaggcgcctgtaattccagctacttgggaggctgagacacgagaaccacttgaacctgggggttggaggttgcagtgagcctagatcacaccactgcactccagcttgggtgacagagtgagactctatctcaaaagaaaaaaactaactctaatttaatgtgtcacctaagtttcaaagggtttagatacattctcagaggacagatttaaatggattgttaaggaaaacaagatctggccctaacctttctcagtcaacatcattttttccacatttttctacacgatcatcaacgaaagactagtaagttggatattacagtatttaggttcttcaaagaaggcagaatcccagctctttgtgttgtttacaggatcctgaagatacagaactatgttcatagaaaagttggttgggtgtggtggctcacatctgtaatcccagcactttgggaggccaaggcagatggatcatttgaagtcaggagttcaagagcaccctggccaacatggtgaaaccccgtctctgctaaaaacacaaaattagccaggtgtagtggcgcatgcttgtagtcccagctactcgggaggctgatgcaggagaatcgcttgaacccgggagcaggaggttacagtgagccaagaacacatcactgcactccagcctgggcgacagagcgagactgcgtctcaaaaaaagagagagaaaagttaaaagaacatgcacaaggtcgggcacggtggctcacgcctgtaatcccagcactttgggaggctgaggcaggcggatcacttgaggtgaggagttcaagaccagcctaaccaacatggagaaaccccatctctactaaaaatacaaaattagccaggcatggtagcccatgcctgtaatcccagctactcaggaggctgaggcaggagaatcacttgaacccgggaggtggaggttgtggtgagccaagatcgagccattgaactccagcatgggcaacaagagcaaaactccatctcaggaaaaaaaaaaaaaaaaagaacatgcacaaaacagatggcagcctaagtacttaagatgtcttaggccaagtactaatagagtattgatgtaatattgggatcagggtggttgtcaatggacccaaatcttagaaaatttatctactaagatatagaacaaatgggctgaatcagctgaagggggagttaggatatgattttggggcaaggctgggttctcaaaccatggccttcccatcccagaacacaatgccaaatgaccatctggaatcactgctgtaaggacgcaggtccctactccctctcctgtagagacctgggagattaaacagcagtaacatagtagcttctgttctgcctcccatgaccctttcagccctgttttcttgccccctgataacatagcatttattaagcacatattattgaccaggcattgtaccaggtacttccaagcacattatcttgtctgttatcacaatcttggatatagagagtttttaacctcattttaccaatgaagaaatagggcccaaggaatttggcgcctaaggtaacaggtagtaacctgaggagtttccccactctaagggcaggggcttttgtagttatgctatttctttaggcttccctcagaagaactcctgattgcacaggggagtccatgtgtctatgtgtcccacggcgggataaggcagtgcagacctcaaatctgctttttgtttcatggcagggtctcactctgtcgcccatgctggagtgcagtagcgtgatcttgactcactgcaacctccgtctcccaggttccagcgattctcctgcctcagcctcctgagtagctgggattacaggcgcccaccaccacggctggctaatttttgtatttttagtagagacggggtttaccatgttggccaggctggtctcgaactcctgacctcaaatgatccacccgccttgccctcccaaagtgttgggattacaggcataagccaccgcacccggcctcaaatctgcttttgttgtcaaaaaatcaagtgagttttgcattgtactccagagtatgcctatgtttgttgttttaatgtaaaaactaatgccctttcctccctaatcattgagtaatatcggcactcctggaagacgtgttgtgtttattctgcggcttcttgtaataatggctaataatagctatcacttattgagctgtaacttcatgccagatactctactaagtgctttacatagattatcaggatactgccaggttggaggtaagactccttgattttacatgctgatctctccctcactagactaaacccttaagcatgtggaccatgttgtatttgtgtgtgtaaccctggtgcctaggacagtacctggcatagggatggagctcaataatgtgtcgtattaggctaggcccatacagtggctcacgcctgtaatcccagcattttgggaggccaaggtgggtggatcacctgaggtcaggagcttgagacctggccaacatggcaaaaccatatctctactaaatatacaaaaattagccaggcttggtggcgggcgcctgaaatcccagctactcaggaggctgaggctggagaatcacttgaacccgggaggcggaggctgcagtgagctgagattgtgccactgcacttcagcctgggagatagagcaagactccgtcttgaaaaagaaaaaaagaaaattatcatgttagcggatatcaaaggcctgagaacctgtacctccattctgtcagtttcctatcctttttccaacaaccaaaagttgaagaagctgggacagagctgccctctttggctgctccaaatcctttcaagtgcccccagtttcaactgcatctgagctgctttagagaatgagactcagtaaattcctacccatccgatggtgtcttttatggacctcactcagacccaagatgctctggataaggtttgaggcttgactccttcccagaccctgagcccccagccacggtctccatacactcaggctggctagcagggtaagtgtggatggaagccgctgcttagtttttatttttgtcattgttgaggtgtaggaaggaggaaaaaaacttgattccctaatgaagaaaccctctcttatcatggccccatctcccagcctttcgtggggaatagagctatttcttgggaggatttcacttatttataaatgtgcttccagaaactgagctggtctggcctctccccttgctaagtggggtgggtggtgtgcaggaggcggcagagccagcagcagagtgaactggtctcagggaagcaggccctgtctcgtccctatcttaaccagccactggagcacctctctggacccacaaagtatgctcaggcccaacactgccctctgcgggagcctgcttggcctctccattgctgtgcaagcgatttcagcctggcccaaagagctccttccaccctggagcaggtgtttgggaaggctagggtgccttaggcactggggacttcagctggggggtggggtgggaggtgagctgccttgggaaaccccccacaccctcatgtggctggctgaagaaatgcctccgaggctccagctgaatgccgctcaaggcttttggagttaaaacggcccttctcattcctggagcctcacctgctccttgcacaggtgccctgggaaaactgtgggacttgcccaaggtcactctgcagtacagtcaggatcaggacccagcccagctggcccttggccattctgactcctgctgtgagggtgggttgcaatccactgggcaaaacactttatgctggggcaacagtgaaaagtttgagcaatagtgacagcataggatcaccaggttcgtcctgtttccctccttcctgaagatacagggtgaggcacagtgaatctgctggaccagcttcaagaacaatatgtcagcctatccactgccacctcccacagctccagactcgtgggtgcttcctggatgtgaccagccataggtacaaagtagactcatcatcttttcctcaaatagtttcttctcccagagttctcatcctgatggatggcagtatcacttacctgggtactgagctggccacctgagggtcagccctcactcttaagctctacatgcaatcaaagcctgggtcttggcccctcactgccttttcacacccttcctgtccagagctgccccaccaggggggcagatccatggagatgtggggaggtgggaggtacagtggctgagagtgagcttccggagtcacagggacctgggtttgaagcttgtgctgctgctggtcactatgtgaccttgggcaagttattttactctctaagcctcagtttcctttctgtaaggtgggaataataataatacctacttcataggactgtggagactgtaactgaccaactgaatataacgtgctttgcccagtgagtgcatgatggcaggcctgataacattagcttttcttaggaattcatttccatctcttgcctagacctcggctgtaggcccctcaccaggccccaggccgtctaatctgtctgctgccttgttcccagggtgactgaaaatgcaagcacggtcattggactcttggctttatatctttctgtggctccccagggtccacccaagaaggtgcatgtggcctttcataaactgatctgatccttccaaccccccttccccctctgcatccagcatggagtgctctgtgctccagcctcagtcacctacttcaggaaattttttttttttttttttttttttttttttttttttgagacagagtctctctctgttgctcaggctggagtgtcctggcaggacctcgactcactgcaacctccgcatcccgggttcaagacattcttgtgcctcagccttctgagtagctgggattacaaatgccccaccaccacacctgggtaatttttttgtatttttagtagagatggggttttgccatgttggccaggctggtctcaaactcctgacctcaggtgatccacctgcctcggcctcccaaagtgctgggattacaggcatgagccaccaagcttggcctgttttttatttttttattaaaaaaaataatagagagaaggtctcactatattggccggactggtcttgaactccttgggctcaagcgatcctcctgccttggcctcccaaagtgccaggattataggcatgagccaccgtgcccagcctcttttggctttttaaaatgtggctactagaacatttaaaatcacatgtggggctcacacaatcttactattgggcagtttggctccattacttggggagccgtaggtcccttctttgtccaggaggtggcaatccctccctgccttggatgcttccattccagaatggtctggaaggttcctgaggtaagtgcctatctaatacggcgatattgagccccaaataaggcagggtcccactcagccctgcctttgagtcacccacctcaacggaagactctgggccgggcgtggtggctcatgcctataatcccagcaatttgggaggctgaggggggcagattgtttgaggtcaggagtttgagactggcctggccaacatggtgaaaccccgtctctactaaaaatacaaaaaatagccaggcgtggtggcatgtgcctgtaatcccagctactcaggaggctgaggcaggagaattgcttgaacccgggaggcgggggtttcagtgagccgaaatcgcgccactgcactccagcctgggcgacagagtgagattccatcttaaaaaaaaaacaaaaacaaaaacaaaaaaacagaagactgtgcctctagctgataggcacctgctctgtgggtggcacgatgccacattctcaacccagcctctgttttccaggagtgcataagcctcttggggggacaggtgtgtagtggatgctgtggtgcacctccccatcacatccctctccaaacactgcccttggctaaaagaagatgcctcccccaaccactgactgtctgtaaggggcacaaagcctggccaacatggtgaaaccccgtctctattaaaaatgcaaaatttgctgggtatggtggtgggcacctgtaatcccagctacttgggaggctgaggcaggagaattacttgaacctgggaagtggaggttggtgaactgagattgtgccactgcactccagcctgggtgacagagtgagcctccaccaaaaaaaaaaaaaaaaaaaaaaaaaggaaggaaggaaggaagaaatcaatcaatcaatcaatcagtcagtggtgggtgcaacatctcaggtgtctgagaggtacagggatggagtaagtgtaaggactggggggctggatggctgttggggcagtcagtgcagaggagaaaggcagtcagaggctgggggtgaagaatcactgcttgaaggcaaagtggaaaagccagagggcctccttggcagcatgtaaagaaactcgcctcctgaagttaaggaacagagagaagtcagcatggcagagcctgagagcaggttgaattcccaaccttaatgagtcagcgatacagaggaggcccctggggagaagcgggagccatccagggacagaggttagtgcccctccttccttggggacaatgcctcttccttaggagacatgtactacccccttcccaaccctgagtatatactgcacctcctcttcttgcactgggccagtaactagggctaaatcgcaacctcacctactggtgaagtgctgggtcggctaagggaggaaggaggctctgtcctgaaggagctgcaggtcccagccagagccaggagagtggggactggaatcagaggatgctggctgggccaaggggatcagagcataaagttggataaggaacgtgtgttggtatgggagctcttttccctgttacagaatttatcaccctggcaaggaccctggtacttggaagcttggagaaagtgattcagggctcttacccgcagtgggcaggactgctgacggctcccagctggattttcctgcaactgccctcaatgaagcaagctgttccacccaaggttgatgcaggacaaagaggtgggtccagaagggcttcccaagtctgaagctcctcgggggatgcgccaaggcctcggttacagctgcaccatcacggctcagcttccactgtccagccctctgccctgctccatggtaggggtcgctcatgagacctctccccaataaacttgccgcacacagttctccatctctcatcccccggggagcctgccacgtggtagtactcaggctggaaaggtaaagacgataacgcgagatgtgctcagtgccaggtctgtggggcagacctttagtgcaggggaggagttgagagagaaagtgaccatcgaaaccaccaaaaaaatgcagccattgcacaagagcctgaagagagggctatgcttcctgcacgccgggcctctcaactgctctgcatggaaaaccggtatctcagaggcatcgtcaaggtgtccctgggacatggccatggggcccactccttggtctgccccaaatgggctcccttcagtctgggtgtgaaactgggcagctgacacacggaggggagggggtgtgtctccatgcgggaagctcccagattccaggtccagggcttctgcactgggcccggtggggatgctcactgcccctgcaccaggctctccgggggtatcagcagctgcagcaggctcggtgcccgggatggggtgggggccgtggggaggttttctccaacccccggccgtggcagcgagtcagtgt

SEQ ID NO: 392 - DNA, 32252 bp, Homo sapiens
tgatctcagctcactgcaacctccacctccagggctcaaacaaccctcctgcctcagcctctcaagtagctgggcctacaggcatgcaccctcatgcccagctaatttttttattttttgtagagacagggtttcaccatgttgcccaggctggtctcaaacttcggggctcaagtgatctgcctggcttggcctcccttcaaagtgctgagattacaggcatgagctactggacccggcctcaattttcagcaaaagtgtatgagtatgctcctataccctggtcaacattgaggttgtcaatccttaatttcttttttgctgaacttttatattttaattttatttatgtatttattttgagatagagtcttgctctgttgcccaggctggagtgcagtggtgtgatctcggcttactgcaacctcagcctactgggttcaagtgattctcctgcctcagcctcccaagtagctgggattacaggcgcccgccaccatgtctggctaatttttgtattttcagtagagacggggtttcacccgctcaggctagtctcgaacttctgacctcaagtgatccacccgcctcggcctcccaaagtgttgagattataggtgtgagccactgcctccggccgatttatttatttttatttttatttatttatttattttgagatggagtttcactcttgcccaggctggagtgcaatggtgtggtctcagctcactgcaacctctgcctcccgggttcaagtgattctcctgcctcagcctcccaagtagctgggattacaggcgcccgtcaccatgccagctaatttttgtgtttttagtagagacaaggtttctactaaaatgttgaccaggctagtctggaactcctgacctcaggtgatccacccaccttgacctcccaaagtgctggcattacaggtgtgagccatggcgcctggcctatatatttatttttaagagacagtctaattctgcggccaggctggagtgcagtggtgtaactgtagctcactacagccttgaactgctggactcaaccgatcttcctacctcagcctcctgagtagctaggacttcaggtgtgtgcataccgagctaatttctttttctcttttcttttcttttcttttcttttttttttttttttttttttttgagacagggtctcactgtatagctcaggctggagtgcagtggcatgatcacagctcagtgtagccttgacctcctgggtccaaacaatcctcctgcctcagcctcctgagtagctgggaccacagaaccaggcctggctaattttttgaattttttttttttttttttgagacaaagtctcgctcttgtcccccaggctggagtgcaatggtacgatctcagctcactacaaactccacctcccgggttcaagcgattctcctgcctcagcctcccgagtagctgggcttataggcgcctgccaccacgcccggctaatttttgtatttttaggagagacgggtttcaccatgttggccaggctggtctcgaactcctgatctcgggtgatccacccacctcggcctcccaaagtgtcgggattacaggcgtgagccaccgtgcccagccaattttttgatttttgaaacatttctgatattctgtttaactttctttttgctttggccaatctttctttctctttccttctttccccctccctaaccctcccttcctctcccctccccaattctcccctctccagttctcccctgtcctctcctctcttcccctctccttttgggacagggtctcacactgttgctcaggctggagtgcagtggtgctatcattgctcactgcagcctcaatctcctgggcccaagtgatccttctacctcagcctcttgagcagctgggaccgcaggagagcacaccactacacctagctaatttttgttttgttttgtttttgtagcgatagagtttctgtataatgcccaggctggtctggaactcctgagctaaaatgatccaccttctttggcctcccaaagtgttgggattacaggcctgagccaccccgccaggcctctttcttttctttttcttttcttcttctttttttttttttaagctgctccttgctgagcagggctaactagtaagcagtggtctgtcccaatctttctattatgtttctttttcttattgctttgtaacagctttttgtattttgtttatttcatcaaccatttcttcctagattgtaaattgtctttcaaccttacctaaagtttgccataaagaagctctgtcaatttttagcttttctttgaagattttaaaacattaattgctaaaaagacagggacaacagaaaacatgggtgggctacaaagtataaaaagtcttgcatagtcattaccattttgatccctggttgcttgcaaatgtgcttcaaatcccagcttgggcacttcctgtctgattgtagggattttttttttaatttttttttttttagagatgggcatctcaggttgggctcagtggctcatgcctgtaatcccaacactttgggaagctgaggcaggtgggtcacctgaggtcaggagtttgagactagcctggccaacatgttgaaaccctatctctactaaaaataccagaattagccgggcgtggtggcacacacctgtagtcccagctacttgggaggctgaggtaagagaatcgcttgaacccgggaggctgaggttgccgtgagctgagatcatgcaactgcactccagcctgggtgacagagtgagagactccgtttcaaaaaaaaaaaaaaaagagagagagaaatgggggtctccctctgtcacccaggctggtgcgatcatagctcactgtagcctcaaactcctagtctcaagcgatcctcctgcctcagcctcccaagtagctgggggtcacagctctgagccacctcgccaggctgcaggcaaatttcttaatcttgccgggctccagtcttccagtctataaggtgggaataacaaaatttgcatataggaatttggggaaacgtgtagttctgggtttgggtgaagacctccacttttgtagtaggttcataaatcaaatcagagcaaatagttggtgtcttaaaaactgtatttatctgggtcttctaagtaaacggtttgaggagtggtggaggcagaaattaagatttactgagtacttagggtcaagtaaggtgcactggatcgtgttaatcgttaactcgtggaaaccgcccagagtgtgtacgctttctttcttttctttccttttctttttttttgagacggagtttcactcttgtcgcccaggctggcgtgtaatggcatggtcctggctcactgcaactccgcctccagggttcaagcgattcacctgcctcagcctccagagtagctgggattacaggtgcccaccaccacgcccggctaatttttgtatttttagtaaagacgggggtttcaccatgttggccaggatggtctcgaactcctgacctcgggtgattcgccgcctcggcctcccaaagtgctaggattacaggcgtgagtcaccgcgcccggcctggagtgtgtattatcccaattttatggggagtaattgtgctcactcggctcaccaccaagtcgccagagcgcgcctccgcaaggaagccctccaggcacttctactttcccggacccgcctcccgctccagccggttacacgcgccgttagcagcgtgggcggagttggttctgccttcgcggaaccaactggtccagcttctggtgtctcccctcgctcaattaaaagccagctcctctcctttcggcttccccacggtgcctttcgggatttgtagtcagacgcgcttcagccggctctaaggagagcaaaggcaagactccaattcccagcatcccccgcgcccggagagtgcagcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgaggggacctaggagggcgggagtggcagaggtatgagagagagagaggtgagtgggaggcgaagagtgagaggaaggcagggagaagctaggagatcggaaggcgtgggtcagggtgaatgacgtgaagtagacttgggaagggaaaagaggtggctttagatttgggaagcatggaggggagaggttaccgccgtacttagcagaagtgggctaagagatagaagataggaaggacgggcagatttggagcttgtagactggtctgaccaggatgggatggaagagagaggtgtgggctcaattttctttgtccctgtttagccaaagatgagacaagtcattgaaatacaaaatgatcttgcaaacactggacagttaacaattctgtcacttggtaattgagggaagactggagttgaagggcagaaatagggtgaggaggcaagaaagggagggagattggtcaggtttgggagaaaccagaggagatgagtgacatgggaaaggagaccacagaaaaggtggggttattgtggggactgatggatctggaatcagttagaaaggtcaggggtgacactggcatggatggtgaggttgcacttctgacgtttgcattcctcaggtgatggagagcaccccttcaaggggactgaaccgagtacacctacaatgcaggaatctgcaggaattcttagggggcctgagccctggggtattggaccgattgtatgggcaccctgccacatgtctggctgtcttcaggtgagaagccccttcatggcagggaaatgtaatggggtctgcggagtggaataaaatatcataggtaaaagtgtagcagcctggagtcggggtggggactgggggcaagggttggaaattgctctaaagtgtggaggccaaaacagcaggactggtaaagttgtgctggagtgagatgagatgtttgagaggtaattgagggcagagatgcagatacaatgcagcttctgatactaacctttgacctctgttcctgtacagggagctcccatccttggctaagaactgggtgatgcggatgctctttctggagcagcctttgccacaggctgctgtagctctgtgggtaaagaaggaattcagcaagtaagtctcagccagatacaaatttctcaacagctacatttcccaaactgctgttccttggagcacttccaggaagtgttaatagatatatcacaaaacttaaaaataaatacatttgggaaactctgcatattgccttttcccttttatttatttcccagctgagatcttgctttcaaatgtatcttccctcttaaagagttatgtgtgatatctgtaatgaggctctgataagtaatgcagtaaagaatttgtcttaggaagatactaatttcactctgtggaacagtgttccaagggtcagcaagttcagaacaggcagagatggtggcttttatgggcctcctttttgttttccaaataccctactcacctctctgcttctgttccagggctcaggaggaaagtacagggctgctgagcggcctccggatctggcacacacagctgctcccaggcgggctccagggcctcatcctcaaccccattttccgccagaacctccgcattgcccttctgggtgggtatgtcacttctctctcttcctaagctagggcaggggaactgctgcttattaaaccactaattaaactttgggagggggagctcctgggggcctccccagaaccttgtggtctccacgttgggaactcctttaggagtaagttggaccagatgtagtgtgtggtgtaggaaatgtcccccactcatggcccctgaggataagggtggaaagatggcagagggcagcaaggaacacagacagggttccttactctttttttgttgttctgttttgtttgtttttgagacagagtctcactctgtcaccaaggccagagtgcagtggtgtaatcttgactcacggcagcctctacctcctgggttcaagtgattctcctgcctcagcctcctgagtagctgggattacaggcacccaccacgacgccaggctaattttttgtatttttagtagagatggggtttcgccatgttggccaggctggtcttgaactcctgacctcaagtgatccgcccatctcggcctcccaaagtacagggattacaggtgtgagccactgcgcctggccagggttccttactcttggcccatcctggccgtagggggaaggcctggtctgatgacacaagtcagctgggaccagacaagcatgcccgggacgttccctcccttgacaagtacgccgaggagcgatgggaggtaagcacttgggagtgtgtgtgtctctgcttgtgcttctacttcccatggcccttggggcatggtctccctgttctcttctgttcttcaggtggtcttgcacttcatggtgggctcccccagtgcagctgtcagccaggacttggctcagctcctcagccaggctgggctcatgaagaggtgaggaagccggaggtacagcagctctctgctgtgccatctccttgggtccctaagaaatggtatctggggctagtcaagatcagaggacattagctggaaaaggcaagctgagtagaatatagccagagataccaagaaaaaacgtgagtggacaagtggggatagtagtctttctctgcatatcaccatcattgtcctggtctttgtctctagtactgaacctggagagccgccctgcattacttccgctggcttccagttcctgttgctggacaccccggctcagctctggtactttatgttgcagtatttgcagacagcccaggtgaggaggcagggccacttaaccagcatgctctgctcctctcaggtctcactgagagactcctgcctacagactgttccctgattttctcttctctgtccctttcttcccattgtctccctcccatccctcctcctttgtctctgcctctttctccctagagccggggcatggacctggtagagattctctccttcctcttccagctcagcttctctactctgggcaaggtaagcagggggctgaaaggtatagagatgggaaggggaaagcaagttgtggggcagtagagtagactgagaagataagaatgaaaacagaacgaacagagatggagaaagaaagaatgaatgtatggggttgggggtgggtgggttgtgttttggaccccagctggaaacctctgttcctcaggattactctgtggaaggtatgagtgattctctgttgaacttcctgcaacatctgcgtgagtttgggcttgttttccagaggaaggtatgagcgcctagataagtggcttccagggaagaaacagggtggtgtgttgcctttgcctttaaaaaggagtggggtcttggggcagtagcaggaagcagttgccagaactgaatacttgggtctctcgggggagagaagttgggggttgaggttctgcatcttgggagggatctgatatttcaggcaggaagatgtaaggcagtgacttctgagacaaggcatctgcctttctattcttttcagaggaaatctcggcgttactaccccacacgcctggccatcaatctctcatcaggtgtctctggagctgggggcactgtgcatcagccaggtttcattgtcgtggaaaccaattaccgactgtatgcctacacgggtgaggcgggacagagggcccctggaagaggaggttgggggtgagggaatgccagtttatgttcgtgtttacctggcagtctacagagctctctgacatttctcatgacacttgaaagaagggcttgagggagtctgggtgtgggggtggcctcctcatcctctttctatccctggctcagagtcggagctgcagattgccctcattgccctcttctctgagatgctctatcggttccccaacatggtggtggcgcaggtgacccgggagagtgtgcagcaggcaatcgccagtggcatcacagcccagcaggtattcccacttgggagaggtggagcaggaagacaggctgcacttgggctgcgggggacaggggtcacattatggaaggctagctctgagtctgttataataggtggtggtgagttgtctgtgtttgaagagaaatgaaggctttgggtgtgagaataggtagacccttgaggggaaaaaaacatggagggaggaggtatagatctggatttgtgcctcggcactgccacatcctaactgcgtaaactagacatagttgttttgcctctgtgagcctcagtttcctcatctagtaaatgacagttcttacctcagggttgccgggataattcattggaagaataggggcaaagcattgagctcagcacctgtcatgcaataaatgctaaaaaaagaaaatagtagctgctgctattttaaagaaagaaaaacaaaacattactggaaagggcgaatgtgccagaaaaggaatatcccacgttgctgggagcagcaacgtgggataacagctgaactgggatgggtggagttgatgacaggagttatgagtttttagaataagctgatgttccagtgacattaggtgacagctcagatggctttcctgccttcttgctggagccctcatgccattcttgtctgttttcctagataatccatttcctaaggacaagagcccacccagtgatgctcaaacaggtatagacaggctccaagatgtcagaggctggcagctggtgatgacatgatggaaaagaaaaaggggcatccaaatctggggaagaaacagagggccgggttgtctggggcagtattctgagtccctacagtcaacccttgctccttgcagacacctgtgctgccccccaccatcaccgaccagatccggctctgggagctggaaagggacagactccggttcactgagggtgagtagcttctggtggccaagtcttggtcattggccagagaaagggcagacagttcagtctgcattttattttttacttcatggactaggagagaaaagctggcaagacagttttttgttgttttggggtgagtcggtagtaaacaaatcgtcccaaatcaatgcactttggatttggctaggtgagggaataattcacagtaatttgtattaggcctttctgaatatggctggatcacactggtgttaagatgaacccctgagcagacaagcatagagaattagtttgtaaaattgcggtgggggcaagcccagaccgcgtccagggctgccaccaaggagctggggggattcccaataggagctccgagcttcactttctcgtcttctccccgcgcccctcccgtcctgccgaccccaggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgcttttggaagcggcagaaacatagctcctgagagcgcgggacttggacacggacctcggcgggcgggactgggcggggcggggcatcagaactcaggtgttttttatttacgcgtcagggcttttcttgtttaataaagttatgatagctagcagtgcggtcccgggcgcctccccgtggggtttgccttcgcggcggactcgctcctctggtctacagcctttggaccggtagggagagggtggggccaaagccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaaggttaggggtcagacagcttgtccttgggtttctgagacttgagaggggctggaggagaccggctgaaatgcagtctggggtatactggatcccagcctcttctgctttctcttctcagtcacctgcagaatccattaaggcctggaggcctaaggagttagtattgtatgaaatccctacgaaacccggtgaaaagaaaggtaagtagaataagtaagaaggccttttctttcacatatgtgttgcccatttggcctgccgaaatgcagcctgggaacaagttcagtggttagtggagctctcctctgccttcacagatgtctctgggcccctgcctcctgcatacagcccccgatatgttgaggctgcctggtacccgtggtgggtacgagagggcttcttcaaaccagaatatcaggttagtatctggcagggaggggtcctaaattgtctccaggacagagtggcccttgaatacaactggacctcagagttgagctcacattgtagaccttgtcttctttctggctctggtgtctccaaagatttctcttggcaggttccccctggccaattccctcctctccactctcctcttatttgcaggacagttcttccttgaagttctttctgttctggagacagtagagggtgctctttccccaatccaattctctcttgcccctttgactttttttcttcctctaggcccggctgccccaagctacaggggagaccttttccatgtgtatcccacctcccaatgtcactggctccctgcacattggccacgcactcacggtggccatacaggatgccctcgtgcgctggtgagaggggagtgggggctgcttgagttcttggaagggaaataggaagggcaggaatgagtgaggataaacatttaagctcaggggctcacaggagggcatttttgttgcaggcaccggatgcgtggggatcaagtgctgtgggtccctggttcagatcatgcaggaattgctacacaagtatgtcttttgttacctgttccttttcttgggcaaaagcaatttcttcccccaaagcaaccaagcaacctgactctgttcatttgccctgaatccaactgcaggctgtggtggagaaacaactgtggaaggaacggggagtgaggagacatgagctgagccgggaggccttccttagggaggtgtggcagtggaaggaggcgtgagtatgatgggcaggactcggggggcccagatggcagatttggtttcttgcctcccaccactatcactcctgacttgtaatccttggctcttcccgacacagctctgacttcctcagagatggaagctctggagcctgttaacatttggtggagtttctaagccttatgtgtgtggatattatatatgcattagaatattcgtgtgtgtgtgtgtgtgtgtgtgtatttatatatatatatatattttctttctctttacttaccccaatttctcttgtctaaatctcaccttcttccactcgcccattcccacctttcaattcccatggaattaccctcattcttctgggtctgttatctcatgccatctctgtgaagcatccttggatttcccacaatatggctatccctcctctcttcctatagaatcttttgcctcttttaatatcttagaaaaccccatactgggtttgtaagtccatttctattagcctctagaggctagatcaatgccatcctcacttgattttcctccaacacctggcattgctgggggcatcgctgggcctggtacataggaagtgcttgggaagtgtttgctgacaaggatctctctgggcacaggaaaggtggagagatctgtgagcagctgcgagctctgggtgcctccctggactgggatcgagagtgttttaccatggatgttgtgagtgttctgtgccttggtccctgtgagtgatgggcgatgtttagggatctgtgtggggcagggaggaagcaatgcctgggtccctgagcagggtgatgggctgagaagtggctcttagaggtggacactcaggtcattccagggctcctcagtggctgtgactgaagcttttgtgcggctctacaaggcggggttgctgtaccggaaccatcagcttgtcaactggtcatgtgctttaagatcagccatctcggacattgaggtgaggcggagagagggaagcaggtttgtgagagctctgaggcagagtggtcaatgattaagagctcagactctggagccagggtgcctggattcaaatctgatgcctgcctgttacagctgtgtggcttttggcaggccgtttagtctctttaagcctcagcttcctcagtctgtaaattagagatgatggaatgcttgcatcgtgggggtgttgtaaaaattaaatgagaattcacataggtgcttggcaagatacctggccatggcttaagtgctcagtgaatatttattagaagtgtgactgcacgagcattgggtgagggcagagggaggtagctcccgaatcctccaaatggcttttagatggattgcagggaggctgggcagatggatgagtggcagagtgaagcctgggcatgagccttgcagaaaggctgccctctgacccagctttctcggtgcctccaggtggagaaccggcccctgcctggccacacacagcttcgactgcctggctgccccacccccgtgtcttttggcctcctattttctgttgccttccccgtggatggagagcctggtgagcatagtactctgcagggtcacccgtttacctccatttttcctgttttctgaagcccatgttgggctgctaggaacccatcagtccatctctcacatgtaccttggtagtgttcacctcagcgtgggcacttacccagggtcttctgggggatgtacaaaaagtgcatgtggtcactgccctttgagagtgtggtgtgattcttcaggagtgcgctacccaggaaagagatcagttctaaggtatgttttgttttgtttgtttgtttgtttgttttgagacagagtctcactctgtcacccaggctgcagtgcaatggcacgatctcggctcctgcaacctctgcttcccaggttcaagcgattctcctgtctcagcctcctgagtagctgggattacaggcgcgtgccaccaggcctggctaatttttgtatttttagtagagacggggtttcaccatgttggtcaggttggtctcgaactcctgacctcgtgatctgcccgccttggcctcccaaagtgctgggattacgggcgtgagccactgcacctggcctctaaggtgtggtttttacggtaaatgttctgaagagctcagagaaagggaagacagatgagctggaattgtcagtggaagcttcttgtaggagctggtgctccccctgaggaatgtacagcatttgtgattaggacactgagaatccccagtgtcctctgggcacccagcaagaattctattatagttgctttaattaatgctgcccccatttcttccatgcaaattatcagggaattctttagcaccagagaccctctcagacctctggtcatcagcttatgggaaaccctgggttcctataaacactgctcctacttttttctagtcactcctgggggcctcttccaccttgactactccctgccccttcccctttccagttctactgcctttagctatgttggcagtgagaggtgaggatgatgaccagctgtaagtgtttaaatgtttatcttcagatgcagaggttgtggtaggaaccacaaggccagagacgctgcctggagatgtggctgtggccgttcatccagacgactcgcgatacacagtaatacccagtgcgctcctgcactctggcccgccccgccaatggccttctcttctcttgggttttaaatggtggctctttctctcttgcttctacttccttttcctgagacttctctcagtggttctgattggactccctcctcctcttatagtttttctgtagctcaggggttgacaaactggcccatggtcctaatccagcttgcggcctttttttttgagacagagtctcgctctgtcaccaaggctggagggcagtggtgtgatcttggctcactgcaacctccacctcctgggttcaagcaattctcctgcctcagcctcctgagtagctgggagcgtggcaccatgcccggcacgtgccaccacacccagctaattttttgtatttttacaaaaattagtaattaattttttttaagtaatgtaatttttaagtaatgttatttagtagagacggagtgtcactgtgttagccaggatagtctcgatctcctgacctcgtgatctgcccacctcggcctcccaaagtgctgggattacaggcgtgagccgccgcgcctggctgcttgcagcctttatattatctatggctgctattatataccctctccagctctgctgcagtggcataatagagtaattgtgctgagaatgaatttgtctctaggcccaaaagcctaaaatatctacattctggccccttaagagtttgctgaccttgctctagcttgctaccttccactttctaccttcttattcctggggttctcacgccccagcccagacccttccaaccctcacaggtgcctgtccttgatccctctcccttcccttcagcatctacacgggcgacagcttcgtcaccccttgatggggcagcctcttcccctcatcacagactatgctgttcagccacatgtgggcacgggtgagtggaagtcaggggagggagagaaagttgggggtcctggaggagaggggagggaaccaggaggaagaggaaggtgggagtgggagatcctcatatagggtggtctgagtggggaatgggagggaggcacagacagagaaagtcgcaggggctggggcggtgcaggtgatgatgatacatctggaaaagcaaaagccaaggtcaggttcagtactcaccatggctgtgctccccaaggggcagtgaaggtgactccagctcacagtcctgccgatgctgagatgggggcccgacatggcttgagccccttgaatgtcattgcggaggatgggaccatgacctccctctgcggggactggctgcaggtggtaccaccctatgttaccccatcctttgggggctctctgtccccctaatcctcctcctagtttcttatttctctagaggccttcagtctttactcttgccgctttttctccagggtcttcaccggtttgtggcccgggaaaagataatgtctgtgctgagtgaatggggcctgttccggggcctccagaaccaccccatggtactgcccatctgcaggtaacctcattttaactcctttactaagggctaccccaaaagggaatgtatggagcttaagggtgacaataggatgggctctgcacccctccgttagaatacgagctccgtgtcggttttattcgctattgtatcctcagtaccaagggcctggcatggcatggggtcttgtgcccctgggagaagtcacagggccggaagagcagtggactcaccctgtctctctttcagccgttctggggatgtgatagaatacctgctgaagaaccagtggtttgtccgctgccaggaaatgggggcccgagctgccaaggtgaggctgcagtgtaggaaggactggggccaggggttgggggagctccctgagaattggaatgaagaaatgggaagcaggagacctcctgccctgaagacctctccagctgtggtaactgagaggatgtgtgggatggaggctgggcggcccagcaagggctggctcatatccttactcaagcccagaatcttggcaagaggcttgggaggtcctttctgagttttaaaatgacctcagaggccactcgtcctatctgtggaggtgcggccgtgcaggaagggcaacattgtctaaagtcccctttctctccaggctgtggagtcgggggccctggagctcagtccctccttccaccagaagaactggcagcactggttttcccatattgggtaagggtagggtaaggggagctcttgtggagatggggaggggggactgactggttattctaagacttcacgaatgtcctcccggcagggactggtgtgtctcccggcagctgtggtggggccatcagattccagcctacctggttgtagaggaccatgcgcaggtgggtaggaagaagcacccggagggccgagtgtggcacagagcacctagcccaggagtcagagctccgcagggccaagtcccgctcctgcctggtcatgtgcttcatgctcatagtcatgtaaccttctgcgcgatcaaggctccctgaagtggcatttctttatctcacccctgggggaacctggccactctaagaccacatgaggacgtgaaaaccaagtgacatttacacctgtcagctgttcttcctcactctccccaaccccttcctacttttgcagggagaagaggactgttgggtggttgggcggtcagaggctgaggccagagaggtagcagcggaactgacagggaggccaggggcagagctgaccctggagaggggtgagtgcctgagctggggagggatgtacaggggagcgggggcctgggcatctgggcctttgaggggaacagatcccaagatacagaaggtagggtcaggaaagttgggaatggagccaaaggggacagccctggtctctgggggtgggggttggcctagaatggtggcagcagtggtctgaggtcctagaagccaaggttccaactgtccccattctttttctgtttcccagatcctgatgtcctagacacatggttttcttctgccctgttccccttttctgccctgggctggccccaagaggtgaggtgggttgagagggcgaaagtgaaggggaaacgataaggaagggatggctgggcccccacagaggcttgaggggggcctggggcctgggcctcttactgctcctcttccccctagaccccagaccttgctcgtttctaccccctgtcacttttggaaacgggcagcgaccttctgctgttctgggtgggccgcatggtcatgttggggacccagctcacagggcagctgcccttcagcaaggtaagagcccttcagtgccctgccgctttctgtgactccagtgttccccaaaccttgtcctcccttctaacccctaatgtggtcctttccacgttgctgattcctttttcctaattcacttcctaccctacccccaaaagtatggaggccagagatcccaaggcacctccaaggaaacccccctctgttgacccctccctgcccccaggtgcttcttcatcccatggttcgggacaggcagggccggaagatgagcaagtccctggggaatgtgctggacccaagagacatcatcagtggggtggagatgcaggtgaggacgaagcacccactagagggacaaggtttgcagggtttgcaggagagaggaaggcaggctgagggaggagtgaggccagcaggtgtgacccttatagaggcagggccttcgacctgggtcgtgaattgcccccttccatccccaggtgctgcaggaaaagctgagaagcggaaatttggaccctgcagagctggccattgtggctgcagcacaggtgagtcatcgctgcctgccccccaccagctctagctcaccacctctggcttcctctgcaacccaggtcctggccctgcagccacaaaggcatctgccacccttcttcttcctctggttgcagaaaaaggactttcctcacgggatccctgagtgtgggacagatgccctgagattcacactctgctcccatggagttcagggtaagcctgggcgaggggtgtcggggtgagcagagggcagcgggcacctgtgcaggggcagggcaggggcaggacttctggtgctgctgccacctacatgcagactacctcgattcttcccttccagcgggcgacttgcacctgtcagtctctgaggtccagagctgccgacatttctgcaacaagatctggaatgctcttcgctttatcctcaatgctttaggggagaaatttgtgccacagcctgctgaggaggtaagagaaaacagaggtgcttgggagtagggtagtcaggtgtcagagggccaaggtggcatctggaaggaaaggaggcaggggagggggagtcaggccatcctgccccctctgcctgcagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggtgagtgaggctgggggaggcttggtattcccatgcctgcttctaattcctctggaaatttccaaggcagagagctctggagttaataagttcccaattgtcccctcagttaggagaggagaggagacgagggagtctcagttcccctcttcctgggactggttttggcagtgcagcccaggcactgttgcctgcctgtcacctggggagaggaggaggagggagacttctagaaatgtctgacaagtcggtgtcagaaggcagaggggaattttttcagtccctgtagttgctgagtttggcccatgggcaggctgcgtgctgagagaggcctgggagggactagcagcggtctttagaccaggggttctcacgctgtcctacgtccaaagcacctggagggcttgttgacggtggatcccccccgctccactgccaccccagagtggctcctttagcaggttggggtgggggtgggtggtgtaatgaatattcatttcttgtcccaagtggtgctgctgctgctggctgtggaccactgccctagctcagccttttaaaaacctctgtcccctgttgataagcaaaaaactcaatgatttttttccctaaactacatgtttccctggaaatcctgtccctgtgtactgcagagaattgctgtcctggagtccccttctttgtgctgagtgtgtcctgggactgtggatcatatcagaagtgctaagtgcttctgcctgtccctctctcccaggacccatggcctgccccactggcgggtagcagtggctgtagggaggagggctgtggccctggacctgtcctctgaccattggcttcctctccaggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggtgagtcccaagcaccttggagtgggtctgtgggtgaatgggggggagcaccttctgaaggggtttgctgcagggggctcatctgcaggaatggttcgtactttactgtggagccctggggaagatggattgttcctgcagggttgctgcgatgaccctagggtcttgagggacagtattagcgtagtgctcaagagcaggactctgttgctagactgctatttttgagctgtgtgatcgagcctcagtttcccgcatgtttaaactaggaacagtaatagtatatgttatggttgtgatgagggttggataagttagtaatagggtgtccccaaaatctcagtgcagctttaataacttcagaaggataaatgctatgaactcacccaaaaattattttaaaatttaactatttaaatttatacttatttggttttgagttttgactaattcattttaaattctaatttatttttggttggccatttcaatcacagcaactaaacaggcatcaaacactgatcatctaaaacctcttaaatgacgcctcactttttgtcatgttccttgagatagtggattttctgtggtgctgaggacagatctcattgccctaaggagatggggtggatgggtcgagaagagagccagcagggttggtactgagtctcccaggagcccctttgccaattctgggtcccccccattgccaggagcactggcgccagccagagctggagcggcgcttctcccgggtccaagaggtcgtgcaggtgctaagggctctccgagccacgtaccagctcaccaaagcccggccccgaggtgaggcaaggcgggtcctgggctcggatccctgcaggaaaagggggctggtggggaaaagagcagagcctgaagggccaacccccccgttaggaggtgcagggtaggaagggaggcaggagctgaggccttgcccctgacagtttctttctttccagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcaggtgaccagaggggatggggagggttagggcaggcttgggaagcatgctgggaggaagggaggggctgggctctataaagtaggggaagggaccttctaatggaggatggaggcctggcagcaggcggatgtctgagccttttctccctgttcttccccagggcctggtggacccgcagatccagctacctctgttagccgcccgaaggtacaagttgcagaagcagcttgacagcctcacagccaggaccccatcagaaggggaggcagggactcagaggcaacaaaaggtaaggctgagggaggcccccagaaggctccacccctgagggaatgtgggccaggaggggcctcattcctggatcctcacctccttttctcctcgtccagctttcttccctccagctggaattgtcaaaactggacaaggcagcctctcacctccggcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaacatgtctgtttatggctctttggtcccctttgctcccagtggtgacttttgtgcttctgagttgtcccctgagagcttggtctgggaaaagaggaggaggggtcctcgctggaggaagaggaactttctagtcatgggtagggtatgggcacagtggttccggttctacctactttctggactaactgacagtgccctggcttttgcaggctctttctcctccacttctcactaaatggaagcttccccgctccttggctgtatccctagaggtgctgagagaagtaggacttcctccagacctgatgggctgcaggctgtgctgcagatggtgtgcccccaccttctgtgctctgacacctgagtgcccagcctctgagttacacattcacagcacagccagccaccttacccacgccaaacaccatctcatctccatggaattcaagggcctggcccttccacgcccagagtacattctgtccagcagctctgagtagcctgtcctgggctgggtcctctgtggtgctagatgtacaatgccatttaatcctactgaaaacctcatgaggcgggtgttagctccattttggagatttttatttttactttatttttgggacagggtctcgctctgttgctcaggctggagtgcagtggcataatcatggctcactgtagcctcaacctccagggctctagtgatcctcctgcctcagacttctgagtagctgggaccacaggtgtgcaccactgtgccctgctacttttttttttttttttttttttggaaacggagtcttgctttgtcacctaggctggagtgcactggtgagatcttggctcactgcaacctctacctctctggtacaagtgattctcctgccttagcctcttgagtagctgggattacagttgtctgtcaccacgcccagctaaattttttttgtatttttagtagagacaaggtttcaccatgttggccaggctggttttgaactcctgacctcaagtgatctgcctgcctcggcctcccaaaatgcttggattacaggcatgagccaccatgcccagccctgccctgctaatttttaaaattgttctgtagagatagggttttgccatgttggccagggtggtcttgaacttctgggctcaaataatccacctgccttggcctcccaaggtgttgggattacaagcataaaccactgcgcccagcccccattttggagatgaagacgtgtgctcagagaaaagtctccactgggacctaacccaataaattaggtgcaggctctttctggctgctgtaactaaacttcaaatataatggtggcttagatgaggtggatgtttcttctgctgggcataagtagtgcagagatctgcaataatgggagcccacacctccttcaatcttattttcctgccattctgatgcattgtcaaacttcatgtccaaggtctgcaccagctcccatcaccgtgtctgcatttccacccagagggaggagggaaagaaggggatgggcagttttctttttctttttactctgtttcagcaaggtgttttttttttttttttttttttttttttgagcacctgctatggatgggctgggccttattctggacacttagattcatcagtgagtgaaacaaaattctgtgcccttgtagtactttccttctagcaggacagtcagaaataacatacaaatgagtgaacgatatactatgtttgaatgtcatgaatgcaggggagggaaaaaggatagaacaaggtaaggggactctaatgtgtttgtgtggcggggggcaggttgtacttttaaatagtgggtcagggcagaactcactgtaaaggtgaggtttaagcaaaggcttgtaggaggtataggaagagcgttccagacaaagggaagggccagaggaaaacagatagaggcatggtcagacagctcgaggagtagcctggagaccagtgtggtggggcagagtgagaaggggaggatggtgggaggtggagaaacagaggtgagggtggggaattggtggggggtagggaagactcaaggcggacaatctggggcttgtgtccaaaatggtagccagttggctacctaaagcattaaataaaataaaaacgttcagtttcttagtcgtacttgccatatttcaagtgttttggtagttgcatgtggccagtggctactatgttcgtcagcacggttataaaacatttccatcatcacagaaagttctattggaaagcactgatctaagaccttataggctgtttcaagaactttgcttttcctcctctgaaatggaagctcctttcttttcaaggatactaccagaaagttgcccacctcctttctacttgcatcctattggacagaacgtgatcacatggccacagctagctgcaagggaggctgggaaatgtaatgatccacatgctgagttgaaatctacatgactatccaaaaggaggaggatggctgttaggggggccagttagcagtctctgccacccccaggtctggtgaaccccaaagcactcttcactgcactgctctgttttgagccttgggagacaattctttgagaaaaataatctggaaatcacatcctggtgatctcaggccctgaagtctaggaaccaggttgaggtgcatttagctgtctgctctaccaacctcttggacattcagatatccagtcccccaacttgtttggggatcctcacagctgccccatgggcgtcacctgcccattactgcaggctaggggcaagtcataaaatactagtctcctttggagccccctgctacctctccttgggggctaattgtcccaggacagttgtgaaggaaggtagaccaattttttaagtgttttttttccaccctgccattttctatgctcccctcatcttcagtgatgctccatactgaactcttgttgtcttctgtctccaaaggagtcagtctccaatttcatatggagataatggagggttgtgtaggtgtggggggcagagtgggtaccacagaggacagagagcaatcctatcagtaccccccactgctcaagtctgagctgcaagtttgtgttttgagagctggtgagaagtcaatttttttttttttttttttttttttgagacagagtcttgctctgtagtccaggctggagtgcatggtcttggctcactacagcctctgcttcccaggttcaagcaattctgcctcagctccccgaagtagctgggactacaggcacatgccaccatgtccagctaatttttgtgtttttagtagagatggcgtttcaccatgttggccaggctggtcttgaactcctgacctcaggtgatccacctgacttggcctcccaaagtgctgggattacaggcgtgagtgagccactgcgcctggccaagataatcttgagaaggtggtcaggagtgcctgcctcagaaatcagcataaggaggaccctgaaccccaggggactaggagttatatgttgggaccaggtttccatcctaacagcaatccctaccatcctgccgacgacctataagacaggctgtgatatgtccctaagtagcttccctgtgtgatcctcacaacaacctgatggtgcaggaataatgagaaaaactcagaattgtgtaaaaacaaaacaaaacaacaacaacaaaaaccttcccccaaactgggagggagctgagaggccaaaaagtgactcagacaagtccagcttggtgagtagatgagttttttaggacttacatacaaggcactcctggatggcagcaggacagctttagagatccgtgctgcctcccatgctaaagctgctttcaagctaattttctgactctgccgactgtgtgtgtgcgaatggactgttttccttggtgggttcccagatactctccgggatgtttgggttctcagggacacctgctcctcggccaggcaccgtgaccttggctcgccacctggccttcaggattcaggcagtggcatacaccgttaagtaacctggtaggggacctgtcacactacagcaggtaccatcattgttcccattttgcgagtgaagaaatggaggctccaagaggataagaaacatgcccaggaattcacatgtgggctggtgtcacctcatactcacatggttaaccaggacaggctcagcttgcacctggcctctcctccccagcacttgcgcctggctgggcatcctctcacaagctgaacccgtcatctctcacctgagtgcccacccacctcccaccccaattacctgtgtggatccatgggccaggggaaccatgtcctgggggtgttctgcctatgtctctttctttggtttttgagcccctggccccaatgcttaagcaaagggaaatgaaataaaaatcttgcttaaaccaagacctctgtctagtgcctgacttctccactgctattagatctcaggtgagtgacttgccctctctgagcttcaatttccttatctgtaaaataggataatgatacctagtatgccacattcaagactgctgcaagcatcgaaatagggatgcaggagaaaagcaggacttcaataaatgttgcttctctttattcccaggtgttccaaagatctcaatttggtgtgtgttcctatgcatgcgtatatgtgtgtggtgtgtgtgtccccaaacaactccccagatgccttgtaggcctgtgacactggtgttgagggagacattgtccatccctggaaccctctgctcaacagggggacagtcagagacttgagcatccaacccccacttcctgccagctctgtgctcagggacccacagagtcaagcaagttattgaattcagcataccgaattttatttattgccgctcaggagggtgggggcctgctgaaagacagggtcggggcctgcctcctgcatccccggcccaaaagcccgggccaagaaggacacaggcttcaatggctgtcatgtgttgcagacaacatggtgttgagatcttgcatggtggagggtgacgctggtccctgaagggagatggaggaggaggcagagctgggaacaaagggttaaagggcgccatgtaagagagctctccattcccaccacggagacatccagaccccagcagaggcccaaactgactcacaaacacacagccccatctttccccttccaaagaactaccttttcaagcaattccaggaagctggactcataggaggaatttgtcagaaaagactccttcagcttcagttgcaaagtcatacccggccctgcggatccagaagtacagcttaggacccagcagtcagggctgattcctccggagacacagaaccttcctgctcacgctccccggcacagttcctcttccccagcaatgcccctccagagcctcttggaagctcaggactggggtgtctctgtcactctcagggaccatgaagtcccaccccttttctctggcctcttcttgccacagggacccaggagtcctgccctctagccctcacctgttccatgtgagctgccaaggagggtcaagaggaggacaaggggcagcccagaccccatagtggccactgcgctcctgggatggaggagacactgaagtcccggtggcctctccttaacaggcctgtttctacaccccactcaagccttagcataagtgtttgaggggaaatgggaggaggaatctggtcaactggattttccagttctcccagtaagagaggacccaggagaggaccattcactgtgcttttggggaaaatagaaggaagtcccctcttttccactctgtgtcccacccctcccttgtgtctccaggtttgagggagtgagtgcgggtcctacagacagggaaatggagagggaagcggggaccagggaggcgtccctcctgcaggtgtctgggcccccacccatgcccgggcctcccaaggatctttagagattaattattaactgcagctaattttcatcattcttgacaccgaagggctcaggaatgtgggcccaaaagggaggggtggattaagccaagtttcttccagaacccaggtgtcctgctccctcaggttttttttttttaaacactagtcaagtgcagtagtgaaaagagtagaaggagtagaacaaggagttgggtctataatggactgtgaacactgcttccccagccttggtggctttctagatgagaaatctggtcatgggaacttccattgctgaacattctgttttacttgctctaacgcatcctggattgtcagggggagacacgagtttcctcagacatcctctcactcctgccttgtgcacccatgaaaaggggacacccacctactcccggccgagatgcctacaggcaagcgctgggacaggcaagcacaggacagatgtgcagagggagttactgaccctctttagaaactaggaaagtaaggcacagagagggtaagtgacctgctaaggtcacccagccaacaagtagcagagagattagaacccatccctctagccagacaaagagacacaccagccatggaaacttgcttgaacacacaagggcacaggccagcatcttcctatctgccacttccctatgcagcctctccaccttccccaaagccagcgggactgagcacagagagacagaggcagagagagcactgggcagaggtggggagagcaaaagcaagatggggaaacagagatagaggcctggtctgcactgtaagtgtaaagtgaggcaaccaatgactcccagacttgcacaggacaacaggaagaccacagtgggaagaaagcatggaggagaagagcagcaggcacaggagggacgagcaggaggtagaattgggaacacagagagatcttcctcggagaagagtaagggccctccctccctccctccctcccttcctccctcccttcctccctccctccctccctcctttccttcctttttttttttttttttttttgacagcgtctcatccctgtcgcccaggctggggtgcagtggtgcaatcttctcctggctcagcctcccgagtagctgggattacaggcacccgccaccacagcaggctaatttttgtatttttagtagagacaaggtttcaccatgttggccaggctggtctccaactcctcacctcaggtgatccaccccctcggcctccctgagtgatggaatcacaggcgtgagccaccgcacctggcctcccccacactttctacagccatgtgctaggctcatcactaagtattcctttatagcgcataagcgcctgtgaagtaggtactagattaccccgattttagaggtgaaattaagacttaggccttgtgacttgccagagaatgcacagctcagcagtggtggattccagtgcagtggactcagccctggtactgagcttctgaggattcagggctgtctggctccagagctggggtctgaccttccatatcacactgtccccaaacatgacacgtgtcttccttggtgccccttatctcccctttccccttccctgtcaaaggaatggaaagctctgtcagctgcagccatctaggtgagacacggctcaggtattgaccttcccagcccactcttaggtttccagaaggtcagatgcagtcctagaccctcatggttcccctacaaccccagcttccaaatcctgcttccctgagggactcatacgtcctgacttccaacggttgtacttctaggaacaagaggatgaccttgggataggtcatttgggtctccccttttaaaggagggtctgggctgtgaattgactcagacctgggggacaggtccctagtccaggaagagcccaagggccaggtgggggagcccgcaggctcttactcactctccccctcaccctgtgcttcctgggatcaggctgggacaggttaatcccctgggacaacttggcgacctctctctggggatggagattctggtgttggtggaggccccggcacaactggctctcccgggactcataataggccccagagcctttaaagagcctgggagatgggcctggccaacacacttcaactggtgccatggacactgtgctggtgctgctcctgggcctgcaggccttggccggacccagtgagcacttgggcccagacagggggtcttgaggaaggacatgaatttgggacccagtgggatggccaactcttctaaccctgttctatggtttatcttcttttttcaacagttcagctgaccctactggggacttctgacacagtatccccaggtctcccctgtctctggaagtctccccactgtctctggaagtctctcctctgtctctggagctctccccggtttctggaagtctcccactgtttctggaagtcttcccactatctctggaggtttccccactgtttctgcaactgtccccactatttccaaaagtttccctactgtctctgaaatcttccctctgtctctggaggtctccccactatctctgcaactgtccccactatctctagaagtctccctactgcctctgggagtgtctcaacagtttcttcaaactctgggagttttcccagcagtcctcagtctttagctccagccgtttctgggagcacttcaggaacagtctccacatcatcaggtgatatttctgttgctcaacccatctcgggagaacccttcagctcggtctgtagctctggggtggggcttcctgcaagcctggcagttttccagaacctcagtggaagcagctcccttgcctttgtggctatacaagggcctctctttctgttttccaattcatcacctttttctgtcatgattagttcctgttgtatcctaagacttttttggctacttcaaggtcatgaaaatattctcctctgcattcttccagaaacgttattattttagctttcaaatttaagtctattatccatctcaagttaatttctgtgtatggagcgaggtggaagtcaagattcattttttcttcttatgaatatccagaaccattatttccaaggaccctcccctgtccctgccattgaacggtgagcacctatcctgaaagtcaagtgactatttgtgtgggtttttcggtaagttttttttttttttgaggtggagtttcactcttgttgcctaggctggagtgcaatggcgcgatctcggctcactgcaacctccgcctcccgggttcaagcaattctcctgcctcagcctccggagtagctgggattacaggcgcctgccaccacacccagctaatttttttgtatttttagtagagacgggattttaccatgttggccaggctggtgtcgaactcctgacgtcaggtgatctgcctgtctcagcctcccaaagtgctgggattacaggtgtgagccactgcacccggcctatcagtcagttcttactccagggccacagtgcttaaggactacagatttgtagcaagtcttgagatctcatagtgtaagttctccctttttttttttaagagagtgtcttggttattctcagtcttgattttcataacattatttcatcagtttattccaaaaacttgctggagtcttgcctgtgggtgcatttgatgtgacctctgctttgctcttgcttgaatctcttctgttttttccctctgccctcttaggacctgcctcatccagtgctcccggaacagctccaactgtgcctgggactttagcactgagtgttgctgtcttaggagttccactgccaccatggctgggtggccaccacgtcctctgggctcagcatcctggccagttaagtcactcttctaggcactgggtcacttacagtaaaatgttggtgggcctattctctctcatttccctgcagccacccctggctccttgggag

SEQ ID NO: 393 - DNA, 37701 bp, Homo sapiens
cgcttctcagaattcaggcctgtcctcggaatgctacaaggtacagcccatttaagctcctgtatagacgctcctttttattaggccccagtctcattccagataccagaccaactcagactgtgccccaaaacacttgtcatccctactatcttctgtctagtcatactcctattcactgctctcaactactcatacatgccctgctcttgtttacactgccagtttacactgtttctccaaaccatcacagctgatatctcctggtactatccccaattagatgtcctaggtcctcccaattcttagtcctttaatacctgtttttgtccttctctaattccgtttattttttaattcatacaaaactgtatccaggccatcactaataattctaaatgacaaatgtttcttctaacaaccccacaatatcaccccttaccacaaaatcttccttcagcttaatctctcctactctaggttcccacgccgcccctaatcctgctcgaagcagccctgagaaacatcgcccattctctctccataccacccccaaaacttttcgccgtcccaacactttaccactatttcattttatttttcttattaatataagaagacaggaatgtcaggcctctgagcccaagctaagccatcataccccctgtgaccttcacatacacatccagatggccggttcctgccttaactgatgacattccaccacgaaagaagtgaaaatggcctgttcctgccttaattgatgacattgtcttgtgaaattccttttcctggctcatcctgtctcaaaaagctcccctactgagcaccttgtgacccccactctgccctccagagaacaactcccctttgactgtaattttcctttatctacccaaatcctataaaatggccccaccctgatctcccttcgctgactctcttttcagactcagcccgcctgcacccaggtgaaataaacagccacgttgctcacacaaagcctgtttggtggtctcttcacatggacgcgcatgaaaagaagaatactttaaaaaaaaaaaaaaaagcagcatcagcaccacctggaagcttgttatttatacagaatctcagacccacctgaaacctactgcattggaatttgcattttaacaactctggtgatttgttttctcatttcacaagttgtagtctgtgaaaaatcaggagctatcaggaaaggagatctactcccctggctactgcgaatcaaggtttcttctgcatctacgactgctacccataaaatgtgaaatacccttcaggaatctatacggctctaaagactcatagtgagatgttaagtatccctttctccttcctaatagcagcctatttcctttcaaggaattctcttcccctgttctatgtcttgttgtgagggttaatttcaggtgcctgctaacccaaacaagccagagaagcaattcttttctctaggttctcaaccaggggtgattttgccccccaggggacattttggcaacatctggaaacatatttgtttgtgacaaatgacagggagagattctggcatctagtgaaaagcagccggagctgctgctaaacatcatatagtacccaggatggcccctcacagcaaataattatccagcccaaaatattaataggaccaaggctgcgaaaccctgaatgagtaattacatatattctccctctttcaggaagtctcaatcttgagagaagggggaaagagaaatagaacatcgctgtcacagcagcgtcactgtgacccaactcttcctgcctagatgacctgcttcctccctcttgaccctccagagtgctgtcaattccctaccatggagccctagctttgcataaatcatacgagccccaatttccttccagttcactgtcatttgcccaagtcagccagtatctttctgttgatggtaaccaagaacccttacgcccaaccatccaattagaggagggctccattccagggcagggcaggcttacccagctgctaggctaagcacacacttcaagcatcagcaagtaactgacaagttcagcttgaatgaacttaaccagaatttgcagtcaagaaaactagaaagaaactgttttaatttcagtataagtgtttcattttgcatcaagtgatttaaacagttcattatttgggaccctgatgttctgggccatcaggtggggcaggtttgctctggttttgagtttcagtgctaagaaggaagaggaaaacgagagagaagagattgagttgtttatattatctggcctcaggtgagagagtactggaatgagaagcctatgtttaaaggaaaaaaatattaaaactgggaaagtattgaacatggaaagatgtaacctatacaatgaagtacagcacaatggaagaacctaaaaattaaaaccaagaatacatatatatatttcttgatatatatatcaagaaatagcaatctatctgcaagccgaaaagtgttgcagaaggaatggaggctttgtcatcgaatacacctgctggtttaaccaaactaagattgaaagtaaaaaccttagcctgggaaacatagcgagaccccatctctacaaaaactgaaaaaaatagccaggtgtggtggtgcatgcctgtggtcccagctacttcggaggctgaggtagaaggattgcttgagcccaggaagtcgaggcagcagtgggccgtgtttgagccactgcactccagcctgggtgacagagtaagaccctgtctcagaaaaaaaaaaagaaagaatgtaaaagcgtttgaagccatttggcaaagatcatggaaaacagggcaagcaatagctacagagttccagagccatgttaaattaataaataagtaaatatttaaacattgaataccttaacaattaaaaatcatatctatctattatattgttgaatgacaaaagcctattacaggatgattctacctatatcgacatttgcatatatgcataaagcaagtctggaaggaccttcacaagcatgttaacaatggtcacctatgggtagggagatcttctttgaatttttttttttttttttttggtgcattagcgatcttgatggtttcaaatgtcatcaccagggaatgataaacgctggggcctacttagggtggagggcaataggagagtgaagattgaaaaactacctatctgatattatgctgattacctgggtgacaaaattttctgtacaccaaatccccaagacacacaattagtgcgtgtaacaaacctgcatatgaatccctttaaagtaaaatacaagttgaaaggaaaaaaataaaacctcttcaatcatctttcagatagcaatttttttcattgcttcttcagtgtacataaatattcttttacatcattcacacttctttgaacttttctgtactgtttaaatatcgcaataatgtttatgcatcctattttaaaaacaacaacaacaaattaaaaaataaaaaggagaaggaggaaggtgaggaggagaaaaagaataacaaaaaagacttgtgatcctaagcatatagacagctcagaaattgcaggaaagctgaaaaagaaaaacaagagaaaggtaaaggaagaatgatcattaataatattactaaattgggccaggcacagtggctcacgcctgtaatcccagcactttgggaggccgaggctggtggatcatttaaggtcaggcgttcgagaccagcctggccaacatggtgaaaccctgtctctactaaaaatacaaaaattagctgggcgtggtggctaatggtgggtgtaatcccagctacttgtgaggccaaggctggagaattgcttgaacccagggagcagaggttgcaatgagccaagagcacaccattgcactccagcctgggcgacaagtctctgtctcaaaaaaaaaaaaaaaaattactgaattgggctacagattcttagagctgctgatgggactttcatgaacttctaattcagagatccccaaaccagaccacacattagaattccctgagggctttttttaaatattgctctgaataaacacataaacaagcagttcccttggcccaacccatctttgacctactgaatcaaaatatctggaatgggattggggaatctgcacattgaccagcccgtgcaaggatctaaaaccagcccctggcaaccactaatgtacttctgtctctacgaatttgcctattctagatgttccatataaatggaattatatggccttttgtgactggcttctgtcacttagcatgttttcaaggtccattcatgttatagaatgtattggtacttcattcctttttatggctgaattaatatttcattgtattgatataccacattttgtctctccattcaccagttgatagatatttgagttgcttccacctgttggctattgtccacctgtttctatttctatgaacatttgttcacaagtttttgcttgaacatctaggggttttgtttgtttggttttggtttgggttttttgttttttgttttttgttttttcagagatagggtctgtcacctaggcaggagtgcagtggcaccttcttagctcactgcagccttgtattcctgggctcaactaatcctcccacctcagcctcttgagtagctagaactacagttatgatgccaccacaccctggttatttttttaatttttctgtagagacaagggtctcactatgttgcccaggctggtgttaaactcatgttctcaagcgatccttccaccccagcttcccaaagtactggggttacaggtgtgagccatcacacttggccattggatacctgtttttagttcttttgggtatatacctaagagtgaaattgctgggtcatatggtaattccacatttaacttattgagaaaccatcaaactttttagggtttttttttttttgagacggggtcttgctctgttgcccaggccagagtgcagtggcacaatcatagccccctgcagcctcaatctcctgagctccagtgatcctcccacctcagcctcccaagtagctgggactataagcacatgtcactacacctgactgactttttttttttttttttaagtagagacaagattttgctatgttgctcaggctggtcttgaactcctgagctcaagcagtcctcccacctcagtctcccaaagtgctgagattacaggcatgagccactgtgcccagaccactgtttagttttttaatgtggctactaaaaaacttgaaattacatacatggcttgcattatgtttctgtgaaagagtgctgctctggatgcttctttctgcccaagtattctactggaacttacctctcatttacctttgccctcacctgcttccaaacaagactcaaggaggaacttaatactataaaacagccaggtgcagtggctcacgcctgtaaccccagcactttgagaggccaaggcaggtggatcatttgaggccaggagttcgagaccagcctggccaacttggtgaaaccctgtctctacaaaaaatacaaaaattagctgggcatggtggtgcgcatctgtagtcccagctacttagggagctgaagcaggaggatcacttgaacctgggaggtcgaggctgcagtgagcatgattgcaccactgcactccagcttgggagacagagtgagaccctgtcacaaaaaacaacaacagaaaataaaatactacaaaacaagttacatgaaaatgaaagtctttaaaccaagagtgaaaaaaggtaggggatccaggcgcagtggctcacacctgtaatcccaacactttgggaggccaaggcatgcagatcatgagatcaagagatcaagaccatcctggccaacatggtgaaaccccatttctactaaaactacaaaagttagctgggtgtggtggtgggcgcctgtagtctcacctactcaggaggctgaggcaggagaatcgcttgaacctggaaggtggaggttgcagtgagccaagattgcaccactgcactccagcctggtgacagagccagactctgtctcaaaaaaaaaaaaaaaaaaggtgggggaggacaagtaataaaagagggtggcaagaaggatcgattttgtcagagaaactgaataacaacagctaacatttattgagtgtgtgctttgtgccaggctctgctaagtgctttctttataatctttttttttttagacggagtctccctctgtggcctaggctggagtgcagtggcacgatctcagctcactgcagcctccaaatcctgggttcaagcaagtctcctgcttcagcctcccgagtagctgggactacaggcgtccaccaccatgcccagctaatttttgtatttttagtagagacgaggtttcaccatgttggccagggtggtctcaaactcctggcctcaggtggtcgacccacctcggcctcccaaagtgctgggattacaggtgtgagccactgcacctggccagtgctttctttataatggactcttcacaccaattctatgaggtaggcagtgtggtaatgttattatacacacaaagctgataagcagcacaagattatagattcagacccaggccttactccgaaacctgagctcttggcaccctggtagccaatgcgaagatggaaacatcagctctagaaagcccctaccacagagtctggaaagacagacgatgcccagtaagttatttccctgcccattctcacactaactcagagggagaaactttttcttgatcttgagctccacagggaatttgaccctgtggctttgtacaagaaacactaatacgacatagtgggtaatgtcccccatatcaatgttaccagaaatgaagcagcatgccacatcatatgaaaacagagggcataatgttaggtcttaatttattaagtgcagttcagtcgggatccaggagcttagacagctgatagcaagctttcactttatcttttagaatgcccttttgcccttttgagtctcttgcctggaaatggtctatgacagacctctgctgccctctggtgggcagagcatgaagcacccagcaaagaattctttccagtcacatggcctcttctttgtttatattgctgaatctgtgggaagctgggcttctccacacaatcccttgaggagaaggcttaacttgtatatgaaaggaaagacacctctcccaactcaagagcaacccactgccaggatacgctctgggcctcctgccttcctcaccccacttacacgccttaccaataacatcatgcccccacgggagcagtggaggctgcaggggcccatggtattgctggggccaagggcacatatggagtctgagatttctacaaccagatggtcaagaagcagggtggagaagggaggagctgcgtggttctggtcaaagaacaagtctttctcagcctacactggagccccagacattcctgcccacgatgaggaagctgaggagcagggcgggggagaagggtggcttttcaacctggtcagaggctaatttcggggtgcaaggtgagagagtaggatcacggtccactgagacctgctcctgggtcatttccaccccaggaccaaggctgaaatggacttaaaccctgaggaaggaaaggttctaatggcttctttagttcagggtccaacagtagagaaagctgcccagaaagacctgggggtgggaatttggccccagctcagcctttaaccgccagctttcaaatttaacccttcagcactctctctcatctctatctctctctcatctccatctctatctctctatacatctatctatctctctatctctctcgacgttgctacctgtaagcaggtcagcagctccctctggaaagggtgagcctccagacgaggaggaaaggtctgcaaggagcagctctcccattgctcagcctgagctgtgcctggggctcacacctgtctctccagtcccactctccaccctgacagaacatcattctgcaatatgagaggattcccagactgttgtttttcattgaaagttctaccatactgatgatttttttttttttttttttttttgagatggagtttcgctcttgtcgcccgggctggagtgcaatggcaggatctcggctcacttggaacttccacctcccaggttcaagcaattctcctgcctcagcctcctgagtagctgggattacaggcgtgcaccaccaagcctggctaatttttgtatttttagtagagacggggtttcaccatgttggtcaggctggtcttgaactcctgacctcaagtgatctgcctgccttggcctccgaaaatgttgggattacaggcgtgagccactgcacccgaccactgctgagtgtctgtgccttctcccccttgttttcatcctggcatgtgaaattctggtttctacctggttcagaacatttatctcttttcagtacagtagacatgtcaatgttgcctgatctgaaaaagagtggctggcatgaacctcgcagtggccaacccagaaacatccatgactccaggatcatgttgcagggaactgggaagggccagtgtctgtgtgatgggctgctgaacattttggcagatccctcttccactgttttatcattttgttgtttatttaaaaactcgaatacatgcacatagtttttttaaaaatcattatatcatcacaccaccacacccggctaatttttgtatttttagtagagacagggtttctactaaaacagtcaaaggcacagctactcagaaggctgaggtaagagaattgcttgagcccaggaggcggaggttgcagtgagcggagatcgtgccactgcactccagcctaggcgacagagcaagatttcgtctcaaaaaaaaaaaaagataactagttaaataaattacccatttcatagagttctattaaaagaatatacgtgatgacatgaaagatctccaagatacacaatataatccatttcatataaataaaaaacataactttaaaaaattatcttggtcccaagaacctagggatatcccctccctaaaataaagctacctggaggggacaaactgcctgtcttggagccaagggctggccctcaaggaaggaggtccaaggtgggaacattccaacatctataagaaactagccactcggctgggcacagtggctgacgcctgtaatcccagcactttgggaggccaaggcaggcagatcacctgaggtcaggagttcaagataagcctggccatcatggtgaaaccccgtctctactaaaaatacaaaaattagtcaggcatggtagcgcgcctgtagtcccagctactcgggagactgaggcaggagaatcacttgaacctgagaggcagaggttgcagtgagccaagattgcgccactgcactccagcctgggcaacagagtgagactacatctcaaaaaaaaaaaaaaactagccactcacccttgttccaccctcaacccacattctccaataaaagaaagaaggtcagcaggtctaaaagagactgacctccacccccaccagggcttgagaaagacatctatggcaagtcactctcagtttagtttccaccctcaacccacattctccaataaaagaaagaaggtcagcaggtctaaaagagactgacctccacccccaccagggcttgagaaagacatctatggcaagtcactctcagtttagtttccacccatctcttccctagccacacccaaccaaaacccattttcagtgtcctcacaaagaatggattacccatctgtcctaaatatgtaaatcgtacaatcccacaggcacacacataccctctagctctcccatatcatctgagccctcaaatagcacaaacaagaggtcagcaccagcctttatcgggaaagagaagcaccacacacccactacccaatccagggctatttcccatgctctggtcagcggcaggaggagaagcagagcagagagggccatgagtgcccctggaaatgtcacaagccccaggatgtcaccctctcttgactgccaggaaaagcttccagaattaccaaagaagctccagacaaatcagcacagctagggcaccgggatctctgcaagtagaagaaacatcaagtcacagctgtgccctcctggcttcagctacctgaaatgttttccctccaccctaggaaagcttggcctatattgctctcaaaagtcttaaatagctccttgcttcccagacaatccaatccaaactggcactgaaggctcttattattcagatgtcaaccttgtatctcctgttataaaaaactggaattatggtcgggcacagtggctcatgcctgtaatcccagcactttgggaggccaaggtgggtggataacctgagatcaggagctcgagaccagacctggccaacatggtgaaacactgtctctactaaaaatacaaaaatcagctaggtatgatggcaggcgcctgtaaatcccagccttgggaggctgaggcaggagaattgcttgaatccaggaggcagaggttgcagtgagtcgagattgtgccattgcactccagcctgggtgacaagagtgaaactccatctcaaaaaaaaaaaaaaaaaaactggagatacgtctgttcctttacccaccctgcccccactcctcacctcccaaacatatcccacacattcccaccctgtgttcctttgccagcaatcaccagattgcctatctggcatgtccctgtgctatcctccctttgtcgcatctgcctagccttaagcacctcaatcaaatcccacctctcccacagagaccttcccagggagccacacctgggaacaggtgtaagcctgtactgtttatatgagggttctcatctgggacacaggtttgccacacctgagaacaggtgtaagcctgtactgtttgtatgagggttttcatctgggacataggttctttctctccaactagacttttcctgaccttctgaagtccccttcccagcacctaagccagtgctttgcacatagcagttgtctgttattgttgatgacaatggactgtactcacctaattcggaatcagacctcacagtccagttggggttcatggtcagttttgggggcaggactggtgggacacagaagcggccacagcctgacttgcaacatttttctccagcttgacaattctcatccatcacacagccaacaatgcacaggcccaccagaacttttggacaatcaccgccccgccctgtgggaacaacaggcacaggaaaagggacagggcatcagctctgccatctccatgttcccatcgtgaacttacacacagaggctctaggtcaatcaacccctgaccctcactagacccaactaaactggctgggaaaccatggcgctggaggatctcagaatctttaggaacccaagagacctctgagcccagagttttcaaatggtgccccaaagggagttcccaagaggtaactcagggattgacacctctgcaggtttggggtgggggtgggtgaagtgtggcaggggcaagcctcccagaccactccccctccccctatgctctggattcatagtgtcacttcttcacggtggcctcctctgccaccctagacaaggtttgatgtccctgctttgtgctcctgtagcaccctgtatgcttcctctcatcaaactttatcataatcccttatttaaaaggaatatgtctatcttgcctgatgggctataagctacatacggacaagagtctgtcctcagccttgagcactgcctgggaatctaaagggactaagatagcacaagggtcaatgattctttaatggagatccacagtgcctggcactcaaaaatatttgtttttttaaaatgttgaagaaaaaaaggcattggaacaggaatgcttttatctctgtgtgtgtgtgtgtgtgtgtgtgtgtgtgtgtgtgtgtgtgtttccagctgggcgtggtggctcacgcctgtaattccagcactttgggaggccgagacaggcagatcacgaggtcaggagttcaagaccagcctggtcaacatgatgaaaacccatctctactaaaaatacaaaaattagctgggcatggtggcgtgtgcctgtaatcccagctactcaggaggctgaggcagaagaaaccccagaggcagaggtttcagtgagccaagatcacgccactacactctagcctggggtacagaccaagactctgtctcaaaaaaaaaaaaaaagaaaaaaaagaaaaaaaaaaaaaatatatatatatatatatatatatatgtgtgtgtgtgtttccaactaagatttcatttggggcaggggagaagctttttgttaaaaattagatctgaaaatcaggatcttgggcaactccttcattttacagataaagaaatttgggctcaaaaagacgggtttgcttacctaaggtcacaaagcaaaacctcagcagaatcaagaccaaaagccacactgtctgtcttccagcccaagtagttcctactgccccacagtgccttcccccagttcttttaatgtcgacagggcccctcggccctagaagaatgggttgctttgggttgggggaccagagggacaggaaggatgagaatcctagctcctcccaggaagggaaagagaagcactcttctcaggaaacactcaaggatttcttcccaaaagagccaacatacctccctcaatgtctccgaggcaggtgcggccacagccggtgctgcagcatttatgcccctggggacaggatgcatccccatcacacagctcctcacacggaagggggtcagcgggacattcaccaccaaactctgctacataatcaaagcattggagcccagagacgctcacaatatgaaacacatttttcattgtgtcccatgtgtatgtttatatatagttatatatttatatacatatataatgtaaatatttatgtgtatcatgtatctgcaatacatctgattttttttaagacagggtctcactgtgttgcccaggccaaagtgcagtggcataatcatagctcactgcagcctcaaactcctgcattcaagggatcctcccacctcagcctcctgagtggctagaactacaggcacatgccatcatgcctggcttatttatttatttattttgtagagacagggtctcactgtatcacccaggctaaagtacagtggcacaatcatagctcattgcagcctgaaactcctgtgctcaagggatcctcccaccacagcctcctgagtacctgggactagaggcacaagccaccaggcctgggtaattttatttatttattttgtagagacagagtctcactatgttccctaggctgatatcaaactcctggctcaagtgatcctcccgcctgagcctcccaaagtgccaggattacaggcgtgagcccccccacccagcccaccctgatattttatattctagttcttatttttcctaattactaaattgctttcaggactcacagtttgaaaaacactgttcaggtctaacccactgtggccaacattctccctgaattctccctgtggcagacatttacaatggtggcctccagtgaactttacctcctgggattcaggcccttttgtagtccccttccatacctactctgggtttgaccatctgacttgctttgaccaatgggacattagcaaatgtaatgtaagcagagccttgataagcactagcatactggggcttgtccactcagaatacttcctcttggaaaccagccgccatgctataaagcagcttgaactacgctatgggatgatgagatgccccatggagacagaacctagaagagaggtcatcctggacgttgtggctccagttgagctccctgctaagctcccagatgaatgcagctaaatgaatgaccacagctacatcatgtgggtatatgaactgcccagccaagctcaggcaacctacacaactgtgagaaagagtaactatattgctttaagtcatgaagtttggagatggtttcttatgcagcaatagatactggataccaagtttattctgagaggcaacaggtccagctaaaatgatttgtttccccatactctcttgcaacaaggggtgaccacaaactaggacataaactgggaaacttttgtattcctgacacagggaatacccctttcaaactgctccctcacttctttcttcttccagtccaaagatagacattacacagagaggcagagtagccttctttcaatgaggaggcaactcagcataacgaaatggtcaagaattgcaaagaggtgttgtatgaaaggagagaaggttagcactcccctcgacaaggatggaagaggcctttgggcctgacaacatgcatatggttcaagcattgccacctactttgtggcatctaaccatcgtcttttaaaataaataaataataaaatgtaaatgtaaaaaaaaaaaaagaattgcaaaggagaaagagggaaatagtttcatccttgttagcatcatggagccaccatcccagcctcaggaattcttgttatatgagaaaaacaaacccctatatgattaattttctgttgtgtgcagccaaacacatttcctatgaaaataaactcagagaagaatcttgcccagaactacagagtgagtcagcagcaaggcaggacaacactcagcctcttgatttgcggtaaagtactttttctactacactatccttaaaacatgcaggcaactggccagggccccaggcgcaggcacacccaaagaaggccacatccaaaccaaaccaattcaccatgactcattcatcttagtgtttatttcaagcttcttaagtaaagagaaaggtgacaggcaattaaagatttcgcagaaaaccaaagcaagactggcccagtgcctctgagtaggaacaggtaagtatgattgcatacagctggctctgggaagtctgccatgatggaaaaagcaagtattggaatccaaggagaatacatgcagctaaacaacccaggcgtagtaaccctgtatcctgagattttcctgaacagcccctatttcaaatatcctgtgctactgtgagatcacatcaaaactatgtgtcctgatttttgactcagaaaatgtggtcactgtaaccaccaaatgcatctccctgcacctccccacctgcttgacaaacactgaaatccatttaacaaggaacaaaagccttctatctcacagctgagaaggctgggagtaaaaatctccctggtggaaaaacccggtgacataaacatctcataaaattatgccatgtgccctagaaactgggagtgccatacgtcccagatttcaccattttgctgagcttgaccttgagatgaccaatgccaggagctctctgctactctctgccctcgtcctcaagaccaggcatggagcacttacctctacccttttccaggccaggcttcctggaggcccagagggtcacagcacctcgcttttgaccagtgcccagcaatgccacccagtctgacaccctgccttatatgaatccctgccacgtgatccctttctctcagctctaacacctggaattaatggggcctcactacctccaagccagattatgctatcctacttaagctagacagcctttatacctttttttttttttttttttttttgagacagggtctcgctttgtcacccaggctggggtgcagtgccgcaatggtggcttactgcagcctcaaactcttgaactcctgggctcaagcaatcctccaacctcagcctcctgagtagctgaactataggcacacactaccaggcccagctaattatttttattttttatagagacagggtctcactatgttgactaggcttgttttgaccttctggcctcaagcaatcctcccgcctcagcctcccaaagtgctgacgtcacaggcatgagttaccatgcctggccctttgtacctctttatactgacctgaaatctggctgggccttttcctatccccagagaccttacaaaaacctggcggatgccattctttcaggcaggatcctctgtctttcacgatcctggctttgccatgctaggtaaggtcagttcctcataagacatgctccctaatcacctcacaattagcttaccaggaatcaggaagagaaataggaacagtagccagaatggggatgacggttccccaccctctatcagcacccatcccaagactctaagctatcaccaaaaaaggagtgaagctgaagcccaggaaatactcactcacagtctgtcctgctgcctcagctccaacctgccactatgtctgagagaaagatgccagttgttgttggaaaagtaaaatttcagcacttcttaacccaagaagggccctctgagctaacaaacttactccccttctcttgtaaatagagagacagacaactagagagagggattggcctgaggtcaatggtagcagaactgagtcacaaatccccagctctgatataaggtctcatgccctttaaaccacatcatgggcctggctcagtggctcatgcctgtaatcccagcactttgggaggccaaggtgggtgaaacacttgaggtcaggagttcaaaaccaatctggccaacatgttgaaaccctgtctctactaaaaatacaaaaaaaaaaaaaaaaagccgggtgtggtgatgggtgcctgtaatcccagctactggggaggctgaggcaggagaattgcttgaacctgggaggcagaggttgcagtgagccgagatcacaccactgcactccatcctgggtgacagagcgagactccatctcaaacacacacatagacacacacacacacacatcatcatgatcccctacactgcagcaaggatcacacaaaaaccaagaagcactgggactcactctgcccagttccaccaaaagagaagatccagtggtagatagttttagaggttaggaaaagttatccaccagtgtgtaggcagtcctcaagaccacttacttccaggttcagtgattcattagcaggactcagcgtatagtcatacccatggctatgatttattacagcaaaaggatacaaagaaaaatcatcaaagggaaaagtccagaggaaatcaggtgctgattttcaagagtcctcccggtagagtcacaggatgcacttaattcttccagcatggaattatgacatgtgtgaagtgttttctaccagggaaactcattagacactcactgtgaaagttctctactgggggctggtcacttaggcaccctctgcctagcacgtaccaagattccagactctcagaaggaaagcagatgttcagcctaaaccacaatgtttacacaaacagtttaggcacagtgaaccactcttatcagttagagtagtacaaatacccacaaaatccaagttcccagaagccagccaaggcccagccttgccagcaagcctttttaagaagagcggtctcaggcttgttatgttaactcttttctgtacaacctgcagtgaggttttagaaaagggtcagccagacacccagggaggccatgccatcagcccacgtaaaagataatacatatatgttaataagcaaaacagagggtcacaggggatctggagtggtcaggtttcatacagtggggaggtgagccatgaggaggcccaagaagacaactgtcaggccagaatcagaatcttcactccaaaacctcttcccccaggttgtccctgtctcagtaaagaacaccaccatcacccaactgctcaagctgaatatctaccacccttcttgataccccgtctccctcaatgcctgcagccacttacttgttcacccagtcccattaattctaccttcacaaacatgtaagccttccatttttctttttcattgttattggttttttgggggcttttttgttttggattttttttttcttttttttgagatggagtttcgctcttgttgcccaggctggagtgcagtggtgcgatctcggctctctgcaacctccacctcctaggttcaagcgattctcctgcctcagcctcccgagtagctgggattacagacgcccaccatcatgcccggctaatttttgtatttttagtagagatggggtttcaccatgttggccaggctggtctcaaactcctgacctcgtgatctgcccgcattggcctcccaaagtgctgggattacaggcatcagccactgcgttcggccgccttccatttttctatgtctgcagtatctccaacccagtctaagccccgatcatctctcccagcctgccacaatagcctcctaactggtcttccatcttctacacttgcccccatccattcttcatatactggcagagtggtctttttaaaatgaaaactggacaaggcctctcctgcttttaaaccccctcaaaggcttcctattgcacttagaataaagcctaagagagaagccctgaagacccccgaaagtctgggccctgcctacctctccaacctcaaatgaaagcagcctccttctctcttcttcctttaccttcaaagcactcatgactcatcatcatcttggggttattatgtatttgttttcttgattatttcctgtctgtcacactatatgagcaagccccagggtggcaaggaccacggctgccttcctcaccactgcagacccacatgccaggtagggtagccacactcaatatacagtgaatacatgaataagtgggtgagtaaacggataggtcaggcatcagataggtggggaggcagagaaggggcggaccagaacacagaggtacttggcatgaccatatgagctctcttgagcattatctggcaggtttactgcagacttttttaaatgcatttctggccggacacagtggtttgtgcctgtagtcccagtttctcagggaactaaggcagaaggatcacctgagcccaggaggttgaggctgcagtgggctgagatcacaccactgcactccagcctgggtgatagagtgagaccttgtcccagataaataaataaataaaatgcatttcttctcaactgcattatcactctgggagctaaacatccttatccccattttacagataataaaagtgagattcagagaaatgaagggacttgcccaaggccacacagcaagcaagcagaagagccaggattcagacccatgttcagactagaacagtgtcatgagagcaggacccaatgtctgcccttgccctcaggcaacctgactgaacctccactttgccaaacagaccagcgctggctatggtaaacctctggcaatgtcagagcttaaggaaagcgaaatttttcatagccctggaaggagagcttcctgtagagttgggtatagcaaccagtcctgttgggtgagtagcctagccctcccctagggctggagctatacaaaagtagttaactaccaatgcagtagccagtatcacctcccaccaggctaggaaccccgctcagcccagcaggctctgggacatctgcgggagatcactattctagcctgcctgccaagctccagtggaaaaggaagccctatctgggctggccaggggccagagcagctcacaaaggtactgtgcctgggtgccagcctcgcccttagcccctacaattcagccctcagcttcaaacactgggaagattgtaccaagccctacatgccagcagtcagtgacctgcctgagacagattcccaggctggttccagagctgggcctcaagagtcctggcaaggagaacaaccttccattctctctaatgggcaggctgcccaagatagctgcctaagccgggcacagacagacccaatgggtaccagcaaggggcctcctacctggagaggtttgactggaaggaaaaaggttgtcacatgttacagggcttcaggttctgagaggaagtgatcagggaagaagaaaaccatcctggttttgaataaaggggctggtgagaaattgtactcctgctgggcatggtggctcacacctgtaatcccagcactttgggaggccaaggccggtggatcacctgaagtcaggagtttgagaccagcctgaccaacatgctgaaaagccgtctctactaaatacaaaaaattagctgagcatagtggcacatgcctataatcccagctacttgggaggctgaggcaggagaatcgcttgaacctgggaggtggagattgcagtgagccgagactgcaccactgcactccagcctgggcaacaatagcgaaactcagtctcaaaaaaaagaaattgtacttctgacccaggccacttaggaggcaagaggaaggaagttaatatatactgagggcaaaacactttacataatttgaataattacaacaagccttcgaggtttattcttcccaccttacagagaagggaactaaggctcaaaattacttgcccagggacctgctggccagtaactggcaaacctcaggcttgaacccaggactccgacaacccaaacctaggattttccactctaacatccaccacatgcactcagataagagaatgattccagttcctttagaaaacataatgagaaatattcaaaacagcagagaagaaaataaaatacctaggcataaatttatggagaaatattttaacactataaaacaccctgaaatatgcaaaatacacttgatcaacagggaaggcataggattcaacataggccaggcacagtggctcatgcctgtaatcccagcattttgggagccaaggtgggcagatcacctgaggtcaggagttcgagatcagcctgaccaacatggcaaaaccccatctcttctaaaaatacaaaaattagctgagcatggtggcacacgcctgcaatcccagctactcaggaggctgacgcacaagaatgacttgaatgtgggagcagaggttgcagtgagccaagatcacgccactgtactcctgcctgggcgacagcctgtctcaaaaaaaaaaaaaaaaaagaacatttcagtaccataaaacagggtaagaaaaaaaaaagattcaacattataataacagcagttctccttaagctaatttaatttatatatctaacatcactccagtgaacgtagtcttggtatttgggaatgatggaagaaaaatagataatattataataaaatatatttggaagcacaaataagcaaaagtagccatgaaaatcgtgaaacaagaggaaaataggaaggggttagacatagaagacatgccatcaatttctaatatgttttaggggcctctcaagggaatggagaaggaatagagcagagagccctgtcacttctacctccaaattttctcaactatgtcacctttctccatccccgctgctacctccctagtctcacgggtctacatcctcatctgccttcattctctccctcccatttctactctaaccgtactagctttctttccatttctcaaatgtggcaagctcctagtcatcttaaggcctctgtgtgtgcttctctctctccctggaatgtccatcgcacccttcacctggctaacttcaaatcgctctccaggttgcagcttaaatgtcactccacacatgccatcctcaaccacccaaaccaatgtgagttctcagccgggcacggtggctcacgccagcccttgggaggccaaggcaggtggatcacttgaggccaggagtgtgagaccaacccagccaacatggtgagaccccatctctcctaaaaatacaaaaattagccaggtggggtggcatgtgcctgtaatcccagctactcgggaggctgaggcaggagaattgcttgagcccagaaggtaggtggaggttgtagtgaaacaagatcgtgccactgcactccagcctgagcaacagagcaagactgtcaaaaaaataaaaacaaaaataaaagtgagttctccgctttactctgtctctcagcaccctttaattttccttccctgtccttatcagagtttgaaattatatatttatttacatgcttatttgttaaacctctttctctgccatgagactatgagctccatgaaagcgggcatgggatctaccgtattttccacaatataccaggagcccgtcactggatctcgcaaacagtacacattcaataaatacttgttgaagaaatgaatgcataaatggataattaggtcactgggactctgcaaaagggagaatgaatctctttcaaatacctctctaccaggaccagaatgaaaaagaatctgtttcccacaggagacagccccgccgtgtgtgtacatagggaacataagaatctcaggagcaggccaggcatggtggctcacgcctgtaatcccagtactttgggaggctgaggtgggtggatcacgaggtcaggagattgagaccatcctggctaacatgacgaaaacccgtctctactaaaaatacaaaaaattagccgggtgtggtggcacatgcctgtagtcccagataatagggaggctgaggcaggagaattgcttgaacctgggaggcagaggttgcagtgagccaagatcacaccactgcactctagcctgggagacagagcaagactctctctcaaaaaaaaaaaaaaaaaaaaaaaaagaatctcgggagcaaatgagtggggaaatgtgtgccaccttccataggcatcaagattcttttttttttttctgtctctgcagattctcaggataagattttttaacagagaatattgcaactgattatgggaactgggaattacccagtggttttcttttttcttttttttttttttttttttttttttgagacagagtctcgctctgtcacccaggctggagtgcagtggcataatctcggcccactgcaagctccgccttctgggttcacgccattctcctgcttcagcctcctaagtagctgggactacaggcacccgccaccacgcccggctactttttttgtatttttagtagagacggagtttcgccgtgttagccaggatggtctcgatctcctgacctcgtgatccgcccgccttggcctcccaaagtgctgggattccaggcatgagccaccacacctggctactcaaccgttttcaaagcagtctgcaaatgagggtaagttgaggctgcccttctggcaccctccctctgcctgcccaggctacataccacaaatgattatggcttgtgcaccctttgtatatcttttttttttaaggtcttagaatatagcagcaaagtaaaaccaacaagctgatatgtgcatatttgagaaataaacaagcagaccaaacagaccatgaggtgtggggacagcgtttcttacccagcttctgtttagagattgggactacacagctcttgttgcagccaagcgtgcagcatttctttacacctggacatgtctcatcagtgatgcaccttttcaaacaggattgtttccgaataaccctagggcaatctcttttcctccctgtagcaaaaagggagacagcaaagaaaagagaaaataggccgagcgccatggctcacacctgtaatcccagcactttgggaggccaaggcgggtggatcacctgaggtagggagttcgagaacagcctggccaacatggagaaaccccatctctactaaaaatacaaaattagtcgggggtggtggcacatgcctgtaaatcccagctacttgggaggctgaggcaggagaatcacttgaacccgggaggcagaggttgcggtgagccgagatcacgccactgcattctagtctgagcaacaagagcgaaactccgtctcaaaaaaaaaagagagagagagagagaaaatagtgcctggcaacacccacgggcacagcagaagggaaaaacagaaaaaggaagtcctgagatttatttaagcctctcaaccctggtgctaagacaaagagacaataataacaacaatagtaatagcaaatatttactgtaacatttactgacgtttaccttgtgccatgaacatcttatttgatcctcacaattatccccattttatagatgaggaaactgaggctaaaagcttaagatttataaagagctaaggcttaaggcttaaaaaggtctgcttggctctagggtctactctcttaatcattatcttacacagccttccctttacaactcttccctccagccttcacaggaactttgagtccaaagtaaaagacatagataatcaatggtgcgctctttcctgatggaaggcaaacaactgggggcactgaataattaaaggaggagggaccctaaaagagtaaagaagaagtactctaggcaagggagacttccagaggcaacctagaaggtgggaagctctctacttccatctatcccagaggcaatgtcagagagtatgcccagattttgcccctcatgccaacatacccttaggaatgtctcggcagatccgaccacagcctgtggtgcagcacttctgttcagccggacacaattcatcaccctggcacagctctttgcatgggttcttatggggagggcattctccctcttttgctgcaaaagatactatttgagtttggggtaactagccaggcctcagaaatggggaatggaccttcagcccctccaggcatctctatccaaaatatttctgcaccactgcactctagcctgggtgacagaatgagaccctgtctcttaaaaaaaaaaaaaaattctggctgggcacgatagctcatgcctgtaatcccagcactttgggaggccgaggcgggcggatcatgaggtcaggagatcgagatcatcctggctaacacagtgaaaccccatctctactaaaaatacaaaaaattagctgggcgtggcggcgggcacctgtagtcccagctactcgggaggctgaggcaggagaatggcgtgaacctgggaggtggagtttgcagtgagctgagatcacgccactgcactccagcctgggtgacagagtgagactccatctcaaaaaaaaaaaaaaaattctgcaaccaccttcccctcctcatacacaaatactaacatatatccaccactgctaaaggagcagccatcctgcagataacgagagagaaagggtgggatgatcctgttctcatttaatgagttctagggaaaagctagaacctctagtaagcccaactggaagtcctatctccttgtccagagagggtaaagaaagccaggaagaatgacccaggccatcctgagaatctattcatccagtcctgtcctatagagatgatcatctccacttacaagcaaccttgctctgggagaaggcaggggatgagttctcctctcctctagtcactttctgttactgttggccagggatcccaaatgatagctcaccatgttctcctgcagttatccaggattccagagacccaagagcaagaagtgccttcagaagaaagaggcagcttaacatcatgatgatgctgagagttgggacaagagctcagttcaggctagaggtgtacaccttgcccagagtatcagctgaggtatgagcaggactagggatggccccaaacccagtcccaaaaccttccctttcacaatactccccaagaatatcttctcctgacaagaagaagagggattggctgctggagtgtgggaaaattcctggcactaccaaaggggacctgtgatgggaggatcaaattctgtaagcaatatacacaatattcctggatgatgagaaacctagtgggtggctggaaaaatggaggggtggccattggaaaaagaatcaaagagagccctaaagggcattggaaggacatggctttagcccaaataacagagggagggattcacgacactacttaatggccaaagctaataacataaccaagcataataaaattgtggctcctgttcatcctagcaaccaagaaaatacagaatggaacagaccactcagaaactatcaaataggccaaggcgggcagatcacctgaggtcaggagtttgagaccagcctggccaacatggcgaaaccctgtctctactaaaaatacaaaaatcagctgggcatgctggtgcatgcctgtaatcccagctacgtgggaggctgaggcaggagaatagcttgaacccaggaggcagaggttgcagtgagtggagatcatgccactgcactccagcttgggtaacagagtgagactctgtctcaaaaaaaaaaaaaagagagaaaagaaactatcaaaaacctacagaaaagcagtagttgagtttgttaagaactaatgaaaagcaccaaacacctacatctttgtccctctaacccacacaggccattcttggactgtatgaagtctagctggcagaacccaagagaagttgctatgtatgactcaaatagtctgcccacatatacctcctttatttcttttttctccatttctttttttctttatctgtcctggtcatgcctttggttagctgtgatacctaatggtgtccactggcactgcttagtcctatgggcaggtacaaggtaaaacctccttaataggatcaaaaagtttggagccaggaagtcgcccttatggttagaaggctgatgttggctcatggagataattaacatttgatgatgacctcatatgtgcctaatatgcttttttttttttttttttttttttttttgagacagagtctccctctgtcccccaggctggaatgcagtggcgcgatctcggcataattaacatttgatgatgacctaacatgtgcctaatgtgctttttttttttttttttttgagacagtctccctctgtcgcccaggctggagtgcagtggcgtgatctcggctcactgcaacctccgcctcctgggttcaagagactctcctgcctcagcctcccgagtagctgggattacaggtgcccaccaccacgcccggctaatttttatatttttagtagagacggggtttcgccatgttggccaggctggtctcgaactcctgatggcaagtgatcctcccgcctcggcctcccaaagtgctgggattacaggcgtgagccaccgcccctggccgagcatattaaaatctagttttcaaaaactgaactgcaggcgccgctgtaccaaacgcttccctctgctccccaaccccagcctacagaaaactggtcccttcctcctaccccgcagtcatccccaggccttggcccagcgggaaacatcccttgactgaaccgccactgaacacccacactgcacaatcgaggcgcagccctcccgagaggaagccccaacgacctccacctacaaggcctctaagtgtaactgtcctgggcgaggcgcggcggttcggttcccatggtaaccccgcagctccagcgtcgcgcttccgggcggacgagcagcgcgctccagtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacggtgagggcgcccccggtgaggtctgggctcaggccgggcacggcctcggggctcctgggaccctggcccgcgggcgagagaacgcggaggctggagctgcagagggggttggcgttttcgcagcccgacgacctggatttaaattctggtgccgccctcctagctaggtgacgtgggccatctctgtcaaccccctgagtcccaggatcctcttctataaaatggaaatgattagtacctgtctcataaaacttgttgtgggatgggaagataaaggcgggtacaacgccccggacatcacctgacacagagttgaccctcggtaaatactgcttcccttcctcctgccgtgccagaaggcagggtcgggacttttaaggcaggaaacttcctcagttcctcttttgtggaggaggccttacaactatcgtcccaccccaaggcgggagagatggtgacggatctgagaagcagggatgtccaggtttaacttcatacccaccctccacctccaccccaccccagtgtcacaggccgcagtgacatttgttccgttggtccccacagaacccttggaacataatgataaagcaccggcaggtgcagcggaggggccgccgctcacagatgacaacaaggtaaggctggccctgcatggggcttatatcccagccactggcttgcatggcagatttgggatccccagtgcacaaggctatggagatctacagccggtagaaagagcacaggactgaggaagaggagactccgattctgtaactctgtgtgatcttgaactagtcaagtcacttccttctctgaactcacgtacaaaatggggaagggcacaggagatgggttgtggaataaacaatacctaagatccctcacattcactggctctgtggttgagggctctaaagaggtcagttagcatggagtttaagagaacaggctctggagtcagacaactgtgttctcatcaacagactctgatgagcccgttttctcaactataaagagggattaatagtatgcatgtcagggaagggagagagcacaaggtgggcctttgggatgctgatagtggtgaaatggatgttcactataattactcattaaagtgtatagacttttctgtataagtattatatttcataaaaacactttgggccgggcgcggtggctcacgcctgtaatcccagcactttgggaggctgaggtgggtggatcacctgaggtcgggacttccagaacagcctgaccaacatggagaaaccccgtctctactaaaaataacaaaaaattggccgggcgcggtggctcacgcctgtaatcccagcactttgggagtctgaggcgggcagatcacctgaggttgggagttcgagaccagcctgaccaaaatggagaaacccggtctctactaaaaatacaaaaattagccgggcgtggtggtgcacacctgtaatcccagctactaaggaggctgaggcaggagaattgcttgaacccaggaggcagaggttgcagtgagccaaaaccacgccactgcactccagcctgggcaacagagtgagactccgtctcaaaaaaaaaaactttgaaaataatatgcacttcatagagttattatgagaaagaaataaagtcatgcctctgtgatttgcacaaaatctgagcatgtagctagttttcaataaaagctgtctagtattgttaaggaattctatgtccataattaactggggaggctgggaaagaatatgtttgggacatgccccctcaccctgtctccctcctgaatgcagtttcacagatcctgccatctccatggatctcctccgagctgtcctgcagcccagcatcaacgaggagatccagactgtcttcaacaagtacatgaaggtgagagggacacaggataaaaaataacaggagaaagactcatgaggagcccagtccttgcctgcatcaccagtctgtctctttcctacatacagatatctaaagttttcctttcttgttgtttttgttttgttttgttttgtgtttttgagacagattctcactctgtcacccaggctggagtgcagtggcacaatatcgattcaccgcaacctccacttcccaggttccagcgattctcatgcctcagcctccctagtggctgggattacaggtgcccaccaccttgcagggctaatttttgtatttttagtagagacggggtttcactgttggccaggctggtctcgaactcctgacctcaaatgatttgcctgccttggcctcccaaagtgctgggattataggtgtgagccagggcacctggtcagttttcaaatttttaatcccccaagaattttattccctccttgagggtaattcagataccttttttttttaaaatctgcccttgtcacgcacgtggttttttttgctgacctcttataaggatgaagtgacttaaatgtactgtgctgagcactgtgctccagacataacaagtgtccaataagtattcttattagttgtttaataatataaccattattggggccatgcacagtggctcacacctgcaaccccagcactttgggaggccgaggcaggatcacttgaggccaggagtttgagaacagcctgggcaacacagtgggacctcatctctactaaaaaaaaaaaaaaatttttttttttttttttgagacagagtctcactctgtcgccaggctggagtgcagtggcacggtcttggctcactgcaacctccgcctcctgggttcaagcagttctctgccccagcctcccaagtagctgggattacaggcatccgccaccacgcccagctaattttttgtatttttagtagagacggggtttcaccgtgttagccaggatggtctcgatctcctgacctcgtgatccgcccacctcggcctcgcaaagtgctgggattacaggtgtgagccaccgcgcccgtcctgattttttgcactatttacacctcaatctgttgggcacccccacgattatatccgtaagagggggaataaagggaggaggtcaagcctgaaatgtgaatctaaatctggctgatcccaaagccctgctcataatcacttttcccttctgtatgaagctaggataaagacttattttatattcagtttccttcaggttgatgcacattaacaggactctgaccttgtcctctgttgtgctcccctagttcttccagaaggcagcactgaacgtgcgagacaatgttggggaggaggtggacgcagagcagctgatccaggaagcctgtcggagctgcctggagcaggtgagaccaaaggggacaagagatgcaggcacaaggtttagctctcgagcctctgataagaaatgcgatcttaagccggacgtggtggctcacacatgtaatcccagcactgtgggaggccaaggtgggcagatcactcaaggccaggagtttgagaccagcttgggcaacgtggctaaaccccatctctacaaacaatacgaaaattagctgggcatggtggtgcacgcctataatcctagctgcttgggagccataggcacgagaatcgcttgaacctgggagacagaggttgcggtgagccgagatggcaccactacactccagcctgggtgaaagagcaagattctgtctcaaaaacaaacaaaaaaagaaatgtgatcttgtcatcagtggtattttggggaatgcccagcaagccacatattgagataggcttgaggctgttgctgacagggaaaggaagggaagtagctactatatgtcaggtaccaggataaatgcattatttttttttatgtctcagaagaaactatgtacagaagatatcttttaattactattttatagatgaagaaattgtgacttagcaaactcatagaagcagagagtagaatggcagtagctggaggggagaagtggggggatgttaatcaaagggtacaaacttttagttataagatgaacaagttctgggcaatctgatgtacagcatgatgactatagtttatctctattgtttacttgaaatttgctaagaccatagatcttaagtgtccacacacaaaatggtagtggtggatgtgttgattgatttcattgtggtaatcatttcactatgtatatctatgtcaattcatcacattgtacaccttgaatatataccatttctgtttatcaattatacatcaatagagctagaaaaaaatttttaaaagcaaagcaaaaaaaaaaaaagaaatggcttaagacacataataattagaatagctaagatctgtctcacccctgcaggtgcgtggtggatcaagttatcatggccccatttggtatcatggggatgagcaccctgctgcctccctgcctctctggtgtggtcaggaagcatgacatcaggtctataaatgactgttcccaagatagtagagaacctgtttacatgtgtcagctgctgttattaggaggaattgttgccatcaccattttatagggagacatcaggaaaggtcgccaatagtcgctggctcactttctcacctcctattcattctcttcactttgttttcgcttcagtccccactacttcactggaacccctcttgtcggggtcgctagtaacttccgtgttgtcaaaccctctggtccctaactgtcctcaacttactcagcttctcagtgacatctgtcacaatggatcatttcgcgtttcttggaatgctcctctgttggctagagtgccttgactttgctccaacctcattgcctactcttctctctcaccccccgcctctaactgttggtgccttcccaagttcagtcctcaaaccccttctctttcatggctcactgttttcataggtgttttcatctagtcctgtggcttggaagccaattcagccgctcataattcacacatttatatctcagtccagagttacattcaccgttacccagttccaatccactcttctcacagcagccagactgatctccgtaaagatgaattagatcatgtcactccccattttaaaaacccttcagtgactttcctgttgcagggagaataaagtcttaatgccttaccatgatcctgctgggaaaactggctagccatatgtagaaagccgaaactggatcccttccttacaccttatacaaaaattaattcaagatggattaaagacttaaatgttagacctaaaaccataaaaaccctagaagaaaacctaggcaataccattcaggacataggcatgggcaaggacttcatgactaaaacaccaaaaggaatggcaacaaaagccaaaattgacaaatgggatctaattaaactaaagagcttctgcacagcaaaagaaatgaccatcagagtgaacaggcaacctacagaatgggagaaaatttttgcaatctactcatctgacaaagggctaatacccagaatctacaatgaactctaacaaatttacaagaaaaaaacaagcaaccccatcaacaagtggccaaaggacatgaacagacactcctcaaaagaagacatttatgcagccaaaagacacatgaaaaaatgctcatcatcactggccatcagagaaatgcaaatcaaaaccacaatgagataccatcttacaccagttagaatggtgatcattaaaaagtcaggaaacaacaggtgctggagaggatgtggagaaataggaacacttttacactgttggtgggaccgtaaactagttcaaccattgtggaagtcagtgtggcgattcctcagggatctagaactagaaataccatttgacccagccatcccattactgggtatatacccaaaggaatataaatcatgctgctataaagacacatgcacacatatgtttattgtggcactattcacaatagcaaagacttggaaccaacccaaatgtccaacaatgatagactggattaagaaaatgtggcacatatataccatggaatactatgcagccataaaaagtgatgagttcatgtcctttttagggacatggatgaagctggaaaccatcattctcagcaaactatcacaaggacaaaaaaccaaacaccgcatgttctcactcatgggtgggaattgaacaatgagaacacatggacacaggaaagggaacatcagacaccggggcctgtcgtggggttgggggaggggggagggatagcattaggagatatacctaatgttaaatgacgagttactgggtgcagcacaccaacaaggcacatgtatacatatgtaacaaacctgcatgttgtgcacatgtaccctaaaacttaaagtataatttaaaaaaaaatgccttaccatgacccacagagcctaccctcgactggcttctgcctgcttctttaacttcatttcatctcacctcttttttattgactatactctggctgttctgaactcctttctgctcctccagcacaagcttaggccatttcacttgctgttcttagtacctggggtactctacccttaactctataaagccggctccttcttttcttcagatcttagtttaaatatcagagaggtcttcccctcgcactcctacctctgctaaaatcttgagctttacaagagttgaggcctaatcttgttcaccactgtattcccagccctggaatatgactcttagtatgtgtacagagtttgctgaattattgagtaaatgaaggaacaaacaaatgataaatgaacaaacaagcttcctgctctaatagaacttaacagcctacttaagcagacaggtgtgaattagattaccaacaaatgtgtgcataattacacattgagacttgatcacccttcactggaaagggacaaagtttggaggagaagagcatgaatccaattatggattagcagctttgagccatccaagcatagacatggggcagactatttggtatataagtctagagctcagaggataaccttttgtctacagttgaattatggaatcgtggtttatagatgttaattgaagctgtgagaataggtgagagcagatagaatatgtaatgagagaggatagggaaaagaaccagattgagaaggaaaagccagcaaagaaggctaagaaagaacggccagagaagtagaaggaacacaggaagtgtggccacaggagcctgtagaaaagagtgtttccagaagggggagccctcagcactgtcaaatgccactggcagaggtcgggtgaacccaattctccacctgctgcaccatctcccctctgcccattccatccttttctttgtcaaatgagccaggtgttcccacctttgagcttctgcactcctccctgctgctgaaacacttctgcccagctttttttacagcctccttcacatctcaactcagaggccaccttctgagcaaggccttccctggccattcccgcaaagtagcccttcccctctggtggttctctgtcacatctgcctgggtttttttctttttttctcacagcatctatcatgatccacagttaccttgtttgtttctgtgcttattatccagatcacccacaaactataagctccacaagagcttgtcctagttactgctgtgtccacagcacttaggtcccaggtactcagtatttattaaaagaaaaacagcaggccaggcgcactggctcacgcctgtaatcccaacactttgggaggctgaggcgggcagatcacgaggtcagaagtgtgagactagcctagccaacgtgataaaaccccatctctactaaaaataccaaaaaaaaaaaaaaaaaaaattagctgggtgtggttgcacgcctgtaatcccagctactcaggaggcagaggcaggagaattgcttgaacctgggaggcggagattgcagacagccgagatcgcaccactgtactccagtctgggcaacagagcaagattccatgtcaaaaaaaaaaagaaaaaagaaaaacagcagcttactgaggagtatgtgttatactaatgtatttagtttgaaaaaacatacagtatgtatttacatgggaaaagcaaggaagaatttacattgaaacattaatagtagtttatgtaatgagattccaggtttttcttattttgcttttttacattttttaatttttccagccatgatcattaattcaagtttttttaaaaatagatatctatttctatgcatataaatatatatatgtgtgtggctgggcgtggtggctcatgcctgtaatcgcagcactttgggaggccaaggcaggtggatcacctgaggttaagagttcgagaccagcctggccaacatggtgaaaccccgtttctaataaaaatacaaaaattagctgggcatggtggtgggcacctgtaatctcagctgcctgggaggctgaggcaggagaatcgcttgaacccaggaggcggaggttgcagtgagctgagatagcaccactgcactccagcctgggcgacaagagtgaaactccatctcaatttaaaaaaaaaaaaaaaatatatatatatatatatatatatatatatatatatatatatatatatatatatatatatatttggaagtgggccgatcacttgaggtcaggagttcaagaccagcctgtccaacatggtgaaatcccgtctcttccaaaaatacaaaaattagctgggtatggtggcgcacccctgtagtcccagctactttggaggctgaggcatgagaatcacttgaacccaggagatggaggttgcagagagccaagatggtgctgctgcactccagcctgagcaacagagcaagactctgtctccaaaaaaaaaaaaggaagtaggtagggtgtgcttacccaccaaaatagtgactggtaacacttggtctttttcccttcaggctaaactgctcttttcagatggagaaaaagtaatacccagattgacccatgagcttccaggaataaaggtcagagtcactgtgttctcgggtattggagcgggaggtccttcaggctgggaggcaagtgaaatatgtgggcccagggaggttccatgtacttccatttgtaggaccaggcccacacagcatcatgctggatgggcttctttggcctgggtcagagcggggctggagagctgtagtccagggctgtcttctgcaactccagaagacctgcagctcccaggcactggccttccactgactcccttcccttttcttttagcgtggccgtcaggcagaagaagaatgtgcccatcgaggaagcccccttcctaaaaaggtaaaccatttccttgttttgttttctggctgaaaaaaggcttgtcaggccgggtgtggtggctcacacctgtaatcccaacactttgggaggccaagcggggaggatcacttgagctcaggagttttgagaccagtctgggtaacatagtgagaccctgtctctaaaataaaaaaaaaattagccaggcatgctggcacatttctgtcgtcctagctacatgagaggctgcagtgggaggatcacctgagcccaggagttcaaggctgtagtgagctatgatcatgccactgcactccaggctgagtaacagagtaagaccctgtctctcaaaaaaggctcttcactccgcaaggtactgggcttcctcaaagcccttttgagccttcctagacatgagaggcagtttttctccctgtccctgtcaaacatcatttgatctctttggaa

SEQ ID NO: 394 - DNA, 48175 bp, Homo sapiens
gcaaagtaacgcaggaacaaaagtaaataccacatgttctcacttgcaagtgggagatgaacaatgagaacacgtggactgttgagggggcagggggagggaaagcatcaggataaatagctaatgcatgcggggcttaatacccaggtaatgggttgataggtgcagcaaaccaccatggcacaggcttacctatgtaacaaacctgcaggtcctgcacatgtatcccggaacgtaaaataaaataaaatatttttaaaaagaaaatttgtaagcctgttttacatgattctttaaaaggtccccaataggattgagccacagtagtaaccagctcataatagactcttctctcttcccttctcttccctgaattactcatctcactccccatcttgtatgtcctgggaaatctctcaaacaaactacctgcacccatgcccttttcccagggttagtttctagaggatccaaactaaggcactgtccttgggcccttgcctaaaaagggttttacaatcttttgtagaaacagaggaagataacaataacaatattcctggaactctgaactctcaaagttctgattgtcttcactcccttgaatgatgtcaccagaagcctcaatgatcccttactctgcaaagtgtaatgtgccaaaaagatgtcaatcactcagcctcaaggcacaggactacatcaagtactttactggaaaaaattgagagtgacacaggtataaactgggagttctagaagttggagataaaggggacataaagatgaaatcaaaacggatggatattgtgcatcaaaagagccaaagatggaggaagaggaggtagatgcaagcgttctgttctgggaagggctaagatcttggaatgctgagagtgaaactggaagccagtctggagcatccgtcaggtacaggaacagtactcagagcatgagccacattctggcagttcttccagtgcatccttatccaatcagggaaagcctgcagagaacgtaggacagaaacagctgagcatcttgggttcagctcatctttggagcttgaagttatgtttatacatctttgcacagaaagacactaaaaagtagtgggtttgctttggggagctctccatctccttcaaggaaaaacaaataggagtgaatcgctgccaaagagttgtgttgagacattgatggcttagaagggttggttggtcaacgtgtcttaagtttagcgtcctgtgcctcttctgcaattcatctctgagatttcaccacttctacacccttcctccacccctcctaattcccctcatacttgccagcattgattacttctacatcccttctcatcctcagttcctcatactcagaaagtaactttgtcttgccttttgccaggtgcattcttacctcctgatcagagctggttctgtcagcaccaggtctgccaaagatgtagctgtcctggaatggaccagccaacacccagacctcccggcatgggactggagaggatgaaagaccggggcccctaggacttacgtttattcttgcaggtgttcaggcagttggctttggattggaagttgttattgtttccctggcagccaccatagacaaacatggagcaagtattatctttcttgtcataccaccaatgaagaaaataagccaggcaggggccagtttcttttggcatttcgcatacatctgcagagagactccagagttgaaaactcagtgtgcccactccagaaataaacagttgttattattctccctggcaactgctatagaagaaactggagtaggctccttttctcttatcacatggcaggagcacagctccactgacatattgcacacatttgcaaggagaccccagagtgggcatctgcatccctggagatagggttgttgcaggtgtaattagctaaaatgaggtcagaccaaaatagggtgggcccctataccaatatgactggtgtccttatacaaacaggttaatttggacagaggcacacacactgtgagaacaccatatgaatgtgaaggcagagatcggggtgatgtgtctacaagccaaagaacaccaaagattgccagcaaagcaccagaagccaggggagagcaatggaacatgcttcttccccataaccctgacaaggaaccaaccatgctgacaccttgatctcggacttctagcctgaggaactgtgagacaatacatttctgttgtttaagactcccagtcagtggtgctttgttatagcaactctaccaaacaaatgcaggtcccaactaaataatgcttacacagttccatttgggtaaatctccactgctaaacaattagatcctgttgatttttacctcctaatagctcacctctctgccagtctctttaatataagcctcagtgtctcatgcctggactgttgaggtgacctcagattgatccccctgcctccattcctggcccctccaatcaatccttcatgcttcccaccagagagaaggatctgatggatctgagagccaggcttatcatgtcattgcacagagaagacctaccttcactctatgacaatgtcctcccatgacccacaaggcccttcattgtctggctcctactgtgacgctggcctcctctcctgccgcagaacccctttgagccacatgctccagcagtactcaacacaccgtgctacctctatacctccatccctttgcactgctcacagtgacactcttcttacttcaaaacctttctcagacatcaactgctgtgatgtcactcttgaccccattctacattcctcactgccacaccttgcttcagagtcttgtgcattcatttttcatttgtttatatcttcagtctcatccctgaggctgtgagtttctagtgagcagggagtgagtttctagtgtatctgctttcatcttggcatcccaattcctaacaggtagcctggcacagtacagaaccttatggaacgttgaggataaacgaaatgtatcctgatctgaactgaataaattattcattgagcacctattatgtgctcaatgcttcaaggaacagagaaaaggcatgatctctgctatttaggagcccttagccaagaattacaaataagcgaataggtatcaggtggctactgtgtgccaggcataactctaatcacatcatgcagatcaattggatcctcaaaataatcttttacactgatccttttattatctgaggaaactgactcacagtgagggaaagttgttaatttatccaagacaaaaaggctcgtaaaaactggaggtaagagttgaactcaggatggctgaattcagaatccttacctgctggcatatgagtgacttagccccctaacctgcccactctacttctctgtcaagtcctgttcactttgcctcctatgtcctactctttctttcaagcaggtcctactcttcttcatcccctcagctacctctagttccggccaccatttctatcatcttgaagtcctttaagatactctgttcctcctattttaaactcgatagatgtagtatgaacctggtcatatgatgccccgcctcggtggattgccatagcccttgggatccaggcaagactctttaatctggcccaccatacctgaattgtttgatctctgcccacccagaatctgttttccttgtaccatgctcgtgctcactctgcgttctggactcccaaggccccaccactgagcctttgtgcatgctactgcctgtgcctggaaaacccctccacccactttttgcctaaaacattacccatctttctcaactcaaccccagattttctttctcaaagaaggcaatcccaacccccctgaccacactgagaccaaatcctattgtgggtctcagaggcactcaatcagtatttgttgaatgaataaaaacagaatctttgatagtctttttgcatcccagggtgatgggcatgaaactaagatgcagcagaaaggagaaaccctctgttctggagcagtcaggagaggcgttttggtgcaaagttggatttgtgtaggcagagaggtggtcactccatagcaaaaaagttgggaaatataaattgcttaatttatcacttgcagcatatgttagggcaacgatggccacctgggagctcaaaaaattataagagtgacaggtatccaaatagccaaaagaatctgattcaatgccactgattcaccaatgatttgttctgggaaactgagtctcagacattacctgataggataaggtcattcctaatggcacacaccatatttggcacagtaatgaatctaaatcgcaggtctcccaagtccagcagttttgccagagaccagccctcagcgatcagggcacaaagccagtccaggaaggcagaaggtgaggacagggggaggaggggttggttattctgcagctctgaatattaccttgtttgagatctaaacatttttttccgcagctgaagacacaacacttcttgttgtcctggcattgtctgtcctttgtacacacatccctttcttggaattcacattcttctctgattttgggacatctccctagggaaagagcggttttacacccgtgtgccttagagagcatagtgtctccccactttgccagacacaaggcaattctagagagtcagggaagtttgctttcagtttgcttgcccccaggagttcttttcctcagggcagcctcactcatttccctactgcctacacccccaccactccccagtgacctctcctccctctattcccaccccccagctccatcccatctaaggcagaatttctcaaccactggtgatatttgggctggataattctttgtttggggggctgaactggggattgtaggatgtttagcagcatcccaggcctcttcccatcagaatccagtagcacccctgattgtaacaactgaaaatgtctccaggcactgcaaaggtcccctggaaggcaaaatcacaccattgtgggccactgatgtaagccaatgcggtctttttggccttgttgaggaatccatgtttggaagttcctctaggtggtagtattatacagcaattagtatcacttaccccggagccagtttagattttgaattctgacttggtctgaattctgaccctctctgaaccttggtttcatcatctgtaaaatcattttgcccttacggattttgtgagaaaacaatgagacaaagtatataaagccctaatcaaagtaactgatgcacagtcatattatctaacatttgctaagtatttaccataagccgagcactcttctaagcattttaaatgtatgatctcatttaatctttataattgctctatgaaggaagttctattaatatccccattttacacatgcggaaactgagacccatgaaatttaagtaacttgcccaagattacagggctaccaagatttgaacccactaagtctgattccagatccctctgttgttttagaaatcccttttcagaaatccttacttcctgagtgttcagcaaatgataccaatgatcattgttacattatagtcatggaattaatattccacaactaatgtgtcttaagtttaaagagacttctggatgctgtcctttatctcaaagttagggaacccctagggatacagggacactttatgggactacatttgaaagaaccaagagtggatagagatgatgcctcaaggaaggggcctgttttgcttgtggggtaaggagaaggtcccttggtttcccggattcctgtagcgactcccctgaaagctagatcctgtgactctcctccacctgcttgataaagaccctccacttcaaaggagctgaaagtggggattgcctaagttggggttactgcattcccagaaggaatcttacacaggagggatcttacaaatatctctctcctctcccaacccgggacctgggctaagatggtggaaagcaacccacatctgaagagttcttccctgttccttcctcccagcaaactcccctctctctagggtaagggctgaggccaatacttactgggaaataaccaatcagtcagaccaggtccctggacattcgctaagaggacgaatagcaccaggaggctcaaaagtccagaagatcccatgttgaagagaggccagcctttctggtggttcccgaatttggaatgctcagctgctgcaccttggatataagaactggagacaagccagccaccccctttcttgctgggaacactaagttcccaaggtcacaaatgggactaactggcacccacagctcacagcttgggaggaagggtctcttattgaatggatcttgatccttacacccctaggctgcactgggctgggggctctagtcaaccacagggagtgggcaaagcgtgtctcccactttccaggctaccttcagagtgaatgccaccatcttgggtcttcatcttgataacttggagagtggtggaatgtcctcattcttcattcattttccatcgtacgtgcacacttactagcacactccttctgcttgtctctgacaatgtgtctctgtcggtctcttggtatctcattgtttatctgtgcctctctgtgcctaagtctactgtttctctttccccatggtctctgtgttcctttctccctctcccacagtttcctcccatccttctgtcttttattgtatctttggttcactcatattcgttgactaaggccaaagaatacagatttgccacagagcagggtgtaggggaggaatcaggctgatagcagagtcttcagagaatgtttctcaaagttttgttgctctgagagcaagagaggatatcagagcttagagggagcctttatcatcactgccagctccttgatgtctgaggaactatgaagtgaagggacttgcctgggagactgcagtggaataaagttcagtaacacagcagactttggggattctaactgggctgctagaggagctgtgggaaagaggtgctggggaacttggacagctttcctttcctacagccatggaatctacactggccactcagccagtcctgggaagaagagagacactctttacagagtaaatgttatcccgagggctcccgttttcttctctaactaggagttacccttttgggccaagtttgttctccaaattttcctacatgacagacagaggccagacaaagacagccttattatcagagagtgactatatggtcacaaaatttaggatcacagacagccgccgtaagaatcccatgccaccaacttgacaatctcacttgaagagactaccgaatcaaatttttcttttcttttttcttcttttcttttcttctcttttcctttcctttcctttcctttcctcttctcttctcttctcctttcctttcctttcctttcctttcttttcttttcttttcttttttttctttaaaaacattcttgctctgtcatccaggctggagtgcagtggcacaatctcggctcactgcaatctccaccttcccggttcaagcaattcgtgcctcgacctcccaagtagctgggattacaggcatgcaccaccatgcacagctaatttttgtatatttagtagagatgacgtatcgcccttggccaggctggtctccacctcctggcctcaagcaatttgcccacctaagcctcccaaagtgttgggattacaggcatgagccaccgtgcctggctagaatttctaatgaatgagtaagacgtcgtaagcagtgctgtttcactcatttcatttcccatattctcacaaactcagcccaggagagagtgaaaactggaatatctaagtggaagggctctgagggaccatcaagccctatttctcaatttatagatgggaatcataaggcccagagaagtgaggatgctgactaaatgtcacccagcaagtgagtgtcagaaataagattaagagggagctgagcacacaagttcttgccagaggacaccagggcatgttttgatgttggtgtggatataatattttcttgtagagttgaaggtagagaggaagggtgagtctaaaggaatgaagtaatgtctttagtggagacagaggctgaacacccacaaagtgaaagtcagtaaatttctttttttttttttgaaacggagtctcactctgtcacccaggctggagtgcagtggcgcaaacttggctcaccaaagtcagtaaatttctaaatggtacccagggtccccaattaaggctgcattttttcgtaaattttattgaaaataaattaactatctttctggttgcttcattccattctgtcttgcctaattttcaggcccatccaagcatctcactttccaagcaggtgaaataaaatttatgtctttgggacttgggataaatcatggttttggccccttctctccaataatttcttggagaaggctgggtaaggacccacctggggttttgcctctcctttcttcatcctttctcattgagggcatggtgccctacctctgcctccaggccaattctctcccaggaacaatcctgtgcttagaacaggggactccaacgagaaccaacaagatcagcctctacctggcacctcctgctttttcattagcccaagatctgtcacatggactgattctctgtcactggcttcctatgttgttccctctgcctctaactctattactaagttacatgtttgctcccccaagtaagctctgaactccattaaacaggtctgtgtctagaacgcagtgcttaaaacatgaataggccccaaataaacactcagtacatcttgctggaagagcaaggtaggtgggggggattggtaggtgtgtgaataggtaggtagctatgtggatggatgggtggctggtagagtgtgataagtgggaagatggttgagcagggagagggattagtgaggaaagcatggatgtttgggtacatgaatgcatggattatggatgggtggatgattgggtgaataagtggattggattgaatataaagatggatagggtagtgatgggatatgtgggcctattgatggaggctgtttgaatgaaaggtggaagagtgcattggtagggggatggagggagttaggtatagaaatgatgaatatgtattttgatgggtatgaaagagtgtgtgcatgtgtgtgtgtgcagagaaagggggaagagagaggtcaataataggaagatgaattaaaggctagatgggcaagtgggtctgtagaagaaagatgagtaagaaaagtaagtggatagacatatggagtaggcaaatagctaagttgaaaagtgtgtcagtggaaggaaaggagggataggtgagtggggattgggtatttgcatatgtgttgagtgaatggataggtgagtaaagggattgaatagttagtaaataggtgggtggaaacatgaatgtacaaatgaaagcattaaccaaagttaaagatataaaagaattatatagagaacaatttatgctactctaaagtaatacatgtgaaaatataggaaaaatggatcaattttaccaaaatacaaaagaccaaaatttgcagaagaggaggtagaaaacctgcagactataagatgaaatatttaaaaattactaaaatataccactagaaagaacctgatctagatgcttttggagctgaattttggtagccttcaaaaaatgctgaattgctatattatgtaaaatatttcagagcatagaaaaagtagctaggtttcccaattagttcccatactcattttttgaaagtaatatgacccaaatagaaaaaacaaatttaaaaagacctatttttcttttgactatagatgtgaaaattcaaactatactattagctaaaaagaaccaataatatattgatacagcagtctgcaattaagtttattaagaatgcaaggatggctcaagaaaatttagtaatttattatgccaacaaattagaagagaaaaatcattatgtgactgtatgcttaaaaggtatttgataaaattcagtagtcattttcagtagtagctataaatggataggaaataggcttaaaaaggaaataactggccaggcacagtggctcccacctgtgatcccagcactttcggaggctgaggtgggtggatcacctgaggtcaggagtttgtgaccagcttggccaacatggtaaaaccccatctctactaaaaatacaaaaaattagctgggcatgatggtgggcacctgtaatcccagctacttgggaggctgaggcaggagaatcacttgaacccgggaagcagaggttgcagtgagccgagattgcgcctgggcaataagagcaaaactccgtctcacaaaaaaaaaaaaaaagaaagaaagaaagaaaaggaaaaagaaaataatttaagtgcaataaaacttatgtattccaaattcaacaacaaatatctttttatagtgcaggagccattgactttaaaataaggaactagacaaggatggatgccattgcctttattttcattattattttggaggttctacacaatacaagaagacaagaaaataaagtcatgaagttgaaaaaaagccaaatatatcatcactttcagatgatgggattatatataaaatcaaagtaacatcattcaatattgtgatacttaagataatttggcaagttggatacaagacaaaactgacagctctttatcatgctactcataattaatgattttgatgataatattttctacttactattcaacgtctggggtccatacatttcagtccacaatgtgagcagcacttttccaccaatgggcactcctcatcctgcaggcacttgggtttatcaatcttggtacatagcaagggcttgcgtgggcagaaaccttttttgactttatggggtaaaagaaaacacttgaccttgaaatacttggtcataatttgagacaaatttgaggaatcttgggaatctcaaacaaggttttattctgattaagcttcttacctttccccctacagtaacaatagactggaggaggcagagtatcaactttctacgactaataacttgaggagcatcaagaaaagtcttaccatctctgacttgtaccatctgataggattcctgtctgctcctacagaattaatggatctgggttatataaccccagagtaccacaggtggcaggagtattagcacacagaaccttcttgttttacaaattgtaggcattgaggcgtatttagagggaaatgagttgcccaatgccacatagaaagccagtagaaaagttgaagtaggttgaaaagccttggactcctgccaccacactatactgaaccttagaaccttaaagccacacctggacaatccctgggactacatggggaagtaaacacctgccttagaggaggcaggaaagttggcttctatccaacatcatttgctactaatgttttccccagcccatcttacaggatatgaatatgatgtgcatgctttgaagttctgtgcagacatgagggcttattaggaatacacctcatggttatgaattttttatgaatcggtgaatattgtcaccttgcaagtcattgaggaatgagtctcagaaaaaataagttttcttggggaagaatagagagcaatgctatgaattactggctttgaagaacagcacaatagtcttcagaggtcaagaggtcaatataacttgttgggcattaaaaggggttcccaaagatcctcaaagatgagcccaaggagcatctgaggttcaagacaccccccactccatggagacagcatgacatccttggcacatgcccaatagatttgggaggtatatccccaatccttacctgtccaggccctggcacaaacaaagccacacctggattcacaacatttgtctgtctggggacaatcgatgtcactgtgacatgaaggtggacactccttacgttcagtgaaagggaagagtgggcattgtccatccttaactaaaataagagcagatgtgagcttcttaaaaccccacccccatcccaccacccttcaaagagcctttccttctcttcaaagctagtatccctttctgcaacttggttcaccctaccctatccatctccagtaggctgtggaagaatgaaatgtctcatcatatcatgggatatggtagagagcatgctgggcttggtgccttaagccccatggtaaagtcccagtcctgctacttggtgagtttccttctctgtaaaatgaggataattatgtgaaatctacacaaatcagtgtaagccattttagggtatttggttttacttagaatgaaatggggatccatcacactgttctcagtagagaagtgatatggcctgactcatgttttgaaagggtcattgtgactattgtgtttataatagattgtaaggaggatagaagcagggagaccttttaagaggctgttggggtaatccaagtaagaagatggctcttcagatcagggtggcagctgcggaggtggtaaggttttaccagatttaggatctactttcaaggtagaactaaaattatttcctaactaacttaatggatgttaattgataaagagaggcatcaactgtgattgtgaagtttttcaaccaagatgagaagcatggatagaaccggtttgcgttaggggagtgatggtaagaggtactggtttatgtttatgttgagcttatttttctgtttttgagacagggtttcccactgtcactcaacgaagcctcaatttccccagctcaagtgatctttgaggaggtgggaatacctcctcaagtgatcttcccagcctcctgagtagctgggaccataggcacgtgacaccatgcctgttttttttgttgttgtgtttttgtttttgtttttggttttgttgttgttgtttgtagaaattgggtctcactatgctgcctaggctggtctcaaactcctgggctcaagtgatcctcttgcctcagcctcccaaagcgctaggattataggtgtgagctactgtgcctggcccgaggttctgtttaagcaagttcaacatgagatgtttgtgaggtccaggtggagatgtagagcagatagtggattttaggagtcagattagggctggagacacaactttgtgggtcattaggacataggtggtatttaaatcaattctttggggttttgtatgctcttgtactcatctgactgcaaattctacaagggcttccccaggtcaggctcaggctatgatgtgttgaactctcagaggtattatcaggttgcctctgagtcttaacctaaatttcccacaaaccagcccaagcccatttccctggcctcctcttccttgtcttcctgggagaggagacaaggctcttgtccacagcaccatgattccttagagcttcccatgaagggaagcttgtggtcctagtttcaagtcaggtcccagggttgccttggccgttcaggcccatgggtccatggaattaaaattccacctctactcctgaccaactgtgggtcctcaggcaactaacttcacctctctgactgtgttctcccatctgtaaagtggtagtgatggtacatttttcagcttgcctcacagaatctgaggtcgaaattgcaacgctgcctcataaatcacacagttgtgaagatcactggtcaccatctcaattgttaccgtttagtgagcccacaccacgggaccaccactctatcaagtctttgtgttttaaatcacatataatcctgccaacaactcaacgagctgtttgctgtgactccagaattacagaagagggaactgaaattcaaagaaatgaagaaagcagcaagtgggaaaagtcagatttaaattcaggtcatttgactcctaagtttggtaggacactgtttcccaacattgctggtgatgatcattatactaaggaatgaatccacagccttcaccttcaccccaccctactctccacctccagtgtggacacttactccatgggattccagagctggcctgtctacacttcattcttaagcaaatcctcagtatgatgctcaacaggttactatgatgaggaaacaccttcttccaagggggcacacctggctttcgggtcacattggccaagatctattaacattttctatacactatctcattttttggcagagccactccattaggtaaatactattattaacctcattctatagacaaggaaactgaagcttataaaggcaggcaactggcccaagacctcccagccagtgaatgacagagctaagtcttgaaccaaggaactttaacctcaaatcctgagcctataacctcattggtatactatttctagttaaactagaccctcagatttccaggatagaggtctcaccaattaacatgcaggccgttctgcaggcatcctcatttaagaagttgttggcattcccttcgcagcccctgtatttgaagggtgtgcagcggtaatttttaaagtcaaaatgccagcgctgtgcctcatgattacagtttccatgcctcacaggtagcatgcagggttctgaggtcaggaagcaaggaaagaaggatatgaagagtagagataaaagaacagggtcagttccctagcatttctcataactcctggtgttatcacccaagtcataaaaggagccatggcaggggaaaaaaaaaggcataggttctggtcccagttctactactaatagtctatgttgtatggcacctctgagcatcactccttccttgcaaagaatattacaaggtgcatataagaatcttgtactttggagctgatctttcttctccactgtcctgagctttggtagggcaagacttgttcagcaactattaggttgatgcaaaagtaattatggtttttgcattgttaaaatttgccatttgatattagaatacattcttaaataaatgtggttatatcatatatcattttaatgcacatttcttgcttcctgtacttttgctaatgacttattatttgctgtttaatttatatttattttagactatataaattatgtcagacaaaaagcaaattcgagtgattttctcatttgagttgaaaatgggtcgtaaagcagcagagacaacttgcaacatcaacaacacatttagcccgggaactgctaagaaatatacagtgcagtggtggttcaagaagttttgcaaaggagacgagggctttgaagatgaggagcattgtggctggtcattggaagttgacaatgaccaactgagagcagtcatcaaagttgatcctcttataactacataagaagttgccgaagagctcaacgtcaaccattctatggtcatccagcatttgaagcaaattggaaaggtgaaaaagctcgataggtgggtgcctcatgaactgagcaaaattaaaaaaatatatattgttttgaagggtcatctcttattctgtgcaacaacaacaaactatttctcaatcatattgtgacgtgcaatgaaaagtggattttacacgacaaccaatgatgaccagcttagtggctggaccaagaagaagctcaaaaacacttcccaaagccaaacttgcaccaaaaaaggtcatggtcactgtttggtggtctgccgctggtctgatccactataactttctgaatcctggcaaaaccattacatctgagaagtatgcttagcaaatcgatgagatgcactgaaaactgcagtgcctgcagccagcattcgtcaacagaaagggccaattgatcaacagaaagggccaattcttctctgccacaacgcccaaccacacgtcacacaaccaacacaaaagtggaatgaattaggctacaaagttttgcttcatccaccatgttcacctgacctcttgccaaccgactaccacttcttcaagcatctaaacaactttttgcagggaaaacacatccacaaacaacaggatgcagaaaatgctttccaagagttcatcaaatcctgaagcatggatttgtatgctacagcaataaacgaacttatttctctttggcaaaaatatgttgattgtaatggttcctattttgattaataaagatgtgttttgctttattttcttttgtttttttttgttttttgagaaggagtctcgctgtgtcacccaggccgcagtgcaatggtgcgatctcagctcattgcaacctctgcctcccgagttcaagcaattctcctgcctcagcctcctgagtagccgggattacaggcacccgccaacatgcccagctaatttttgtatttttagtagagacaaggtttcactgtgttggtcaggctggtgtcgaactcctgacatcaggtgatccacccgccttggcctcccaaagtgctgggattacaggtgtgagccaccgtgcccagccaataaagatgtgtttaagcctagttataatgatttaaaattcacggtccaaaaccgcaattacttttgcatccaaagtgcctaacaaagtgcctagtacctagaaggaatgaaataccaaggaagaaacagcccctgatgtctgaaaagtgatctgacactcccagctaagccacatggattctctgttggacatttaaaaaatctcctagaacatctgtatcaaccaacgtcactctgagatcatgatgaagtgagacaaaaacaagatcacagtgaaacctgcaaaataccaaacacccgcccccctctaagctaacgtgagtgacttatgcttctctaccaatcaatcacagctttatccttagtctattctgtattctgtattgttaagattccctgggatagccagtcatagaattgcccccgctttctgacagcacccaatctagagaaaactctcacttctttagaccctcccccgaattacccaatcaaagcccaaatcctataatagattctttctaccagcttcttactgaaatgcctcatacttgtctagggtgaatcttttccctcacttcaataagtaataaacccaatttgttcaactataggtgtattctggtggtctttgttcaaagggcattaacaacagatatttgttgaatgaataaatgtatgagtgagtgaataaatgaatctttttaaaaaacacacagttccccgcacatattagatagatgcccaatacattgagtcaccagaaaacctccttgaagatcaaagagtctgaaaaacaatgccagcatttaagctgactgaggttttattttgtcacagtgccataacagtctcttgaacagagtgcgcatgcaacaagtattagttatttgtgaataattgaatgttggacccaagaagaccagcatcaatattatggtgattgatggtcaccatgcctagacttatgacttgtacttgagggttaggcattgaataacagaatgagaagagcacaggccctgggtccttgtcctgccatccaagggaatccctcagccagttttggacagagcaagaagtggggaacctctgtcctcagcctggacatcgctaccttgaaagggatccatgcacttcttctgacaggcaaaaaagcagcacttctggtattccttgcagtcaaaatctgtgttacatgagtccggaagttcagtggtacaggtgagcctctctttgggacataaccctggtttgtctgcaagaaagaaatgtccaaactcacattctttcggaatttcagctctttttctcctatggcaaaggtgtgtagtgaaattctctcagccctatcctctaccttcgattcttagttcttgctctgcttatattcaggggctagttctgtttctcagcactcagattcattcaaatggatctgaatcaggaatttgtgtccaagaagaactgaaggagaagcatgttggataccagggaaaggggttagaaagggaccaaggccctttccctaaattcaaaagattttctctcttcttgaaacctaatattttaatgcttaattcctttgtctccagttgataaaagaaattagtaaagactggtgggaacatcatggaagtagaggtcaggagggctgatttgacccttgactcctggtaaactcaagaccaatctgaactcattgtatgatttttaatttacctctaaggagtaagaaacagtggagtggaagaagcattgtagtcaggcagacctggctcgggagcctggctccaacactaaccaactaaataatcttgggaaagtatttcccttcatctgagttatattttccatctttaaaatgagaatgacaattcctgccttacaggctgattataagagttaaatggggtgatgtctataatgcctggggtaagaccttggcagatgtggcgttgctttctaccttttatttttatttttatttttttactaaaaactagaagaggcaaggggaaaaaaactacagcacccagtgtttccagtcagtctcccatccaagtactaaccaggtctgatcctgcttaccttttgagatcagacaagatcaggaattttcagggtggtatggccatgcttccttcctttttaaggctagacatggcttcctgatttcagtgcttgtggtaggtagaatctaaagttgcaccctcaagattcccatcttctgattattgaatcaaacactaagctaggcaatgctgtgaagggattttgcagaaaaattaaagacccaagttagttgactttaagattagagattatctctaattttaaggtctaatctctggcccagacctagtcaattaggtccttgaaaagcagagttttcttctggttggtagagaagaattgattagagagattcaaatgatgagaaggatccaacttgctattcgtagctttgaagatggttgaggccaagtgccaaggaataagggtggcatctagaagtgacagccagtaaaggagcctcagtcctacaactccaaggaaatgactctactacaaccagggagcttgggagaggacagtgcatcccaaatgagaactacagccctggctgacatttcaatcttggcctggtaagacccggagcaaagaacccagatgcacaatgccagacttctgacccacagataatttgttacgtagcaaaggatagctcatacagcgcttaatgtgtctccatgattctaaactgagcatccctccagtggaatctggccagagaggcatgatcctttcagatactactgagtcttggaactgtagaactttggaatggaaagaactctatttatcattggtaccaaacttctgatttcatagatcaaaagtaatgaggtcagataggataatacaatgcattaggggcaagtctgggacttacaatccaggactcacttcaggagccccacgtcttccctgaggactggccactgagactttgagtactttccaacaatacttcttgtcattaatgaccccctccaggaatggactgaagctaagaagagtatgtggttcctaatttggagtgtacatcaaaatcatctatgcatctttcagaaaatatagactctaggctgaatcagaatctctagaaagtgcatccttgggactccactttttaaaaagaaccccaggtggtcctaaagcaggcagtgggctccaggagataggctgttacttgggaaccattgttctaggtttaggcagagacagagttcggcaaatcaaactgggtttgagttgttgtagctcctttccccattgtcagcttgaactctcacttattaataaaaaccctcctccgtttcttgttggctcttcttaaccacttacttgtgtgtataagcatacctcatgggtttctctgcatctactggggatgcttctcagagatctggtctcagctgtcttctgacattacttgacacatacttcctgggtaatcccactcgttcccacgatcccaactatgattcccatctcttcctccagactcatcctctattccaaactaaagacttttatttcgacctgcctgggaaaaacaccatctgggcatctcagaagcacctctgttccaacatatttaaaacagaactattatcttcttatgcccaagcactaccttactttctattccgcatcttgacatttggcatcaacaggtccagtttgttattagaatccagagattcactccttcctctccgccaccccagtatcccatcactcatggacttgggtcaattctgtctcctaaacctctctccaaaccctgtctcctgcctctctttactaccactccctcagatcagcacctgatctcaccccttgtctcttctcaactactgcagcagcctcctcactggtcctctcccctcaggctcatgcctagtgacttattaattaaaaaacaattaaacttgcgtgtgtgtgtgtgtgtgtgtgtgtgtgtgtgtgtgtacagtgggaatgaatgtaatcacccaagaattatgtgttgagtgatatcataagacagatgagaccagatctctggggatcatccctagtagatgcaaactatatatatagtctccttacatatataaaaatatggaaaagttagggaaataatttggggggagcaagtaaggaaagtatgtggagggccagggtcgtgagcaggggtagctttctgtggccccaaatccacagtagagggggcctcatctgacactggcactggcctcatgtctaaccctcatccccaataatgctttctaaggaagaatggctgcagcttttttgaactcacgtttgatcttcttggtcagcattgcagaagtccactccaaagcaagggagagaagcagcaggaaagctacattcctccaggagaaggtggggctatggagaggaaagtgcctgtatggatgagaagagaggtgggagttaagcacaatccagagagagacacaaagtgtgtgcaggggaaccttagagatgatccaccaggtccctttagttcacaggtaagaagactgacaccagcatggggaaggagtctgtctgaggtcagatggtgagttaaggtgtgtctaagacattccgtttcaggaccctgaccaatccccataccctgccatggtgctgtaccttgtgccacacagacacttgcctattgtcttgttcctgggtaaaaggccacacttgaatgatcacaaggatttatttggaacagttgcagagctggtttgcccacagtcactccaggggcaaccccagacactagtgagcatcttttctttgctccactgatgacagaaatggatggtatgagatttcccagagggcctgggcacactctactggatcttggtgcaccagaagcaagaacaatctcagatgaccttgggttaacagagaaattccttttattccttctgtgactatccaagcctaggatcttatgatactcccagacaaccagatgaacagatgagcttcccccgcctactcaagcccccatttcccatatgtgtcttcatgatccttatgtattttttattttaaggtgtgaaaaactaataatcctttactgtattaactcttagagtgcatgcatttcaaaaatgcaagaggtgggtagagggagaaagaggaagcaagagacagagaaaacatctttatgccaaaatatacatctgtattggtggaacttccgatactgagaaagctatgaaggtatcttggaatagagtatcttccagagttcctgaagccataccatgtggctgcctaaaagtaaagacttgtgacaatttatctccccaaccttttttgttgggggagttctaatcatgtatcctcttcaaattttacaatagtgcctatactctctggtcatggaaattatgaccccaaacatagtgatcttgattttgggcctcgctcaatcccttataacagcatatcttggatcctcaatttcctcatctggaaaatgggaataatacaattaacctggaagctttgttgtcattgtgaggattaagatgagatagcatgaagatttaatgaagtggtacggagtggtaggaaacgtagcattcagagttagacctgagttcacatcctgaatccaccacttatcggctgtgtggcctgggttcagtcacttcacttcactgagcctcaatttgtcataaaggaaacaataataacacctacctcacagacatgagaattacttgaactatttttgtaaagcatgacaagtggcttgtaaatcagtgtttattgtattttagccagttaacaaataatgaatggcaatagtgaatgccaacaaatgttcctattaccattttagcttttgagttccctagttagagactgtgtaaatcattcctttagttcccctaaaagattagccaaaaggccctctggtgctttaaatttttattatcaagtcactctatgggtttgaaattttaccctctaacctgaaaacatctattaacccagtcttgagaatcagttaatcagattagcctgcagtcagttagaagaaagcagatctcgtgggatggaggcaggggagaaacacagattaatagaattgccaaacataatagaggatgtccatttataattttagcataagtatatcccatgcaatataaggaacatagttctactaaaaaagtatttgatgtttatctgacattcaaatttaattggtcatcctctatttttattttctaaatctggcaactttgacacagaatgaatccattttggttggactggggtttgtttgggcaagagactacaaaacacaggtcttataggtaacaaatgagcataattgcaagagttgctcagtgggggctctgaagaactaggacagacctggaatactaggacagacctggaatactaggacagacctggaatacacggacacaaatgtgctatataaataacacactaggttctgggcacggtggctcatgtttgtaatctcagcactttgagaggccaagacaggaggatcacttgagcccaggagttcaagacccacctgggcatgggctgggtgcggtggctcacgcctgtaatcccagcactttgggaggcccaggtgggcggattatgaggtcaggagattgagaccatcctggctaacacggtgaaatcccgtctatactaaacaaaatacaaaaaattaaccgggcgtggtggcgggtgcctgtagtcccagctattcgggaggctgaggcaggacaatggcgtgaacccgggaggcagagctttcagtgagccgagatcgccgccactgcactccagcctgggcaatagagagagactctgtctcaaaaaaaaaaaaaaaaacttagcccagcatggcagcgcacacctgtggttctagctacttaggaggctgagctgggagaatcacttgagcccaggaagtcagtgtttcaatgagccatgatcatgcccctgcacttcagcctgggtgacagagtgagaccctgtggaggaagggaaaggaaaggaaaggagagaagaggagaggagaggagaagagaataggggagagggagaaaaaagaagaaagagagagtgaaagaaaggaaagaaagaaagaaggaaggaaggaaggaaagaaagacaaagaaggaaggaaaaggaaaggaaaggaagaaagaaagagaaagaaaggaaggaaggaagaagaaaggaaggaaggaagaagagagagggagggaaaggaagaaagagaaagagggagggaaagaaggaaagaaggaaggagagaaggaaggaaggaagggaaaaagggagggagggaaggaaggaaggacacacaccaggaatgaagagattttgattgaaatccacgcttcaccatcaaatcactgtgtcaacttgggctagttttacctccgtctacccatttgaaattttacctccgtctacccttttgaaaaatgagtggatttgactagattaggcttgttcaggctggggtacccatatccctcaggatacaggtagattttccaggaggtacacaggtacagagggatctgaggacattactgattattaaactacatatttactttttcctgaagttgatttacttgacaatgagccaccctgaagttctccttttcttcttctctttgattaagtccttcctctttaaatttttttttaaaaaaagcatacttcttacatatctctcacatgtcttcaaagtgtaaaaacttctgaattccaaacaaaggaacaattcaagaatgcattttcctgaggatgctttccatggaagcaaaggaaagaaagtgtgagtaagaaataccaaggggtcagcaccggtttcattcaggtggcaaactcacactaagccactgtgccttttgctgtctaccctagaaataggattcaggagtgtgatagttgccacggggatgtagattaagacattgatttgaattgaaaaatgaagacattcttttgtgggagaaatgagtttgactgatttggctgatggaggactgactttgccaattagttaaatctgtgccatcaagttttttaaaaaatatatttaaagtatgcagtaagataaaagcattttatgaaagtaatcacaaaattttaaaaaaatatattttttataaaatgctttcaaactttcctatattttgaaaccatagtattcaaactttccagcacttacagagcatttcagattagataaggtcactaaatgaaagaataacatgtataactaatcacattattaatcgtttggtagatgctggtaaagcctttttagttaactttctggaaattaagaaaatcacttgtgatttgtgattagtattctaccagctaaaaaaacaaatccttttgcaagataccaggtgtccaattctatgactttataaaaattgaaggagtgtttaatcaagctattgattaataattaaattagatcattaaaataatttttaaatgcttaatattattttaatataatctcttgagatcaataacatattgctagccaggtgcagtggctcatgcctgtaatcccagcattttggaaggctgagtcaggtggatcacttgaggtcaggagttcaagaccagcttacccaacatggttaaaccctgtctctactaaaaaatacaaaaattagtcgggcatggtggtgcatgactgtaatcccagctactcgggaggctgaggcaggagaattgcttgaacttgggaggctgaggttgcagtgagccaggattgcaccactgcactccagcctgggcaacagagcgagactctgtctcaaaaacaaaaaacaaaaaataataaaataaaataaataacattgcaaaatgttctgcagtagaagtgcattcctaaataagtaaacccaaggcaatagttgacaaaaaggcaaataaataagtaactttagtttaaaatacagtcaccctttggtatctttgggggattggttccaggaactctcatggataccaaaatccttagatgctcatgtcgcttttataaaatggcatagtatttgcatataacctacattcattcttccaaatactttaaagtcacctctagattggtaggtatttaatacttaccattataaatgctatgcaagtagttgttatactgtattggtttttatttgtattatttttattgttgtgttattttttattgtttttttctaaatcttttctatctacagttgattggacctgcagatgcagaacgtgtggatatggagggccaactgtaaatgccaaaaaaaaatcaactttacaaaatagcgttatcaatgttaactattttcaaatacaagtagggactgaacatatatgcatggaatcatgttctcattcactgacataagtgtaagtgtgcctccaaacaagttactatgagggtaaatacataaatatattcaaaatacacacactcaaataataagccacagatcacccaccattttccaagaccaaaattttcacataaatataagggcaaatacagccaaataccagtgtaaattaacacgcttacatacacagatatgtgaaaattccagaattcaaagtgacatgcagacatgtaacacaggtgtttatgcataaacacacagctcggtcagaaacggcccatacagaaacagtggtctactgaaacacagaatactgctgtgaccttctcactagcgatgaaaactcaacagttcacgataaaactgacttttaaaatgctcatgctttaaataatagagacaaaggaaccagacttctaaagccactctccaccgccactgaatttcttataagttgataatgtgaaggcaatttcaaaaacgtaaaagcacagggaggttggtgactcccatctggaataaagatttgttaaatgaaatcactgaaattgaacagagaaacattctgtaaagttagctaaatcatttttaccttttttcttgttagagacagaacctcactctgtcactcaggctgcagtgcagccgggccatcctagctcactgcagcctcaaacttctggactcaagccatcctcctgcttcagcctcctgagtagctgggattacaggcatgcaccaccatgcatggctcaaattctttttactgtgaaggccctgctagagacttgctactgctctagttcacatcttgtagaggcaaaactaaaaaagctgttgctgtgcgcaggtgctgtgggagaacccaagaaaaatggtctgaactgaaaatctccatttccactacccaatttccaactggtatactgtccacagaaaatttggagttgttccctaatgggaagccaaaaacatcagagtacaatcatggatggctcaagggtatctttgtggtgtggaatagtgatgtttcatagcctaagcctgtcatagaggccttggagctttcaatactgatgattgtgcttcataagtgtctcagagaagtcactgttatttttttcttgtattcttctagcactctcctcatggaggttatctcccttttcacagaggtcaattcaacatcctggctctgtatttgctgagtgtatgtcttctccatctgtttcatatggccttcagctttcctgaaattgtattcttgatagagacacacctgatgtaatgtccagaaggccaagtacttgggagctaatgcccaacactatctccagtcacagtccagccaataccatagctttatattcctgaattcagtgcggacaatatctagccttccagaaagtgtactgttgcaggcaggacagatagcaggtgaaccacaaaagtcaccactgccatgctgatcacagaagatgtgagagcagatggtgacccatgcataaccagagagttcaatgtgacactctcgataattacaaaacaacatgtcttcacacaaagacataataggatagtgaggtctccagatgctgaaaatagtccatgaaagaaatatgcagtcatcatccattgtatatctagaatttacagcactgaagaggaccagactgaaacagtaagactcagatctggttttggccttgaaattttacttctctggtatcagatgaatccagcttctatgtaggtatcaagttgaactacaggatctatcagctacttagcatcatctctttatagtcacatcagcctttaactcttcctttattgagaatttccaaatccaatcctgcttgattttcagggggtctgcagatgacctttcacagggccacttctggcctggcacacagggtgctaaagacccaggtcttacctcttcagtggatttcatcttcaacctgccatccttctccctttaggagagggagggttaaaataatttttgattatgagtatcatgtgatatttggcaacttactagaagttcaaagaaccaaatgtcatacttaaaactttttgtccctgtacacttacatattaaaagatgaattcctatagatttgtatttatcaataaaattgtgtttctcaatttttacaatgtgtttatttacatgttcattattattatatcattgaaataacaaatggattttaaaaattaattcataagaaaaaatttgattcctggagtctcatggtcacagtaaataatttaaattttaatttatgcatatgtttttaattgcatagcagtaggaaaatagcatgaatggcattgcctaggttgtctttcaggatttttatggttttgggtttaaaatttaagtctttaatccatcttgagttaatttttgtaaattgtgcaaggaaggggtccagtttcagtcttctgcatatggatagccagttatcccatcaccatttattgaatagggagtcctttccccttcacaatagcaaagacatagaattgacctaaatgtccatcaatggtagactggataaagaaaatgtgatacatacacacaatggaatactatgcagccatgaaaaagaatgagatcatgtcctttgcagaaacatggtggagctggaagccatcatccttagcaaactaatgcaggaacagaaaaccaaataccgcatgttctcacttataagggggagctaaatgatgagaacacatggagacatagaagggaacaacagacactgaagcctatgggaggttggagggtaggaggaaggagaggatcaggaaaaataactaatgagtactaggcttaatacatgggtgtcaaaacaatctgtacaacaaacccccatggcacaagtttacctatataacaagtctgcacacgtacccatgaacttaaaagttaaattaaaaaaagaaaatgacatgaataaaagacttctgagcataagattatattccattatactgaaagtctggggggtaagaggaatgaaaatatgagttcaatgaaaaaaattaatgttttaaattttctaactgttaaagaattgctttccatatattttaaatagatgcttgtgggtatcaaattagtatatttctaccccagtgattatatatattttaaaaaattatgtagcagtttaaaaaattaatatttacatgttcacataatgcattgagattcatttatgttgtgtgttgtttgttcttttttattgctgaattttgtccattctatggctatacaacaggttcatcctttctcttgttcatggaaatttgggttatttccagtttggggcaattatgaatgaagcccatacaaacattcgtatagaggtatttttatgaacctaagtattcatttctcttaaataaataccaggaagtggtattgccgggttatgtgaccagtgtatgtttgtaagaaactgccaaactcttttccaaagtcacagtaccattttgcattttcattagtaatgcatgcactactctcctaagagttccacttgctccacacacctgttagcgtttggtattgtaaatgcttttattttagtcgttctaatagatgtgcagtggtaagactgcatgctatttggagaaatgaaagtaattagcctacatttgtggaactctaagaatctaagccacttcaaatgttggtgggaagatttttcgtattttccaacttctcctaggacagctttcaaatccagttggttccttggtttctgagcctgcttgggtaggagtttctccagagccccatcattgaacctactttaaaaaaaagtcttcataatttccatactttattgtccttaaatcgttaattttaagtttaatattattccttttttattttccatgtctgattctctacccacaatctttttgttttcattagattttatttgcctttctttttccaacttgaaatggatcattggtcaatttcattcatttctcatttcctataatttacttccatttttatttttaatttgagacatacctctttcatcactgctttcattgcactttaagaaatttattttaattgactaataataattatttatatttatgtgctacaatttaatgttttgatgtatgtacacattgcggaatggttatatcagggtaattaacacatccatcacctcagatacttatcattttttaaattagaacatttctgtagcaattctgaaatgtacaatacattgttaactatggtcaccatgctatgcaatagatctcagagacttctttcctttgtctaactgaaactttatccccttaaccaacatcttccctttccccatacactccaccctgacccctggcaacggcctctgataaccaccatctactctctacttctacaagttcaactttttagattccacatgtaagtgagacatgcaatatttgtctttctctgcctggcttgtttcacttagcataatgttcttcatcttcatccatgttattgcaaatgacagaatttccttctttttaaaggctgaatagtagttcattgtgtatatataccacttttttacccatttatccattgctgaacacttaggttgattccatatcttggctattgtgagtaatgctgcaatgaacatagcagtgccaatatctcttcaacatactgatttcatttcttttggatatatacccaaatatgggattgctggattatgcagtaattctacttttagtatttttgaggaagctccacactattcttcataatggctgtactaatttatactcccaccaacagtgttcaagaattcccttttcagccaggtgcagtggctcacacctgtaatcccagcactttgggaggccgaggcgggcggatctcatcaggagattgagaccatcctggctaacgcagtgaaaccccgtctctactaaaaatacaaaaaagtagccgggcgtggtggcgggtgcctgtagtcccagctactcgggaggctgaggcaggagaatggcgtgaacccaggaggtggagcttgcagtgagccgagatcgtgccactgcactccagcctgggcgacagagtgagaatccatctcaaaaaaaaaaaaaaaaaaaaagaattcccttttctccacatcctcatcaacacttgttatgtttaatctttttgataacagacattctaacaggcatgaggtgatacctcattgtgattttaatttgcatttccctgttgattaatgatgttgagcattttctcataaacctattggctatttgaatgccttatttatttatttactaacttacttatttatttattttcaagacagtcatgctctgtcacccaggctggagtgcagtggtgtgatcttgtcacactgcaaccttcgcctcccaagttcaagcaattctcgtgcctcagcctcccgagtagctggaactacaggcatgcgccatcatgcccagctaatttttgtggttttagtagagacagggtttcaccatgttggccaggctggtcttgaactcctggcctcaagtgatcttcctgccttggcctcccaaagtgttgggattacaggcgtgagccaccgcgcccagcctttgtatgccttcttttaagaaatgtctattcaagtcctttgcccatttttaaattgagttgttttcttactatcaagtaaatggagtgccgtatatattttgaatattaacccctcatcatagtatggtttgcaaatattttctctcactctatgagttgtctcttgactctgttgattattttctttgctatgcaaacgctttgtaatttaatgtaatctcacttgtctagttttacttctgtttcttgtgattttagggtcatatccaagaaatcattgcccacacccatgtaatggagctttccccctatgttttcttctcagagttttatagtttcagccattgcagttagatcttttgtccattttgagttgatttttttaaatatatgcatattttgtatttcaatagcttttggggcacaaatggtttttggttacatgaatagattgtatagtggtgaagtctgagattttagtgcaccagtccccaagtagtgtacattgtacccaatatgtagtttgttttatccctctctgccctcctacactccgcccttctgagtctccaaagtccatcataccacctgtatacctttgcatacccataggttaactcaacttataagcgaaaacatatggtatttggttttccattcctgagtttcttaacttagaataatggcctccagctccatccaagttgctgcaaaagacattatttcattattttttatggctgagtggtgtatatataccatgttttctttatccattgagttgatttttttgcatggtgtgcaataagggttcaattttatttttctacatgtggatttccagttttcccaagaccatttatcagagacagtctccattgtgtgttcttggcacctttatcaaaaatcagttaaccataaatgtatagatttatttctgggctttctattctgttccattggtcaatgtatctgtttctatgacagtaccatgctgttttgattgctacagctttgtagtatatttaaaatcaggtagtgtgatgcctccagctgtgttctttttgctcaaggttgcttgagattcttggggtcttttgtgactccatacaaattttaggattttttaaatttctataagaaatgcaactggaattttggtagggattctgaagttatacactaacaagtggaataacctggaagaaattgagaaattcctagaagcatataatctaccaaaactgaatcatgaagaaacagaaaaactaaatagatcaacaagtaaggagatttaattggtaattaaaagtctcttatcgaagaaaaatctaggatctgatggcttcatgacttcattctaccaaacatttaaagaactaatgctaatcctcctcaaatgcttccaaaaaattgaagtggagggaattctttcaaactcattttatgaggccagcattattctaataccaaagccatgcaaagacactacaagaaaagaaaattacaggccaatatccatgatgtacacagaggcaaaaattctcaaaaaaaaaaaaagatcagcaaattgtattcaacagtacattaaaaggatcattcacagccaagcatggtgggtcacacctgtaatcccagcaatttgggaggccaaggagggcagatcacttaaggctaggcgttcgagaccagcctggccaacagggcaaaaccctgtctctactaaaaatacaaaaaaaattagccaggcatggtgacacatccccataatcccagctacttgagaggctgaggcacaagaattacttgaacctgggtggcagaggttgcagtgaaccaagatcgtgccgctgcactctagcctgagtgacaaagcgagactctgtctcaaaataaaagaaaaaaatagtatcatttaccatgatcaagtgggatttatcccttggatgcaaggatggttcaacatattcaaagcaatcaatgtggtgaaccatcttaacagaattagtgatataaataatatgatcatctcagtagatgcggaaaatgcatttgacaaaattcaacatttttatgataaaaaatctcaacaaattaggtatagaaggaatgtacatcaacacaataaaggccagatatgacaagcccacagctcttatacccaacagtgaaaagttgagttttttctctgagatcaggaacaagacgagaatgccaatttctaccacttttaatcgacatagtactgaaagtcctggccagagcaattagcaagaaaaataaataaaattcatccaaataggaaagaaagcgacgaaattgcctctgtttacttatgacatgatcctatatatagaaaaccctaaagactccacaccaaaaaaactgttagaactgataaagcaatttattaaactttcaggatacaaaatcaacatacaaaaatcagcggcatttctatacactaacaacaaactacctgaaaaacaaattaaaacaatcccatttacaatagcataaaaaatacttaggagtaaatttaacaaaggatatgaaagatctgtacactgaaaactacaaaatattagtgaaagaaattggagaagacataaataaatgaaaagatatttcatattcatatttcatatggattagaagaattaatattgttaaaatgcccataccacccagaacctatctttttgcccagcttccccaaatagcagaggttgcactttgcaggaaactgagcagcattttgcaattgaaaggtctacagatggccaggagctgggggagcagtgtgaattcccaggttacaatatttaggaactacaggtaagggcccactatgactctattacatctcgctaccctctagttctccccagttaggcgcttgcccagccccaggccctgtttccatggctgagagctcctagctcacacccctcctcatccccatagcatagcatgttctgttgcaaggctactcaaccagatatgtgcctctagcctcagttactaggaagcagaccttgaggaggacaactagctccataagtcactttaatacaccttgccctaagttcaggctgagtaagtaagtaaattagtaagcctcgtccaaagatattttcttctaaatgctgcctagtcagatatctacattctgataccggagaaggattgtctctaaatattgagtacagaacactccgtacatatctccatattgtgctgctaaaatattttaaatcttttacattttttgtccttttgatctgtcaatgattgagaaaggtgtgtcaagggccctcaatacagccatagatttctcaatttatgcctataatgatgtcaatgtttgctttaatatatcctgatttgattggtttaggtaaatacaaatgtattcctggtgaactgagtcttttaccattatctagcaagccatcctttatccttaaagataaaacttcgtcttagagttttctttttttttttcagacagtctctcactgtctttctcccagggcggagcgcagtggcacgatcttggctcactccaacctccctctcctgggttcaaatgattcttgtgcctcggcctcccaaggagctgggattataggcatgtgccaccacacctgtaatttttgtaattttagtagagacggggtctttccatgttgcctaggctggtcttgaactcctggcctcaagcaatctgcctgcctcggcctcccaaagtgttgggattacaggcgtgagccaatgtgcccagccttagagttttctattgcctaatattaatcaaactatactctctcttctttgtttgcatttgcctagtcttttttccattcttttgcgttcaaccattctacttatgttttaagtttatccttcaaatcgtgtaaatctacattgtaaaaatccagtccagaaattattacctattaattgacatttatgggcactaatgacatatttggattcatttctacaattttattacaagttatctactctcagtcctcattattcagattctgtacttgccaatttgcctacttgctgaaatttatttattacccaaaaatcaatactcatgatgcttttgtggtcattcagggatatgtgcagaatggcaaaaaatttgagtcccccaacgtacacattcccagctgaagtcaaacaaggcaacgctctgcttgtttaagctcttctactactataaacaagcttcctttttgcagtctacttagtgtcacatttttcacatttttgtgctttttgttggtgagtttgctgtttaaaatggctgccaagaattactaaagtgctgtcaagtgtcctaagagcaagaggcctgcaatgtgccttacaaagaaattacttgtgtcagataagcttggttcaggcatgagttacagggctttcagccacaattcaatgttaatgaaacaataatatatattacataaggtgtctttttttttttttgagatggagtctcactctgtcgccaggctagagtacagtagtgcgatctcggctcgctgcaacctccgccttctgggttcaagtgattctcctgcctcagactcccgagtagctgggattacaggcacccaccaccacgtcctgctaattttttgtatttttagtagagatgaggtttcactgtgttggccaggatggtctcaatctcctgacctagtgatccgcctgcctcagcctcccaaagtgctgggattacaggcatgagccaccgcgcctggcctatatacatgtttaaaaaataaagacagggccagcacggtggctcatgcctgtaatcccagcactttgggaggctgaggcaggcagatcacctgtggtcaggagttcaagactagcctggccaacacggtgaaaccctgtctctactaaaaatacaaaaattagcctggagtggtggtgcacacctgtagtcccagctactcaggaggctaaggcaggaggatcccttgaacccagaaggtggaggttgcagagagccgagatcacaccactatgctccagcctgggggacagagagagattccctctcaaacaaaacaaaaaaaataaaaataaaaataaataaataaataaagtatgtagagttttatttaataattaaccacacagattaaaaaatagaaagtagccagcttcccagaagtcttctgtgtgcaccttctaattaccatctctgtcatgtgtcttcagacagaagcacatataaaaacaaggttatgtattgatcaaatgatgaaaatgtgtggtcagaggcttgcattttccctaggagcaatggctcagtatttgctaatccggtgttcacagtgactttacagaacataactacccccaagtaatgggaatcaactgtatttttattactttggtgtacaaagaactttgagctctccatggcttgccacaacaaaagacttcctaggcaaattgtctactgctttgttccaagtgggggctctacttgaggctgtgggaccaagacaaaagaagcagcctctatgtggattaggccccttctcctggcagagagaaagcacaaaggagctggcagaaactcacagtgcaaaactcactatgcatatgctacatctgctcatactccaataggcaaagcacagctgacagcaaacccaaagtcaatgagacagaaatgtgtcttccttccacgggccgttctaaaattgcaaggtaatggacaggagtgtcctcttaaaggaaagatggaatgaatagttgtgaataataatataacccatcactactactcctgttttaattttttgaaaatgtttagatacatattatatgcttgtttaatttaaaatatcaaactttaccttgctcaggctctgcccctccacactgggccactcaaagatgcccaacttaccctacttgggctccaacagccatatcaggttgcattcgagaccagcctggccaacatggtgaaaccccgtctctactaaaaatgcaaaacttagccgagcgtggtggcgcacacctgtagtcccagctactagggaggctaaggcaggagaatcgctggatgcattgatgccctcttcaccctgcttaggctctgattcctgacacaagacagctctgttctgtggaacccctcctcactatgcttggcccaactccccacagccgaccactctaacttctatgtatcctcctcatctccttgggctcagaccctccatgtctggctacccacccccatagacaccctcctcaccctccttcagttcggacagtccacatcaggcctcttccctatggagacagcttcctcactttgctccagctctaaggctcctccctcatctgctcccctgcctggacactctgctcaccccactcaggctctcattctatgccagtctgcccctctagccccagggggatgcctttctcaacatgggcaggctggtctccatgctatgctgcttcttgcctcttcactgggcattctcatctacccctggctccagcacaccaggccagcagccctcctacagagacaccctccttgacctgttccagctctgatgcccacacggagccagccgtggctcccttccccttggggcaaacgcctaccttgctaaatgtgcctatctaatggctttaggactgactagttcagttagtaaagaaaaggagacaaaacaaggaagagctacttttcctttttgtaaaaatatgtattgtgaaaaacaccacaaaaataaaaatatgcatgaaacattaatgttcagtctaacgaactattacgaagtgaccactcattaaactatcactgaaatcaagtaaaaaatttccaacactttctgctcctttttcattcttttccagtcacaaccccttcctatgctctcaaaggcagctaatggtagtgactttctttttcatattttcaagatcatatgtattcccctaaatatgtttttgtttttgtctgcttctgttctatatcaatggagtcacttggaatgtattcttttgtgcctggctttttgtgttcaacattatattaatgaattccatccacattgttttgtgtagctgtattttgtcaattttcattgccatgccatctattgtatgactacacacatctctactgagttgtttatagtttgcagctgttaagaataaagctgctgtgtgtatacatagcatgtatgtaataacgttctgcacgtgtatcccagaacttaaagtataataaaaaactaggattttctaaataaaaatgttatttatatcaacatgtaataagtttattacgttaaatgaattaataaatgtttttaaatgtcaaaaaaattttaaacaatttactcatgtaaaaaaaagaataaagctgctatgaacactctgtgtgcatttgctggagcacgtgggcaggtgttcttgtaggttatacattcagcatagggaatgatgggttacagggtatgcatatcttcagcttctcaagctgataccaaattatttcccaaagagtttgtaccaattcacagccttgccattggtagttgagagttcctattgttccataaccatgctgtatgtagaactgtcacaatcttttcatttttaccatcctgctacgagtatggaaatacatcactgtggacttaatttaaatttcttgactactaatgaggttgagcacctttttagatctttattaaccacttggctatcctctctttgattttcttttcaaatgttttgctcattgttctctggggttttctgactttttcttgctgatttctactggagtcatgtctttcctcagttatatgtattatgaacatcttccaggatcaagggtaatcttctaaaacccttattggcttgtcttttaccttttgaatgaaagtttttatcacgtgcccttcctaccccaaagacagaatcaggaatcctttttctatgttcctttcctacaatacaataactcgctacaatacaatacagtaactccaatatctgaagtctttgtggacctctgctgttggttgtttttcttgatttttttcatcttgttttcttaagatctgtgtgattttttttattgtgagagtacatatttaatggaagtttatgtatgtaacaatactttgtggaatttcttggattcctgtgtttaaaggagaattcttccgaatcaacttgtcctcaatttttccctaacaactcatgcaattttgaattaaattcatagctttagatttatcagaccatgcacatgtgccaattttcctactctgctcttatgaaaggaaacaaggttgcagttacaaattctcagaatagtctttttttttttttttgagatggagtctcgctctgttccccaggctggagtgcagtggcactatctcaactcactgcaacctccttctcccgggttcaagtgattctcctgcctcagcctcctgaatagctgggattacagacacgcaccaccacgcctggctaatttttttgtatttttagtagagatggggtttcaccatgttggtcaggccggtctcgaactcctggcctcgtgatccacccacctctgcctcccaaagtgctgggattacaggcatgacccactgcacccagcccagagtagtcttttttcctgttttgttcagagccaaagccaagacaggcaagttccttcaccacagttgtgcatgtgtgtgtttctgtttcatccatttatttctgtttcatccatttattaaggtgtcagcatttggtgatccttgtgagtgagatttctgatctgacttttcacattgcttagggcttagctcttttttcttgcccttgccaggggcccactaaaattcaaactgcagattaccaggcattggcagatactcccagggaagcctctaactaaagcacttccttatctctctggagtcagaccttcacatcatttttggcttttaagaattcctctttcttgccaactgactcattgatttaaagagtcatgcattttaagtattttagacaatattttgggggggtgatttactgggaatagtttctaagagtcctagttatgaatttttaattataaaattacacacatcaaatacccaataagtgaaacagtacaaagaacatataaagaaaaggtaataatttctaagccacatctctccatttctaactccctcaatattaatagccttggttgataattaataaccaattttaatgggctgttttgtacccttaccatctttctctgcgtccaaatatatacaatcatgtatgtatatgggttctgatacttggaaaacaaaatgaaattatgatgtatacattcactactactgtacttgcttcttttcacttaactctacctcatgtaagtccatccatataaaaatgtagattgaaaattgccttaaatagatgcccacactctgttcaacatctctgctcttaaattactgctagtcttatggaaattgcagagttgcttaatttgcatatccccaactactactgatattaatcttctttgctttttaaagttttttagttaaaaaatttataattgacaaataattttatatatattagtgtgatattttcatatacatatacttatattgtgaaatgattaaatcaagctaattaacatctccatcacctcacatacctatctttttttgtgacaaaaacatttaaaacctactctcagcaatcttcaagtgcttttaattatcggccatttgaattttctctttcgtgaactgcttgtgcaaatctttttctattgagatgtttgtcattttctcatcaatgtgtttattagaaaaaataacttctggctagtcatatgtattgcaaatatttccctcagcctgtagtttgatttttatttattatgtgttttgttctataaaaatttaaagagttatgtaatcaataatgcttattaatttttctttatgtcttacatttcttgcttaagaagttctctccaatgctaacatttgagatcattctcctaatttttctcctaagttatttatttaaaaaaatctaacacataggacagagatttctacttttctgggaaaatgaactagatggacttttctctattcctctgatgaaattcagctaaaaatcctggacattaaatacacaagaagattctgaaaggtaataagggcaaggcagacgagccagaaaccttaagacctgaagaacagcacggcagcgggattactgagttttctttttgcctcacatattcaagactgggtgctagagaagctggaaacccagaaacacagaaacagagacaataaaagcctcaaaaacaaaacaaaatgcaacacaacaaaaaaccagcctgctcactcttgccaaaggaccaggaaagaggcagcctaataagacggaaaacattgaacaataaccactagtatagccaaacacgtagttccacccccatcagagctgagagaggagcctcaacttctgcctttaccaggctgaaaggaggagccccagtctccctgcaaagagcccagactttggtcaccaccagacagtaatgatgctgccttcccccaatgcgtgtgctgtcagtggaggccgtgtggggagcagaaggatacttctatccctctctgctagagaggtatcagtggaacttattgaggagctagacctcccaccccagcccagaagtaatgagaggaaaccactcccccaactcagttgtcaacaaagactcaatggggaacctgatttctacccccatccggcagtaatgaggtggtgctccactcttccctgctggaagggtgacagaagaaatcaaggtttaaatgagatctagaatctcataaaataaaacccaaagtttccaactttcaatacaaaattatttgttatatcaaaaaccagaaaaatctcaaacaaaatgacagaagattattaataggtgccaacactgggatgacaacgatgttataattatatgataaaaattgtaaagaggtcatcataaagaagcttaaaggagcaattataaacaaacaaagatattaaaacagaacgtctcagcaaagaaatagaagatataaagaagaaacaaatggacattttagaaaattttaaaagcgtataactgaaatacaaactcaatggatgagcttaacagccaaatagagagtatagaggaataatctgtgaatttgaagatagaactttcactcacatccgtgtgaagagaccaccaaacaggctttgtgtgagcaataaagctttttaatcacctggatgcaggcgggctgagtccgaaaagagagtcagcgaagggagataagggtggggccattttataagatttgggtaggtaaaggaaaactacagtcaaagaggggttgttctctggcgggcaggagtgggggtcacaatttgctcagtaggggagttttgagccaggatgagccaggagaaggaatttcacaagataatgtcatcagttaaggcaggaacaggccattttcacttcttttgtggtagaatgtcatcagttgaggcaggaacaggccatctggatgtgtacgtgcaggtcacaggggatatgatggcttagcttgggctcagaggcctgacattcctgtcttcttatgttaataagaaaaataaaacaaaatagtggtaaagtgttgggaaggcgaaaattttttggggtggtatggagagataatgggcgatgtttctcagggctgcttcgagcggcattaggggcggcgtgggagcctagagtaggagagattaagctgaaggaagattttgcggtaaggggtgatattgtggggttgttagaagaaacatttagaattattggtgatggcctggatacagttttgtatgaattgaaaaactaaacggaataagagaaggagaaaaacaggtattaaaggtctaagaattggaaggacccaggccatctaattagagaatctcctaataaggagattcagcatagtcctgccagcaaagattatttatttactttaagagttaagagtggcagtttggagatagcactaggagatatcagctgtgatggcttggagaaacagtgtaagccggcagtgtaaacatattgtctagtcctttttaagttagtggctgagcttggtgaggtgtgtttttaaaagacctttagtccgttctacttttcctgaagactgaggactgtaagggatataaaggtttcactgaataccaagagcctgaaaaactgcttggctgatttgactaataaaggctggtccgttatcagactgtatagaggtgggaagactaaaccaaggaattatgtctgacagaagggaagaaatggctgcggtggccttctcagaccctgtaggcaaggcctctacttatctagtgaaaatgtctacttagactaagaggtatttttgttttctgactcagggaatgttgagtaaagccaatttgccagtcctgggcaggggcaaatctctgagcttgatgtgtagggaagggaggaggcctgaataatccctgaggagtagtagaatagcagatagaacactgagaagttatttccttgaggatagatttccacgatggaaaggaaatgagaggttctaagaggcgggctagtggcttgtactatagcatagcctgcctttgctggtgtgtggtgattaggcctggtggaactaccatcaataaaccaaatgtgatcagggtgaggaacaggaaagaaggaaatatggggaaatggggtgaatgtcaggtggatcagagagatacagtcatgggggtcaggtgtggtatcaggaataatgtgggaggccggattgaagtccgggccaggaacaatggtaattgtgggagacttaacaaagagtgagtacagctgaaggagccagggagcagaaagtatatgtgtcaggtgtgagaaagaaaatagattctagaagttatgagaagtgtagagagtgagttgagcatagtttgtgattttaagggcctctaaaagtattagggcggcagcagctgctgcacggagacatgatggccagcctaaaacagtaaggtcaagttgtttggacaaaaagctacagggcgtggtcctggttcttgtgtaagaattctaactgcacagccctgcacttaggctttgggtaatgaaaagggttgggatgagtcagggagagctagggtgtgggcagtcactaaagctgtcttcaaggaacggaaagaggagtggggaaggatttaggatctatagggtcagctagttttccttttgtgagtttatgtaatggttttgttaggatggcaaaaccaggtatctaaagtcgaaagtatctaaccatgcctaggaaggaaaggagttgttttgtaggtgttggggtttgagagatcagctgaacacgatcggcagggagagcacgtgtgtttttatgagaattacactgagataggtaacagatgaggaagaaatttgggcttgactgaagtaatgggggctatctgtgaaggcttgcggcagtgcagcccaggtaatttgctgagcctggtgggtgtcagggtcagttcaagtgaacgcaaagagaggctgggatgaagggtgcaaaggaatagtaaagaaagcatgattgagatccagaacagaataacgggttgtggagggaggtattgaggataggaaagtatatgggtttggcatcatggggtggataggcaaaacaatttggttgataaggcgcagatcctgaactaatctgtaagacttgttcaggttttggacaggtaaaatggaattgtaaggagagtttataggttttagaagcctatgctgtagcaggcgagtgataacaggctttaatccttttaaagcatgctgtgggatgggatattggcattgagcagggtaagggtgattaggttttaatgggatggtaatgggcatgtgatcggttgccagggaaggagtagagatgtcctatacttgtgggttaagatggggggatatgagaggaagaggcaaaggaggctttgggttggggagaagggtggcaatgagatgtggctgtagtccaggaatagtcagggaagcagataatttggttaaaatatctcggcctaataagggaactgggcacttgggggtaactaaaaaagagtgcttaaaaaaatattgtctaagttggcaccagagttggggagttttaagaggtttagaagcctggctgtcaatacccacagcagttatggaggcaagggaaacaggcccttgaaaagaaggtaatgtggagtgggtagcctccatattgattaagaaggggacggacttaccttccactgtgagatttacctaaagctcagcgtccatgatggtctatggggattccgaggcgatcgggcagcatcagtcttcagtcgctaagccgagaagatctgggaaggagtcagagagccttgggccagagttccaggggctctgggagtggctgccaggtgagttgaacagtctgattttcagtggggtcccgcacagacgggacacagcttaggaggaatcctgggctacggcattccttggcctggtggccagatttctggcacttgtagcaagctcctgggggatgcaggcctggaggaatgcctggccactgcggtttgggcatttggaagttcttgtatgctggagatgtggctggggtttctctcagagtggaggcaaggaattgcaactcagaaatatgttgttacttggctgcctctactctattattgtacaccttgaaggtgaggttaattaagtcctgtggtggagtttgagggccggaatttaatttttggagttttatttaatgtcgggagcagattgggtaataaaatgtatattaagaataagacggccttttgaccttttagggtctaggctgtaaagcatctcagggttgctgccaaatgagccatgaactgggctggatttttatatttgatgaaaaagagcctaaacgctatctgatgtgggataaagaaaaaggagcattaaccttgactatggctttagctccagccacctttttaagagtaaattgctgggcaggagatcatgtatggttcttccaagattgccaaggtatcctccaactctcactggtggtttcggggctcaatgcaggaaatcatattgctgattttctagtccaacttgctgttctctagaagagagaaggggtaggaattcagtagccacacaatctggtaaaaacatatccatttaagcataactaatcctcccaaaccctgtgggcagggatgtttttctgtggctcaagagatgcccacacaaggattctcccaggatgttttaagttcaatgagcagagacataaatgccagatctcctagggtttggctaaatcaagcagacctacaagaggagtgtggggagtctggggataggatgaagaagcagaggccccagattggattggctgggactgaggaggcatagcatcctgctgtctgtctccccacaacctaagagtccataatttttgagaactggatgaagagggaaaggtgcttcttagatcttaccatcttcaagaagcatgcagacatttccgcagaagacattactgcattaatgatgaatttgagattctgagtgtaacttgcagaaggttctgcctatcagtgagaatctgtgtggcatttcagttttggctttgataaaattgaggagtatatgagcagtaacacccaggagggtgtttctcactattatcagcccctccaatgctccaggacccactccattgatttcccttcttcctctccccagcgcaaggatctgggtggttttctttgttgttgttgttgttgttgttgttggcttctggagtaaagttccagtccccaatcatcctcccttcaacaactcagctgctatgacgtcacctctatggaatttaaactcacagaacctgagttcaattcttagagcaactagttctgaggcactttctagtcccccattttacaggatgggaagaattgaatctcaaagtagggaaaaaactttccttccaccttcacctctccacttctggctgaaatggccctgaaagactcagctcttccctacccatattcatcatgcaatatctactcaccaccttaccttcaattcttctgaagatttcacttttgttatcccagtggctccaaacttctctccatcaagcatgcattttatttctcctttttatgcccaatgttttgaa

SEQ ID NO: 395 - DNA, 81212 bp, Homo sapiens
gattatctctaattttaaggtctaatctctggcccagacctagtcaattaggtccttgaaaagcagagttttcttctggttggtagagaagaattgattagagagattcaaatgatgagaaggatccaacttgctattcgtagctttgaagatggttgaggccaagtgccaaggaataagggtggcatctagaagtgacagccagtaaaggagcctcagtcctacaactccaaggaaatgactctactacaaccagggagcttgggagaggacagtgcatcccaaatgagaactacagccctggctgacatttcaatcttggcctggtaagacccggagcaaagaacccagatgcacaatgccagacttctgacccacagataatttgttacgtagcaaaggatagctcatacagcgcttaatgtgtctccatgattctaaactgagcatccctccagtggaatctggccagagaggcatgatcctttcagatactactgagtcttggaactgtagaactttggaatggaaagaactctatttatcattggtaccaaacttctgatttcatagatcaaaagtaatgaggtcagataggataatacaatgcattaggggcaagtctgggacttacaatccaggactcacttcaggagccccacgtcttccctgaggactggccactgagactttgagtactttccaacaatacttcttgtcattaatgaccccctccaggaatggactgaagctaagaagagtatgtggttcctaatttggagtgtacatcaaaatcatctatgcatctttcagaaaatatagactctaggctgaatcagaatctctagaaagtgcatccttgggactccactttttaaaaagaaccccaggtggtcctaaagcaggcagtgggctccaggagataggctgttacttgggaaccattgttctaggtttaggcagagacagagttcggcaaatcaaactgggtttgagttgttgtagctcctttccccattgtcagcttgaactctcacttattaataaaaaccctcctccgtttcttgttggctcttcttaaccacttacttgtgtgtataagcatacctcatgggtttctctgcatctactggggatgcttctcagagatctggtctcagctgtcttctgacattacttgacacatacttcctgggtaatcccactcgttcccacgatcccaactatgattcccatctcttcctccagactcatcctctattccaaactaaagacttttatttcgacctgcctgggaaaaacaccatctgggcatctcagaagcacctctgttccaacatatttaaaacagaactattatcttcttatgcccaagcactaccttactttctattccgcatcttgacatttggcatcaacaggtccagtttgttattagaatccagagattcactccttcctctccgccaccccagtatcccatcactcatggacttgggtcaattctgtctcctaaacctctctccaaaccctgtctcctgcctctctttactaccactccctcagatcagcacctgatctcaccccttgtctcttctcaactactgcagcagcctcctcactggtcctctcccctcaggctcatgcctagtgacttattaattaaaaaacaattaaacttgcgtgtgtgtgtgtgtgtgtgtgtgtgtgtgtgtgtgtacagtgggaatgaatgtaatcacccaagaattatgtgttgagtgatatcataagacagatgagaccagatctctggggatcatccctagtagatgcaaactatatatatagtctccttacatatataaaaatatggaaaagttagggaaataatttggggggagcaagtaaggaaagtatgtggagggccagggtcgtgagcaggggtagctttctgtggccccaaatccacagtagagggggcctcatctgacactggcactggcctcatgtctaaccctcatccccaataatgctttctaaggaagaatggctgcagcttttttgaactcacgtttgatcttcttggtcagcattgcagaagtccactccaaagcaagggagagaagcagcaggaaagctacattcctccaggagaaggtggggctatggagaggaaagtgcctgtatggatgagaagagaggtgggagttaagcacaatccagagagagacacaaagtgtgtgcaggggaaccttagagatgatccaccaggtccctttagttcacaggtaagaagactgacaccagcatggggaaggagtctgtctgaggtcagatggtgagttaaggtgtgtctaagacattccgtttcaggaccctgaccaatccccataccctgccatggtgctgtaccttgtgccacacagacacttgcctattgtcttgttcctgggtaaaaggccacacttgaatgatcacaaggatttatttggaacagttgcagagctggtttgcccacagtcactccaggggcaaccccagacactagtgagcatcttttctttgctccactgatgacagaaatggatggtatgagatttcccagagggcctgggcacactctactggatcttggtgcaccagaagcaagaacaatctcagatgaccttgggttaacagagaaattccttttattccttctgtgactatccaagcctaggatcttatgatactcccagacaaccagatgaacagatgagcttcccccgcctactcaagcccccatttcccatatgtgtcttcatgatccttatgtattttttattttaaggtgtgaaaaactaataatcctttactgtattaactcttagagtgcatgcatttcaaaaatgcaagaggtgggtagagggagaaagaggaagcaagagacagagaaaacatctttatgccaaaatatacatctgtattggtggaacttccgatactgagaaagctatgaaggtatcttggaatagagtatcttccagagttcctgaagccataccatgtggctgcctaaaagtaaagacttgtgacaatttatctccccaaccttttttgttgggggagttctaatcatgtatcctcttcaaattttacaatagtgcctatactctctggtcatggaaattatgaccccaaacatagtgatcttgattttgggcctcgctcaatcccttataacagcatatcttggatcctcaatttcctcatctggaaaatgggaataatacaattaacctggaagctttgttgtcattgtgaggattaagatgagatagcatgaagatttaatgaagtggtacggagtggtaggaaacgtagcattcagagttagacctgagttcacatcctgaatccaccacttatcggctgtgtggcctgggttcagtcacttcacttcactgagcctcaatttgtcataaaggaaacaataataacacctacctcacagacatgagaattacttgaactatttttgtaaagcatgacaagtggcttgtaaatcagtgtttattgtattttagccagttaacaaataatgaatggcaatagtgaatgccaacaaatgttcctattaccattttagcttttgagttccctagttagagactgtgtaaatcattcctttagttcccctaaaagattagccaaaaggccctctggtgctttaaatttttattatcaagtcactctatgggtttgaaattttaccctctaacctgaaaacatctattaacccagtcttgagaatcagttaatcagattagcctgcagtcagttagaagaaagcagatctcgtgggatggaggcaggggagaaacacagattaatagaattgccaaacataatagaggatgtccatttataattttagcataagtatatcccatgcaatataaggaacatagttctactaaaaaagtatttgatgtttatctgacattcaaatttaattggtcatcctctatttttattttctaaatctggcaactttgacacagaatgaatccattttggttggactggggtttgtttgggcaagagactacaaaacacaggtcttataggtaacaaatgagcataattgcaagagttgctcagtgggggctctgaagaactaggacagacctggaatactaggacagacctggaatactaggacagacctggaatacacggacacaaatgtgctatataaataacacactaggttctgggcacggtggctcatgtttgtaatctcagcactttgagaggccaagacaggaggatcacttgagcccaggagttcaagacccacctgggcatgggctgggtgcggtggctcacgcctgtaatcccagcactttgggaggcccaggtgggcggattatgaggtcaggagattgagaccatcctggctaacacggtgaaatcccgtctatactaaacaaaatacaaaaaattaaccgggcgtggtggcgggtgcctgtagtcccagctattcgggaggctgaggcaggacaatggcgtgaacccgggaggcagagctttcagtgagccgagatcgccgccactgcactccagcctgggcaatagagagagactctgtctcaaaaaaaaaaaaaaaaacttagcccagcatggcagcgcacacctgtggttctagctacttaggaggctgagctgggagaatcacttgagcccaggaagtcagtgtttcaatgagccatgatcatgcccctgcacttcagcctgggtgacagagtgagaccctgtggaggaagggaaaggaaaggaaaggagagaagaggagaggagaggagaagagaataggggagagggagaaaaaagaagaaagagagagtgaaagaaaggaaagaaagaaagaaggaaggaaggaaggaaagaaagacaaagaaggaaggaaaaggaaaggaaaggaagaaagaaagagaaagaaaggaaggaaggaagaagaaaggaaggaaggaagaagagagagggagggaaaggaagaaagagaaagagggagggaaagaaggaaagaaggaaggagagaaggaaggaaggaagggaaaaagggagggagggaaggaaggaaggacacacaccaggaatgaagagattttgattgaaatccacgcttcaccatcaaatcactgtgtcaacttgggctagttttacctccgtctacccatttgaaattttacctccgtctacccttttgaaaaatgagtggatttgactagattaggcttgttcaggctggggtacccatatccctcaggatacaggtagattttccaggaggtacacaggtacagagggatctgaggacattactgattattaaactacatatttactttttcctgaagttgatttacttgacaatgagccaccctgaagttctccttttcttcttctctttgattaagtccttcctctttaaatttttttttaaaaaaagcatacttcttacatatctctcacatgtcttcaaagtgtaaaaacttctgaattccaaacaaaggaacaattcaagaatgcattttcctgaggatgctttccatggaagcaaaggaaagaaagtgtgagtaagaaataccaaggggtcagcaccggtttcattcaggtggcaaactcacactaagccactgtgccttttgctgtctaccctagaaataggattcaggagtgtgatagttgccacggggatgtagattaagacattgatttgaattgaaaaatgaagacattcttttgtgggagaaatgagtttgactgatttggctgatggaggactgactttgccaattagttaaatctgtgccatcaagttttttaaaaaatatatttaaagtatgcagtaagataaaagcattttatgaaagtaatcacaaaattttaaaaaaatatattttttataaaatgctttcaaactttcctatattttgaaaccatagtattcaaactttccagcacttacagagcatttcagattagataaggtcactaaatgaaagaataacatgtataactaatcacattattaatcgtttggtagatgctggtaaagcctttttagttaactttctggaaattaagaaaatcacttgtgatttgtgattagtattctaccagctaaaaaaacaaatccttttgcaagataccaggtgtccaattctatgactttataaaaattgaaggagtgtttaatcaagctattgattaataattaaattagatcattaaaataatttttaaatgcttaatattattttaatataatctcttgagatcaataacatattgctagccaggtgcagtggctcatgcctgtaatcccagcattttggaaggctgagtcaggtggatcacttgaggtcaggagttcaagaccagcttacccaacatggttaaaccctgtctctactaaaaaatacaaaaattagtcgggcatggtggtgcatgactgtaatcccagctactcgggaggctgaggcaggagaattgcttgaacttgggaggctgaggttgcagtgagccaggattgcaccactgcactccagcctgggcaacagagcgagactctgtctcaaaaacaaaaaacaaaaaataataaaataaaataaataacattgcaaaatgttctgcagtagaagtgcattcctaaataagtaaacccaaggcaatagttgacaaaaaggcaaataaataagtaactttagtttaaaatacagtcaccctttggtatctttgggggattggttccaggaactctcatggataccaaaatccttagatgctcatgtcgcttttataaaatggcatagtatttgcatataacctacattcattcttccaaatactttaaagtcacctctagattggtaggtatttaatacttaccattataaatgctatgcaagtagttgttatactgtattggtttttatttgtattatttttattgttgtgttattttttattgtttttttctaaatcttttctatctacagttgattggacctgcagatgcagaacgtgtggatatggagggccaactgtaaatgccaaaaaaaaatcaactttacaaaatagcgttatcaatgttaactattttcaaatacaagtagggactgaacatatatgcatggaatcatgttctcattcactgacataagtgtaagtgtgcctccaaacaagttactatgagggtaaatacataaatatattcaaaatacacacactcaaataataagccacagatcacccaccattttccaagaccaaaattttcacataaatataagggcaaatacagccaaataccagtgtaaattaacacgcttacatacacagatatgtgaaaattccagaattcaaagtgacatgcagacatgtaacacaggtgtttatgcataaacacacagctcggtcagaaacggcccatacagaaacagtggtctactgaaacacagaatactgctgtgaccttctcactagcgatgaaaactcaacagttcacgataaaactgacttttaaaatgctcatgctttaaataatagagacaaaggaaccagacttctaaagccactctccaccgccactgaatttcttataagttgataatgtgaaggcaatttcaaaaacgtaaaagcacagggaggttggtgactcccatctggaataaagatttgttaaatgaaatcactgaaattgaacagagaaacattctgtaaagttagctaaatcatttttaccttttttcttgttagagacagaacctcactctgtcactcaggctgcagtgcagccgggccatcctagctcactgcagcctcaaacttctggactcaagccatcctcctgcttcagcctcctgagtagctgggattacaggcatgcaccaccatgcatggctcaaattctttttactgtgaaggccctgctagagacttgctactgctctagttcacatcttgtagaggcaaaactaaaaaagctgttgctgtgcgcaggtgctgtgggagaacccaagaaaaatggtctgaactgaaaatctccatttccactacccaatttccaactggtatactgtccacagaaaatttggagttgttccctaatgggaagccaaaaacatcagagtacaatcatggatggctcaagggtatctttgtggtgtggaatagtgatgtttcatagcctaagcctgtcatagaggccttggagctttcaatactgatgattgtgcttcataagtgtctcagagaagtcactgttatttttttcttgtattcttctagcactctcctcatggaggttatctcccttttcacagaggtcaattcaacatcctggctctgtatttgctgagtgtatgtcttctccatctgtttcatatggccttcagctttcctgaaattgtattcttgatagagacacacctgatgtaatgtccagaaggccaagtacttgggagctaatgcccaacactatctccagtcacagtccagccaataccatagctttatattcctgaattcagtgcggacaatatctagccttccagaaagtgtactgttgcaggcaggacagatagcaggtgaaccacaaaagtcaccactgccatgctgatcacagaagatgtgagagcagatggtgacccatgcataaccagagagttcaatgtgacactctcgataattacaaaacaacatgtcttcacacaaagacataataggatagtgaggtctccagatgctgaaaatagtccatgaaagaaatatgcagtcatcatccattgtatatctagaatttacagcactgaagaggaccagactgaaacagtaagactcagatctggttttggccttgaaattttacttctctggtatcagatgaatccagcttctatgtaggtatcaagttgaactacaggatctatcagctacttagcatcatctctttatagtcacatcagcctttaactcttcctttattgagaatttccaaatccaatcctgcttgattttcagggggtctgcagatgacctttcacagggccacttctggcctggcacacagggtgctaaagacccaggtcttacctcttcagtggatttcatcttcaacctgccatccttctccctttaggagagggagggttaaaataatttttgattatgagtatcatgtgatatttggcaacttactagaagttcaaagaaccaaatgtcatacttaaaactttttgtccctgtacacttacatattaaaagatgaattcctatagatttgtatttatcaataaaattgtgtttctcaatttttacaatgtgtttatttacatgttcattattattatatcattgaaataacaaatggattttaaaaattaattcataagaaaaaatttgattcctggagtctcatggtcacagtaaataatttaaattttaatttatgcatatgtttttaattgcatagcagtaggaaaatagcatgaatggcattgcctaggttgtctttcaggatttttatggttttgggtttaaaatttaagtctttaatccatcttgagttaatttttgtaaattgtgcaaggaaggggtccagtttcagtcttctgcatatggatagccagttatcccatcaccatttattgaatagggagtcctttccccttcacaatagcaaagacatagaattgacctaaatgtccatcaatggtagactggataaagaaaatgtgatacatacacacaatggaatactatgcagccatgaaaaagaatgagatcatgtcctttgcagaaacatggtggagctggaagccatcatccttagcaaactaatgcaggaacagaaaaccaaataccgcatgttctcacttataagggggagctaaatgatgagaacacatggagacatagaagggaacaacagacactgaagcctatgggaggttggagggtaggaggaaggagaggatcaggaaaaataactaatgagtactaggcttaatacatgggtgtcaaaacaatctgtacaacaaacccccatggcacaagtttacctatataacaagtctgcacacgtacccatgaacttaaaagttaaattaaaaaaagaaaatgacatgaataaaagacttctgagcataagattatattccattatactgaaagtctggggggtaagaggaatgaaaatatgagttcaatgaaaaaaattaatgttttaaattttctaactgttaaagaattgctttccatatattttaaatagatgcttgtgggtatcaaattagtatatttctaccccagtgattatatatattttaaaaaattatgtagcagtttaaaaaattaatatttacatgttcacataatgcattgagattcatttatgttgtgtgttgtttgttcttttttattgctgaattttgtccattctatggctatacaacaggttcatcctttctcttgttcatggaaatttgggttatttccagtttggggcaattatgaatgaagcccatacaaacattcgtatagaggtatttttatgaacctaagtattcatttctcttaaataaataccaggaagtggtattgccgggttatgtgaccagtgtatgtttgtaagaaactgccaaactcttttccaaagtcacagtaccattttgcattttcattagtaatgcatgcactactctcctaagagttccacttgctccacacacctgttagcgtttggtattgtaaatgcttttattttagtcgttctaatagatgtgcagtggtaagactgcatgctatttggagaaatgaaagtaattagcctacatttgtggaactctaagaatctaagccacttcaaatgttggtgggaagatttttcgtattttccaacttctcctaggacagctttcaaatccagttggttccttggtttctgagcctgcttgggtaggagtttctccagagccccatcattgaacctactttaaaaaaaagtcttcataatttccatactttattgtccttaaatcgttaattttaagtttaatattattccttttttattttccatgtctgattctctacccacaatctttttgttttcattagattttatttgcctttctttttccaacttgaaatggatcattggtcaatttcattcatttctcatttcctataatttacttccatttttatttttaatttgagacatacctctttcatcactgctttcattgcactttaagaaatttattttaattgactaataataattatttatatttatgtgctacaatttaatgttttgatgtatgtacacattgcggaatggttatatcagggtaattaacacatccatcacctcagatacttatcattttttaaattagaacatttctgtagcaattctgaaatgtacaatacattgttaactatggtcaccatgctatgcaatagatctcagagacttctttcctttgtctaactgaaactttatccccttaaccaacatcttccctttccccatacactccaccctgacccctggcaacggcctctgataaccaccatctactctctacttctacaagttcaactttttagattccacatgtaagtgagacatgcaatatttgtctttctctgcctggcttgtttcacttagcataatgttcttcatcttcatccatgttattgcaaatgacagaatttccttctttttaaaggctgaatagtagttcattgtgtatatataccacttttttacccatttatccattgctgaacacttaggttgattccatatcttggctattgtgagtaatgctgcaatgaacatagcagtgccaatatctcttcaacatactgatttcatttcttttggatatatacccaaatatgggattgctggattatgcagtaattctacttttagtatttttgaggaagctccacactattcttcataatggctgtactaatttatactcccaccaacagtgttcaagaattcccttttcagccaggtgcagtggctcacacctgtaatcccagcactttgggaggccgaggcgggcggatctcatcaggagattgagaccatcctggctaacgcagtgaaaccccgtctctactaaaaatacaaaaaagtagccgggcgtggtggcgggtgcctgtagtcccagctactcgggaggctgaggcaggagaatggcgtgaacccaggaggtggagcttgcagtgagccgagatcgtgccactgcactccagcctgggcgacagagtgagaatccatctcaaaaaaaaaaaaaaaaaaaaagaattcccttttctccacatcctcatcaacacttgttatgtttaatctttttgataacagacattctaacaggcatgaggtgatacctcattgtgattttaatttgcatttccctgttgattaatgatgttgagcattttctcataaacctattggctatttgaatgccttatttatttatttactaacttacttatttatttattttcaagacagtcatgctctgtcacccaggctggagtgcagtggtgtgatcttgtcacactgcaaccttcgcctcccaagttcaagcaattctcgtgcctcagcctcccgagtagctggaactacaggcatgcgccatcatgcccagctaatttttgtggttttagtagagacagggtttcaccatgttggccaggctggtcttgaactcctggcctcaagtgatcttcctgccttggcctcccaaagtgttgggattacaggcgtgagccaccgcgcccagcctttgtatgccttcttttaagaaatgtctattcaagtcctttgcccatttttaaattgagttgttttcttactatcaagtaaatggagtgccgtatatattttgaatattaacccctcatcatagtatggtttgcaaatattttctctcactctatgagttgtctcttgactctgttgattattttctttgctatgcaaacgctttgtaatttaatgtaatctcacttgtctagttttacttctgtttcttgtgattttagggtcatatccaagaaatcattgcccacacccatgtaatggagctttccccctatgttttcttctcagagttttatagtttcagccattgcagttagatcttttgtccattttgagttgatttttttaaatatatgcatattttgtatttcaatagcttttggggcacaaatggtttttggttacatgaatagattgtatagtggtgaagtctgagattttagtgcaccagtccccaagtagtgtacattgtacccaatatgtagtttgttttatccctctctgccctcctacactccgcccttctgagtctccaaagtccatcataccacctgtatacctttgcatacccataggttaactcaacttataagcgaaaacatatggtatttggttttccattcctgagtttcttaacttagaataatggcctccagctccatccaagttgctgcaaaagacattatttcattattttttatggctgagtggtgtatatataccatgttttctttatccattgagttgatttttttgcatggtgtgcaataagggttcaattttatttttctacatgtggatttccagttttcccaagaccatttatcagagacagtctccattgtgtgttcttggcacctttatcaaaaatcagttaaccataaatgtatagatttatttctgggctttctattctgttccattggtcaatgtatctgtttctatgacagtaccatgctgttttgattgctacagctttgtagtatatttaaaatcaggtagtgtgatgcctccagctgtgttctttttgctcaaggttgcttgagattcttggggtcttttgtgactccatacaaattttaggattttttaaatttctataagaaatgcaactggaattttggtagggattctgaagttatacactaacaagtggaataacctggaagaaattgagaaattcctagaagcatataatctaccaaaactgaatcatgaagaaacagaaaaactaaatagatcaacaagtaaggagatttaattggtaattaaaagtctcttatcgaagaaaaatctaggatctgatggcttcatgacttcattctaccaaacatttaaagaactaatgctaatcctcctcaaatgcttccaaaaaattgaagtggagggaattctttcaaactcattttatgaggccagcattattctaataccaaagccatgcaaagacactacaagaaaagaaaattacaggccaatatccatgatgtacacagaggcaaaaattctcaaaaaaaaaaaaagatcagcaaattgtattcaacagtacattaaaaggatcattcacagccaagcatggtgggtcacacctgtaatcccagcaatttgggaggccaaggagggcagatcacttaaggctaggcgttcgagaccagcctggccaacagggcaaaaccctgtctctactaaaaatacaaaaaaaattagccaggcatggtgacacatccccataatcccagctacttgagaggctgaggcacaagaattacttgaacctgggtggcagaggttgcagtgaaccaagatcgtgccgctgcactctagcctgagtgacaaagcgagactctgtctcaaaataaaagaaaaaaatagtatcatttaccatgatcaagtgggatttatcccttggatgcaaggatggttcaacatattcaaagcaatcaatgtggtgaaccatcttaacagaattagtgatataaataatatgatcatctcagtagatgcggaaaatgcatttgacaaaattcaacatttttatgataaaaaatctcaacaaattaggtatagaaggaatgtacatcaacacaataaaggccagatatgacaagcccacagctcttatacccaacagtgaaaagttgagttttttctctgagatcaggaacaagacgagaatgccaatttctaccacttttaatcgacatagtactgaaagtcctggccagagcaattagcaagaaaaataaataaaattcatccaaataggaaagaaagcgacgaaattgcctctgtttacttatgacatgatcctatatatagaaaaccctaaagactccacaccaaaaaaactgttagaactgataaagcaatttattaaactttcaggatacaaaatcaacatacaaaaatcagcggcatttctatacactaacaacaaactacctgaaaaacaaattaaaacaatcccatttacaatagcataaaaaatacttaggagtaaatttaacaaaggatatgaaagatctgtacactgaaaactacaaaatattagtgaaagaaattggagaagacataaataaatgaaaagatatttcatattcatatttcatatggattagaagaattaatattgttaaaatgcccataccacccagaacctatctttttgcccagcttccccaaatagcagaggttgcactttgcaggaaactgagcagcattttgcaattgaaaggtctacagatggccaggagctgggggagcagtgtgaattcccaggttacaatatttaggaactacaggtaagggcccactatgactctattacatctcgctaccctctagttctccccagttaggcgcttgcccagccccaggccctgtttccatggctgagagctcctagctcacacccctcctcatccccatagcatagcatgttctgttgcaaggctactcaaccagatatgtgcctctagcctcagttactaggaagcagaccttgaggaggacaactagctccataagtcactttaatacaccttgccctaagttcaggctgagtaagtaagtaaattagtaagcctcgtccaaagatattttcttctaaatgctgcctagtcagatatctacattctgataccggagaaggattgtctctaaatattgagtacagaacactccgtacatatctccatattgtgctgctaaaatattttaaatcttttacattttttgtccttttgatctgtcaatgattgagaaaggtgtgtcaagggccctcaatacagccatagatttctcaatttatgcctataatgatgtcaatgtttgctttaatatatcctgatttgattggtttaggtaaatacaaatgtattcctggtgaactgagtcttttaccattatctagcaagccatcctttatccttaaagataaaacttcgtcttagagttttctttttttttttcagacagtctctcactgtctttctcccagggcggagcgcagtggcacgatcttggctcactccaacctccctctcctgggttcaaatgattcttgtgcctcggcctcccaaggagctgggattataggcatgtgccaccacacctgtaatttttgtaattttagtagagacggggtctttccatgttgcctaggctggtcttgaactcctggcctcaagcaatctgcctgcctcggcctcccaaagtgttgggattacaggcgtgagccaatgtgcccagccttagagttttctattgcctaatattaatcaaactatactctctcttctttgtttgcatttgcctagtcttttttccattcttttgcgttcaaccattctacttatgttttaagtttatccttcaaatcgtgtaaatctacattgtaaaaatccagtccagaaattattacctattaattgacatttatgggcactaatgacatatttggattcatttctacaattttattacaagttatctactctcagtcctcattattcagattctgtacttgccaatttgcctacttgctgaaatttatttattacccaaaaatcaatactcatgatgcttttgtggtcattcagggatatgtgcagaatggcaaaaaatttgagtcccccaacgtacacattcccagctgaagtcaaacaaggcaacgctctgcttgtttaagctcttctactactataaacaagcttcctttttgcagtctacttagtgtcacatttttcacatttttgtgctttttgttggtgagtttgctgtttaaaatggctgccaagaattactaaagtgctgtcaagtgtcctaagagcaagaggcctgcaatgtgccttacaaagaaattacttgtgtcagataagcttggttcaggcatgagttacagggctttcagccacaattcaatgttaatgaaacaataatatatattacataaggtgtctttttttttttttgagatggagtctcactctgtcgccaggctagagtacagtagtgcgatctcggctcgctgcaacctccgccttctgggttcaagtgattctcctgcctcagactcccgagtagctgggattacaggcacccaccaccacgtcctgctaattttttgtatttttagtagagatgaggtttcactgtgttggccaggatggtctcaatctcctgacctagtgatccgcctgcctcagcctcccaaagtgctgggattacaggcatgagccaccgcgcctggcctatatacatgtttaaaaaataaagacagggccagcacggtggctcatgcctgtaatcccagcactttgggaggctgaggcaggcagatcacctgtggtcaggagttcaagactagcctggccaacacggtgaaaccctgtctctactaaaaatacaaaaattagcctggagtggtggtgcacacctgtagtcccagctactcaggaggctaaggcaggaggatcccttgaacccagaaggtggaggttgcagagagccgagatcacaccactatgctccagcctgggggacagagagagattccctctcaaacaaaacaaaaaaaataaaaataaaaataaataaataaataaagtatgtagagttttatttaataattaaccacacagattaaaaaatagaaagtagccagcttcccagaagtcttctgtgtgcaccttctaattaccatctctgtcatgtgtcttcagacagaagcacatataaaaacaaggttatgtattgatcaaatgatgaaaatgtgtggtcagaggcttgcattttccctaggagcaatggctcagtatttgctaatccggtgttcacagtgactttacagaacataactacccccaagtaatgggaatcaactgtatttttattactttggtgtacaaagaactttgagctctccatggcttgccacaacaaaagacttcctaggcaaattgtctactgctttgttccaagtgggggctctacttgaggctgtgggaccaagacaaaagaagcagcctctatgtggattaggccccttctcctggcagagagaaagcacaaaggagctggcagaaactcacagtgcaaaactcactatgcatatgctacatctgctcatactccaataggcaaagcacagctgacagcaaacccaaagtcaatgagacagaaatgtgtcttccttccacgggccgttctaaaattgcaaggtaatggacaggagtgtcctcttaaaggaaagatggaatgaatagttgtgaataataatataacccatcactactactcctgttttaattttttgaaaatgtttagatacatattatatgcttgtttaatttaaaatatcaaactttaccttgctcaggctctgcccctccacactgggccactcaaagatgcccaacttaccctacttgggctccaacagccatatcaggttgcattcgagaccagcctggccaacatggtgaaaccccgtctctactaaaaatgcaaaacttagccgagcgtggtggcgcacacctgtagtcccagctactagggaggctaaggcaggagaatcgctggatgcattgatgccctcttcaccctgcttaggctctgattcctgacacaagacagctctgttctgtggaacccctcctcactatgcttggcccaactccccacagccgaccactctaacttctatgtatcctcctcatctccttgggctcagaccctccatgtctggctacccacccccatagacaccctcctcaccctccttcagttcggacagtccacatcaggcctcttccctatggagacagcttcctcactttgctccagctctaaggctcctccctcatctgctcccctgcctggacactctgctcaccccactcaggctctcattctatgccagtctgcccctctagccccagggggatgcctttctcaacatgggcaggctggtctccatgctatgctgcttcttgcctcttcactgggcattctcatctacccctggctccagcacaccaggccagcagccctcctacagagacaccctccttgacctgttccagctctgatgcccacacggagccagccgtggctcccttccccttggggcaaacgcctaccttgctaaatgtgcctatctaatggctttaggactgactagttcagttagtaaagaaaaggagacaaaacaaggaagagctacttttcctttttgtaaaaatatgtattgtgaaaaacaccacaaaaataaaaatatgcatgaaacattaatgttcagtctaacgaactattacgaagtgaccactcattaaactatcactgaaatcaagtaaaaaatttccaacactttctgctcctttttcattcttttccagtcacaaccccttcctatgctctcaaaggcagctaatggtagtgactttctttttcatattttcaagatcatatgtattcccctaaatatgtttttgtttttgtctgcttctgttctatatcaatggagtcacttggaatgtattcttttgtgcctggctttttgtgttcaacattatattaatgaattccatccacattgttttgtgtagctgtattttgtcaattttcattgccatgccatctattgtatgactacacacatctctactgagttgtttatagtttgcagctgttaagaataaagctgctgtgtgtatacatagcatgtatgtaataacgttctgcacgtgtatcccagaacttaaagtataataaaaaactaggattttctaaataaaaatgttatttatatcaacatgtaataagtttattacgttaaatgaattaataaatgtttttaaatgtcaaaaaaattttaaacaatttactcatgtaaaaaaaagaataaagctgctatgaacactctgtgtgcatttgctggagcacgtgggcaggtgttcttgtaggttatacattcagcatagggaatgatgggttacagggtatgcatatcttcagcttctcaagctgataccaaattatttcccaaagagtttgtaccaattcacagccttgccattggtagttgagagttcctattgttccataaccatgctgtatgtagaactgtcacaatcttttcatttttaccatcctgctacgagtatggaaatacatcactgtggacttaatttaaatttcttgactactaatgaggttgagcacctttttagatctttattaaccacttggctatcctctctttgattttcttttcaaatgttttgctcattgttctctggggttttctgactttttcttgctgatttctactggagtcatgtctttcctcagttatatgtattatgaacatcttccaggatcaagggtaatcttctaaaacccttattggcttgtcttttaccttttgaatgaaagtttttatcacgtgcccttcctaccccaaagacagaatcaggaatcctttttctatgttcctttcctacaatacaataactcgctacaatacaatacagtaactccaatatctgaagtctttgtggacctctgctgttggttgtttttcttgatttttttcatcttgttttcttaagatctgtgtgattttttttattgtgagagtacatatttaatggaagtttatgtatgtaacaatactttgtggaatttcttggattcctgtgtttaaaggagaattcttccgaatcaacttgtcctcaatttttccctaacaactcatgcaattttgaattaaattcatagctttagatttatcagaccatgcacatgtgccaattttcctactctgctcttatgaaaggaaacaaggttgcagttacaaattctcagaatagtctttttttttttttttgagatggagtctcgctctgttccccaggctggagtgcagtggcactatctcaactcactgcaacctccttctcccgggttcaagtgattctcctgcctcagcctcctgaatagctgggattacagacacgcaccaccacgcctggctaatttttttgtatttttagtagagatggggtttcaccatgttggtcaggccggtctcgaactcctggcctcgtgatccacccacctctgcctcccaaagtgctgggattacaggcatgacccactgcacccagcccagagtagtcttttttcctgttttgttcagagccaaagccaagacaggcaagttccttcaccacagttgtgcatgtgtgtgtttctgtttcatccatttatttctgtttcatccatttattaaggtgtcagcatttggtgatccttgtgagtgagatttctgatctgacttttcacattgcttagggcttagctcttttttcttgcccttgccaggggcccactaaaattcaaactgcagattaccaggcattggcagatactcccagggaagcctctaactaaagcacttccttatctctctggagtcagaccttcacatcatttttggcttttaagaattcctctttcttgccaactgactcattgatttaaagagtcatgcattttaagtattttagacaatattttgggggggtgatttactgggaatagtttctaagagtcctagttatgaatttttaattataaaattacacacatcaaatacccaataagtgaaacagtacaaagaacatataaagaaaaggtaataatttctaagccacatctctccatttctaactccctcaatattaatagccttggttgataattaataaccaattttaatgggctgttttgtacccttaccatctttctctgcgtccaaatatatacaatcatgtatgtatatgggttctgatacttggaaaacaaaatgaaattatgatgtatacattcactactactgtacttgcttcttttcacttaactctacctcatgtaagtccatccatataaaaatgtagattgaaaattgccttaaatagatgcccacactctgttcaacatctctgctcttaaattactgctagtcttatggaaattgcagagttgcttaatttgcatatccccaactactactgatattaatcttctttgctttttaaagttttttagttaaaaaatttataattgacaaataattttatatatattagtgtgatattttcatatacatatacttatattgtgaaatgattaaatcaagctaattaacatctccatcacctcacatacctatctttttttgtgacaaaaacatttaaaacctactctcagcaatcttcaagtgcttttaattatcggccatttgaattttctctttcgtgaactgcttgtgcaaatctttttctattgagatgtttgtcattttctcatcaatgtgtttattagaaaaaataacttctggctagtcatatgtattgcaaatatttccctcagcctgtagtttgatttttatttattatgtgttttgttctataaaaatttaaagagttatgtaatcaataatgcttattaatttttctttatgtcttacatttcttgcttaagaagttctctccaatgctaacatttgagatcattctcctaatttttctcctaagttatttatttaaaaaaatctaacacataggacagagatttctacttttctgggaaaatgaactagatggacttttctctattcctctgatgaaattcagctaaaaatcctggacattaaatacacaagaagattctgaaaggtaataagggcaaggcagacgagccagaaaccttaagacctgaagaacagcacggcagcgggattactgagttttctttttgcctcacatattcaagactgggtgctagagaagctggaaacccagaaacacagaaacagagacaataaaagcctcaaaaacaaaacaaaatgcaacacaacaaaaaaccagcctgctcactcttgccaaaggaccaggaaagaggcagcctaataagacggaaaacattgaacaataaccactagtatagccaaacacgtagttccacccccatcagagctgagagaggagcctcaacttctgcctttaccaggctgaaaggaggagccccagtctccctgcaaagagcccagactttggtcaccaccagacagtaatgatgctgccttcccccaatgcgtgtgctgtcagtggaggccgtgtggggagcagaaggatacttctatccctctctgctagagaggtatcagtggaacttattgaggagctagacctcccaccccagcccagaagtaatgagaggaaaccactcccccaactcagttgtcaacaaagactcaatggggaacctgatttctacccccatccggcagtaatgaggtggtgctccactcttccctgctggaagggtgacagaagaaatcaaggtttaaatgagatctagaatctcataaaataaaacccaaagtttccaactttcaatacaaaattatttgttatatcaaaaaccagaaaaatctcaaacaaaatgacagaagattattaataggtgccaacactgggatgacaacgatgttataattatatgataaaaattgtaaagaggtcatcataaagaagcttaaaggagcaattataaacaaacaaagatattaaaacagaacgtctcagcaaagaaatagaagatataaagaagaaacaaatggacattttagaaaattttaaaagcgtataactgaaatacaaactcaatggatgagcttaacagccaaatagagagtatagaggaataatctgtgaatttgaagatagaactttcactcacatccgtgtgaagagaccaccaaacaggctttgtgtgagcaataaagctttttaatcacctggatgcaggcgggctgagtccgaaaagagagtcagcgaagggagataagggtggggccattttataagatttgggtaggtaaaggaaaactacagtcaaagaggggttgttctctggcgggcaggagtgggggtcacaatttgctcagtaggggagttttgagccaggatgagccaggagaaggaatttcacaagataatgtcatcagttaaggcaggaacaggccattttcacttcttttgtggtagaatgtcatcagttgaggcaggaacaggccatctggatgtgtacgtgcaggtcacaggggatatgatggcttagcttgggctcagaggcctgacattcctgtcttcttatgttaataagaaaaataaaacaaaatagtggtaaagtgttgggaaggcgaaaattttttggggtggtatggagagataatgggcgatgtttctcagggctgcttcgagcggcattaggggcggcgtgggagcctagagtaggagagattaagctgaaggaagattttgcggtaaggggtgatattgtggggttgttagaagaaacatttagaattattggtgatggcctggatacagttttgtatgaattgaaaaactaaacggaataagagaaggagaaaaacaggtattaaaggtctaagaattggaaggacccaggccatctaattagagaatctcctaataaggagattcagcatagtcctgccagcaaagattatttatttactttaagagttaagagtggcagtttggagatagcactaggagatatcagctgtgatggcttggagaaacagtgtaagccggcagtgtaaacatattgtctagtcctttttaagttagtggctgagcttggtgaggtgtgtttttaaaagacctttagtccgttctacttttcctgaagactgaggactgtaagggatataaaggtttcactgaataccaagagcctgaaaaactgcttggctgatttgactaataaaggctggtccgttatcagactgtatagaggtgggaagactaaaccaaggaattatgtctgacagaagggaagaaatggctgcggtggccttctcagaccctgtaggcaaggcctctacttatctagtgaaaatgtctacttagactaagaggtatttttgttttctgactcagggaatgttgagtaaagccaatttgccagtcctgggcaggggcaaatctctgagcttgatgtgtagggaagggaggaggcctgaataatccctgaggagtagtagaatagcagatagaacactgagaagttatttccttgaggatagatttccacgatggaaaggaaatgagaggttctaagaggcgggctagtggcttgtactatagcatagcctgcctttgctggtgtgtggtgattaggcctggtggaactaccatcaataaaccaaatgtgatcagggtgaggaacaggaaagaaggaaatatggggaaatggggtgaatgtcaggtggatcagagagatacagtcatgggggtcaggtgtggtatcaggaataatgtgggaggccggattgaagtccgggccaggaacaatggtaattgtgggagacttaacaaagagtgagtacagctgaaggagccagggagcagaaagtatatgtgtcaggtgtgagaaagaaaatagattctagaagttatgagaagtgtagagagtgagttgagcatagtttgtgattttaagggcctctaaaagtattagggcggcagcagctgctgcacggagacatgatggccagcctaaaacagtaaggtcaagttgtttggacaaaaagctacagggcgtggtcctggttcttgtgtaagaattctaactgcacagccctgcacttaggctttgggtaatgaaaagggttgggatgagtcagggagagctagggtgtgggcagtcactaaagctgtcttcaaggaacggaaagaggagtggggaaggatttaggatctatagggtcagctagttttccttttgtgagtttatgtaatggttttgttaggatggcaaaaccaggtatctaaagtcgaaagtatctaaccatgcctaggaaggaaaggagttgttttgtaggtgttggggtttgagagatcagctgaacacgatcggcagggagagcacgtgtgtttttatgagaattacactgagataggtaacagatgaggaagaaatttgggcttgactgaagtaatgggggctatctgtgaaggcttgcggcagtgcagcccaggtaatttgctgagcctggtgggtgtcagggtcagttcaagtgaacgcaaagagaggctgggatgaagggtgcaaaggaatagtaaagaaagcatgattgagatccagaacagaataacgggttgtggagggaggtattgaggataggaaagtatatgggtttggcatcatggggtggataggcaaaacaatttggttgataaggcgcagatcctgaactaatctgtaagacttgttcaggttttggacaggtaaaatggaattgtaaggagagtttataggttttagaagcctatgctgtagcaggcgagtgataacaggctttaatccttttaaagcatgctgtgggatgggatattggcattgagcagggtaagggtgattaggttttaatgggatggtaatgggcatgtgatcggttgccagggaaggagtagagatgtcctatacttgtgggttaagatggggggatatgagaggaagaggcaaaggaggctttgggttggggagaagggtggcaatgagatgtggctgtagtccaggaatagtcagggaagcagataatttggttaaaatatctcggcctaataagggaactgggcacttgggggtaactaaaaaagagtgcttaaaaaaatattgtctaagttggcaccagagttggggagttttaagaggtttagaagcctggctgtcaatacccacagcagttatggaggcaagggaaacaggcccttgaaaagaaggtaatgtggagtgggtagcctccatattgattaagaaggggacggacttaccttccactgtgagatttacctaaagctcagcgtccatgatggtctatggggattccgaggcgatcgggcagcatcagtcttcagtcgctaagccgagaagatctgggaaggagtcagagagccttgggccagagttccaggggctctgggagtggctgccaggtgagttgaacagtctgattttcagtggggtcccgcacagacgggacacagcttaggaggaatcctgggctacggcattccttggcctggtggccagatttctggcacttgtagcaagctcctgggggatgcaggcctggaggaatgcctggccactgcggtttgggcatttggaagttcttgtatgctggagatgtggctggggtttctctcagagtggaggcaaggaattgcaactcagaaatatgttgttacttggctgcctctactctattattgtacaccttgaaggtgaggttaattaagtcctgtggtggagtttgagggccggaatttaatttttggagttttatttaatgtcgggagcagattgggtaataaaatgtatattaagaataagacggccttttgaccttttagggtctaggctgtaaagcatctcagggttgctgccaaatgagccatgaactgggctggatttttatatttgatgaaaaagagcctaaacgctatctgatgtgggataaagaaaaaggagcattaaccttgactatggctttagctccagccacctttttaagagtaaattgctgggcaggagatcatgtatggttcttccaagattgccaaggtatcctccaactctcactggtggtttcggggctcaatgcaggaaatcatattgctgattttctagtccaacttgctgttctctagaagagagaaggggtaggaattcagtagccacacaatctggtaaaaacatatccatttaagcataactaatcctcccaaaccctgtgggcagggatgtttttctgtggctcaagagatgcccacacaaggattctcccaggatgttttaagttcaatgagcagagacataaatgccagatctcctagggtttggctaaatcaagcagacctacaagaggagtgtggggagtctggggataggatgaagaagcagaggccccagattggattggctgggactgaggaggcatagcatcctgctgtctgtctccccacaacctaagagtccataatttttgagaactggatgaagagggaaaggtgcttcttagatcttaccatcttcaagaagcatgcagacatttccgcagaagacattactgcattaatgatgaatttgagattctgagtgtaacttgcagaaggttctgcctatcagtgagaatctgtgtggcatttcagttttggctttgataaaattgaggagtatatgagcagtaacacccaggagggtgtttctcactattatcagcccctccaatgctccaggacccactccattgatttcccttcttcctctccccagcgcaaggatctgggtggttttctttgttgttgttgttgttgttgttgttggcttctggagtaaagttccagtccccaatcatcctcccttcaacaactcagctgctatgacgtcacctctatggaatttaaactcacagaacctgagttcaattcttagagcaactagttctgaggcactttctagtcccccattttacaggatgggaagaattgaatctcaaagtagggaaaaaactttccttccaccttcacctctccacttctggctgaaatggccctgaaagactcagctcttccctacccatattcatcatgcaatatctactcaccaccttaccttcaattcttctgaagatttcacttttgttatcccagtggctccaaacttctctccatcaagcatgcattttatttctcctttttatgcccaatgttttgaaatactcaatcctaataaaagggcatgtttcaagaaataattagtagtcctttcccaatttggtgttcctctttggaactcttaactgaggacataaactcctaagtttatgtcctcctcagtttatgagctaggaaccctccatgcaggctctgaacctggtggagctcttccttggtaagtgtcctcctagacaaaaactcagtgaggccaccactgtcccccaaacacagataaaaacattgcattacttgcagcatcaggagatcctcaagcctgagaattaaacatttagttttcttcagggattctgacttttttaaaaagctgtgtttttatgttgccagcccctggcacctctctgcaataggactgtaaaagtctttttgttttccacccactcttcattttgaagcccagccagaatacatacagtaatctgaaaattccattacaggaaaaaactctttctttccattctcctgacactggcagaaccacaatgccaaggagtatcagcaatttggacatctgagtaaagctggcaggagactcaggattttaccaggctctgctgggggtagaaaagggttccagatgaggagtttggagaatgtgtgactcgactctcactaccttatctggttctgcctcctccactcctctggccatcactccctgggtgggcactggcttctcacaaagtacttcctttttcttatagctcatacacctctcattgcagaaataaattctccacacttttttttaatttttgaaatttgaaaaatatacatttgaaaaacagaaaagaacaaagagaagtaatgagatagtagttattccttacctagagataataactgttgataatttactacgtgtccagatttttttactgtatcaatacatatatcatctgaatttatatctaatctttacctctactcatatataatctatatatatgtgtttttcatcaaatatgcctcagattatacatgctgtttctaacttttttcatttaatcaaatattgcagaaataatttattttctataaaatgattttgggagcaagtactgttttctttatgtatactgcacacaagtgcataaatcattagtggatttttactacatacatacccatctagacaccacccagattaagaaagagatcatcagataatattcctcttctctcatccaagaaaaggtcatcgctattttaaattttatcaccatcaattagacttgcctattttaaactttatataaatggaataatacagtgtgtattattttgtgtctggcttcttttgctcaacatcatgtttggaaagtccgtctatattgtggatgttgttcattcaatttcattgttatataatattccattgaatgaatataatatttaatccattccacttttgatagatatttggattgtatccaagttagagtcttatgaatgtttctatgaccacttttatatatggcactgggcatacatatagatattcctgttgggtatatacctagaagtggaatttttgggtcataggatatgcatatgttcagttttaggagatctgccaaacagttttccaaattggttatatcagtatacattctcatcagcagaatatgagacttccagtgatgctgatttttctgcaacatttaggtttcttaaaaactttttttttttttttagatggagtcttgctttgttgcccaggctggagtgcagtggcgtgatcttggctcactgcaagctccacctcccgggttcacgccattctcctgcctcagcctcccaagtagctgggactacaggcacccaccaccacacctggctaattttttgtatttttagtagagacagggtttcaccgtgttagccaggatggtctcgatctcctgacctcgtggtgcacccgcctcggcctcccaaagtgctgggattacaggcatgagccaccgcgccctgccttaaaaaatctttttcattttagcccttctgttatgtgtgtgttttgtgatttgaatttgcattttcctgataactaatcaagttgggcacctttttattaccttttattgaacatttggatattgtcttttataaattggctggttgaatctttttgctcatttttcaattttatgcccttttcttatttattacacattcttatataccctggatatgagtcccttgataaatatgtatattacaaatatcttctctcactctgtaatttgctttttcactctcttttattttttaataaacagaaattattattttaatgtagttcaatttatccatcttttcccctatggttagtatttttgtttcccatttaagaaggatttcctgccccaaagttatgaagatattcttctgtgttatcttctagcatcttacgttatatttttgacatttaaatctatagtgtaacttacagatttaaatatatactttaatgtatgtttttacttcattcacttttttctttttattattttcttccttctaacttccactgtgatttttatttctttttttttgttctgccaatttttgcttaatatatttgatgccgtattactagataaatcacatttcaaactactatttgtttgtggtggattgacaatttcatcatcatgaaatgtccagttttatctttaataatgcttcttgctttaaaggctactttgtctgatattaacatattcatactcacagtcttttgttagcatttgcatagtatacttgcttacatccttcaactttcaaaccttaaggtagatctttcaaaccttatatttaagatagatgtcttaagctgcattcgttttgtttattcactctgacagtctttgtcttttatttgtaatattaggtctgtttgtatttaatgcaataaatgatatatttgggtttgtatcaaccaattactatgcaatttctattgtccaacagctgttctatttttctttttatccttcttgcactttggattaatcaagcttttttcctataatttcattaacactgcccccctcattgacttgttagttagttattctcttacattacaaaattcatcttggacttattagggtataaaataaaatttgcatcccaggcaatgcaaaaattttcaaacattttacctccaagtactcacatcttttgtgtttttttttaatgtaccataattctacataaatctaaattccatggaaattactattgactgtataatcaatagtaacttaaataaagatatctcggttttggccctgttgatgttttgggccatataattatttgttgtaaaaggctgttccacgcattacggatgtttagcagcatccttggtctctatccactagatgtcagtagcaccaacccccaagttgtgacaattaaaaatgtcttcaaacattgccaaatgtcccctagtgggcacaattgtcctgacttgggaaccacagattagatttacccacatattttccctttctgtttttcttcattccttcttccattttcttgttcatcatttgcctgcataaatctctgatatttcatttcttttcttttctttttttttttttttgagatagagtctcactcacccaggctggagagcagtggcgtgatcctggctcactgcaacctccatctcctgggttcaagcaattctcctgcctcatcctcccatgtagctgggactacaagcatgtgccaccacacctagctaatttttgtatttttagtagagacgaggtttcaccatgttggccaggctggtcttgaactcctgacctcaagtgatacaccctccttggcctcccaaagtgctgggattgcaggtgtgagccactgtgcctggcctgatatttctttccatgtgaaagtgctggtgatgaattttctcagtctttctctgaaaataccttagttctggtcttatttttgaaagatttttttcttaggtatagaattctaggttagcattattttccatcagcaagttgaagatatcattccattgtcttctccctttcattatttccattgggaagacagctatcagtattactgttattcttaaaaaggcatgtctttttttctgtcagattttaagatttttctctttgctttggcttcaagtaaaattaaaacagatatacctacatatggttttactgtgatgtgcctaggtgttcactggtctcaggcggcttctttaatatgtagcttgatgtcttatatcagtttaccaaattctcagccattttccctttctttgctctattctgtctttcttctccttctgcatctccaattacacatatgttagttctctcactatatgctatatgtcacattcattcttttctatactttctagtattattttcctctccctgttttagtctggatatgttctgctaacttatctttcagtttgatcaacctctcttcagctgggtccaggcttctctaaatagcatacactgattattttatttttatcattgtatttttatttttgggattttgattattttcttttttattataatgagtctcttgaatacagcacacaggtggattttgactctatctggcttgccactctgtgtccttaaattgggggcatttaacccatttacatttaaagttaatattgttatgtgtgaattgtatcctgatatcatgatgcctgttggttattttgcagacctgtttatgcatttgcttcatagtgtcactcatctgtgtgtttcagtgtgttttttgtagcggctggtattggtttttccttccatgtttagtgcttccttcagaagctcttggaaggcagacctggtggtgacaaattccctcagcatttgctgtctgaaaaagattttatttctccttcacttaggaagctcagctgggccaaatattaaattctaggttggaaattatttgctttaagggtgtttaaaattggcccccgatctcttctggcttgtagggtttctgctgagatgtctgctgttagtctgatgggcttccctttacaggtaacctggtccttctctctggctgcccttaacattttttttttcattttgaccttgtagaatctgatgattatgtgtcagggctgatcttctcatggagtattttactggggttctctggatttcctgagtttgaatgttggcctgtcttgctaggttgggtgagttttcctggatgatacactgaagtgtattttcctacttggtttcattctcccagtctctttcaggtaccccatcatttctaggttcagtcttttaacatagtcccatagttcttggaggttttgttcattccttttcattctttttttctctaatcttgtctgcctgccttatttcagcaagatagtcttcaagctctgatatcctttcttccacttggtctattcagctattgatacttgtgtttgcattatgaagttctcatgttgtgtttttcagctccatcagatcatttatgttcctctctaaagtggtgattctgattaacagcacctgtgatgttttatcatagttcttagcttctttgctgtgagttagaacataatcctttagcttggtgaagttctttattacccatcttcctaagcctacttctgtcaattcatccatctcagtctcagcccatttctgtgcccttgctagagaggtgttgcaactctctgaaggagaagaggcactctggctttttgagttttcagcattttttctcatcttcatgggtttatctacctttgatctttgaggctgctgacatttgaatggagttttttatggtgcctttttcattgatgctgttgcattctgtttgcttttattttagcagtcaggctcctcttctgcagggctgctgcagtttgcttgtggtccactccagttcctatttgcctgggtccctcccatccctggagttatcaccagtggaggctgcagaccagcaaagatgccaagctgctccttcctctgagagctctgtcttagaggggcactggcctgacgccagctgaaacactcctgcatgaggtgtgtggagactcctgttgagaggtctcacttagtcagcaggagcagggtcagagacctgcttaaataagcagagtttctgccccttgaagggtgtgccacactgggggaatcaccctcatctgggctgccctgactctccagagccagtaggcagaaaagacagatcattgatccacaataccacagctgtccctcctcctaggaggtcctctcagggttatcagtgccccatccataaacccctggctggggatactgagattcccactgggaggccccaaccagcactttgggaggccaaggcaggcagatcacttgaggtgaggagttgaagaccaacctggctaacatggcgaaaccccatctctactaaatatacaaaaattagccagacatggtggcatgcacgtgtaatcccagctacttgggaggctgaggcatgagaattgcctgaacctgggaggtagaggttgcagtgagctgagatcgtgccactgcactccagcctggacgacagagtgagactccgtctcaaaaataaataaattaaccctaatgaataaagctttaattgtggggcattcagataatggaaaattgtccttagttaggggggacttctgaaagcccttctcattttgtccctgttgacacaagcaacattgcctttgcttggcatgaaacccagcagcagggcctaggcacagagatcagctccctaactattctgttgatgcaacagcatcactggatgtctcatatctgagatactgctgatctgttctcctcttggtttgggcacaaaccatgcagatgggacattagtgatgttccgatgatgcagtgtcccaggtagcaaaagcaataaggcagaggttgatccgagtgagggtaggaatagggcatggagtgatgctctggattcttggcctctgcacttagcacaaaggaggagtgtctggagcagactgacaaggaacaaaatagttccaggagacaggtgccatgctgctgcttatttgggttgaaacacaccagcctagattagtgtttctttgaacaactattaataatatttgttgcttggaacaatagttgttagttgtaactaataaatctattgcttacccctgctatacccatgggatacaccccaccccaccttcatctatccattacaaaaaaactcctgtgttcccacagaagtcaaaacagatatttccccccctggggaatgctcctgataaaatccacagtactgcagatggagggctcctagacttaaaaagactcttcagggcactatgtgaaaatagaagagatcctctgacttgagacagagcaagaacctatggggaaattctagactccagaaaagaatccagaccttttatatccattataagagggagcaaaaggaaaaaagaaagtacagaaattccaaattgaacaccaagttcacagtccagtgtgatgtcagaactggggaccaggcagagcacatgatgtcaaagtaggaaaacaggatttcattccttctcttcttccctctctgtcagggtccagagagagcctgggctgggtctattttctccaggataaaaatatatatacactcaaaagtgtcccaattccttctttttttttttttttttttttttttgagacggagtctcgtgctgccacccaggctggagtgcagtgtcgcaatctccgctcactgcaacttccgcctcccaggttcaagtgattgtcttgcctcagcctcccaagtagctgggattacaagcatgcactaccacgcctggctactttttgtattttagtaaagatgaggtttcaccatattggtcaggctggtctcgaactcctggcctcaggtggtctgcccgcctcagcctcctacagtgctgggattacagatgtgagccaccgtgtccagccccaatcctttcctgtttctcaaggccatgtttacatttagcatgccccagggaccctactctgaacctctcaccatcaacttcctctctaccctctccccttaactcataggtactgactgtgagtccccttatgctttgttatcatgctctactctggactctacttgtctatattataaaacttataatgctgaaaggcatgtagctaccttatccatctgtgcatgaatacctagtcccttttcctatagagaggtatcaacccaggcacacagtagcaattttataacctcctgttgattacttaatggaagttattaaattttaaaatgagcctattacaggttatgtggatcctgaaagagtaaatgaccactagtggaaatgaaatcaactaggcaaaaaggacaaatctaatacttcttaaaccgaggaataggtaatagtacctttgagtactgctactttgaaggctatccttccatgaaggaaattaaggacaactagaggaaacagaggaatggtcttaagaaaggaaaaaagagggtaaggataaatggagaagcaagttgagggcacctgtggatcagttatggggatatgcccatatacgggtggttgcttcctacagatattgggtacatgtagaagggagaggtctttggggacctggtcgagaaaaagtggctatgtgatgagtggcagggatgggaagtcagtgaagaagtcaaagctcttggacagaaagaagagtcaggtacgtggctttaatgagggaagctaagggtgctggagatggagtagtagaagcagaaatcctaggtctgcttgattggaatatcaaggctgggatattctctcccatggaagtgggtccaggtgaagcaaggaggtaaccctgtctccctctcttcctttcccatctcccactgatggatcacaaggccaggtaaccttggccatttacttgtcagtccaggcacatctctctctggtcaatgtagaaatccatatatgaatccatttggaagtgcctgaataataatccacctgttgggattgtgtcagggcaggtaggtatgtacaacaggctgaggaaccttgagaatctacccttttcaaacttaacaacccttctagactccagaatccatggatttaactgcttcttaagaaagcgtcctctttgtactctccaagtcctgtgtttgcttaaactcactccctttgcctgatctgctcctgcagtctcccacaggatccacaatgtgctggcctctagagcttccctatttccccttggccaaaatgaaatctacttttatcatcccaaactctaatgaagtcatccagtgaaatccatactcatagaactcgagatcccaaaagagcctgagagttcctctagactctcacccatatcttatctctccctgactcttattctctctctactgtcaatcactcactccagtcgtcttctagagtccttctttaaccttctttccaacctcttgacctttccactattactagtgtcatagctcataagtatccagacttcaccatcttctcccttttcttcagcacaaagtgaatgcattaagaaataagtaatttttttttctcccttggaagtgatcaaagctacatacaactggttctcgaattcttttttttttatacagagtcttgctctgtcgcccaggctggagtgcaatggctcgatcttgactcactgtaacctctacctcctgggctcaagcaattctcctgtctcagcctcccaagtagctgggattacaggcgtgcaccaccatgcctggctaatttttgtatttttagtagagatggtatttcaccatgttggccaggctggtcttgaactcctgatctcaagtgatttgcccgcttgtggttctcaaactcttgacacatcagttgagtggcagtgtccaccgtgccaaagccttcccaacttcagatgacctgacgttttctttcgttttgcgggggaaatgtaagtaaaagttcctggaaatttctcagttaattcttacaggtctggaaggtggtctgtaaggaagtctttggatgaagcttgaaaagggtgcaatactcatcaaagcagtgagttcagcaccaggcagattgaatgtaccaccttctctcccctcttcaggtcctatccttaccacccatgtggtctcagggcttgggtcatctagtatgaatcacagcaaaccaggggtcatagaagttagaggtttatgatattaagtatatgtgcatcttagtgatgggtgcctcttggaatagtgaggaagaagggaggaaaaatggagaaggctgtgccacacatagaccaaaacaagaaggccctctctttgaggggccctcctctagctctgtcatttccccatagagcaaaaagcttatggaaccaagaggatgctcacctggagactgcactgccgcttctagattaccatgggtagcaagtacccaagaacaccctttccaaatggctctaagcccatctccagacctgtgcaggcttttcctaagatatatcttccaaaaaatggaccttgtcattggtgtgcatatacctgaacccaagcattggccaaggggcaacggtttgcaggtacatgtggagaaagcttagaattgtgggcttttgtgtctactagactgagctttctacccattcctccatatactcctcattattttctttttatgattacaaaagcaatccatatttattgtagaaaatttttcaaaaactgaaaaacaataagaagcaaatagaaaattaccagcaatttaatgaccctgaaattatcatgttatcattttggtgtatatgctccatgtagtgcatctccatggggtgtgtgtgtctctgtgtgtgtctgtgtgtgtgtctgtgtatctgtgtatgtgtgtgtgacctacacacaactaggcattccctagtggtgccaaacaatcaatatcttttatgggccctccgttaaacatcgctgtactcacaaagaaacataaatccaattctataaatattgggaattttactgatggtaaaattaaaataggaggaggaggttacatcactatcatatggtaacattcccttaaaaatcatctctttatctttcctaaatattccactgtctttgactgctatacctctctctcttttctttcaccaagcctctctctttgctttccttctggtaaaagcagtctctctctctctctctctctctctctctctatccccccctctccctctctctctacccctgaatctggcctttctaaacaccctcaacttgtgtacctgtatactatactgagctacactaaagtttctatatttagccaaatccagcccatcataccagctcttcccctggtatattcctaggagtggagctcggttcacgctgtttcacactttccttgggaaacactctgtgttcttctgcaaagaggagtaggcaatatgttttcagattcacagacaagcttctccttccaccgtcttgctcccaccctatgctaacctgttcacaaaggttaagcaagcagttggaattatggaatctcccatctggtttcctaatcatatttttaccatcagtatcaggcccatactcatgtttcatccccacactgctcctagccaggttcagaacctctctctagggtctcctcctctggtaacaaaagaatgggtttaccatgtttgtttctcattagcataagtggttataagatgcacctcatttgctataattgaagaaaagacaagtgtatttccactctcagagtccaaggcagtcccaagtgtgacttttaatatgtctcacactttctgggctctgagaagggcaggatgctagtgctcaaatgaccacaacaatgacaattataaacatctctgacatgagacatgatgtatacaactgattgtacctgtgtcctgggtttatttgcaatgcctgcaaatgaattcaccctgtagggagattattaaaactaccatggatatgtttgaactgttgtgagaattaccaaaatgtgaaacagagacatgaagtgaggacatgctgttggcaaaatggcacgggtagacttgttcaatgcaggttgccacaaaccttcaatttgtaaaaaatgcaatatctgcgaagcataataaaacaaggtgcaataaacgaggtatgcctgtatatccgactgattgatggtgctgttgagttcaactgtgtccttactaattttctgcctgctggatcccattcataactgaggcatgttgaagtctccaactacagtaatggattcatctatttctccttgcagttccatcagtttctgcctcacatatagtttttaaatgtatttttaaatgcacatttgactttttaaaatgtatatatttaaatgtatatattttaaatatatatatttaaggtacacaatttgatgatttaatatacatatacactgtggaataatcaccacaataatttgtctatcatctcagatagttaccattttctttctcccctttattcctttcttgctttttttcctttttttttggtgagaatgcttaagatacattatcttaccaaagttcaactatacaataaagtattgttaattatagtcacattgctattcatcagatctcaaaaaaatattgattatgcacaactaaaacttcgtacccctttgacaacttctccccacttcttcctccctccagctcctggttatcaccactctactatctgtttcaacgggtttgactatattagatcccacaaataagtgagatcatgcggcatttgtctttctgcatctggtttgttttacttagcacaatgtcctccaggttcattcttgttgtgtcacctgatagagctgttatttctatcttggtgaaagctgaataatagtctagtgtgtatgtatgtgggtgtgtgtttaccatattttttaaaatccatgcatccatcaatggacatttagtttgcttccacatcttggcgtttctgcataatgcttaaatgaacatgggcatgcaaatatctcttcaagatcctgttttcaattctcatcgatatatatcaagaagtaggactgctgaatcacatggtagttctatgtttaattttgtttggaacctctatgctgttttccagagccactacaccattttcattcccaccaacagtgcacaaggttcccatttccccatgtccttgccaacacttgttatcttctgttttgtttttgttttatgggaggtgtgtgtgtgtgtgtgtgtgtgtgtgtgtgtgtgtgtgtgtgtgaaatagtggtagtcctaatgtatgagatgatatctcatggtggttgtgattagcattttcctgatgattaataattttaagcatttttccaaataaatggccatttgtgtatcttctttggagaaatgtctgtttaatcctttgctcatttttaaaatttgattatttattattcagggggctgttattgagttaaaggagttttaaaatatattctagatattaacctcttatctaatatctctcttgcaaatattttctccaatttcataagttttttagtttgacgtcaccctatttctctatttctgcttttgttgcctgtgctttggtatcatatctaaaaagccatttcccttttcaatgtcatgattttttaattgctttcttctgggagttttatagatgtttataaaaaattaacttctttttgagttaatttttgtgtatggtataagggtccatactaacaacatttattgaagaaactaccctttccccaatgtacagttttgaaactcttattaaagatcattagaccttgtatatgagggcttatttctggactctatattctgttctatcagtctacgtatctgtttttatgtcagtgttatactgttttgattactgtgactttggaaatatgttttgaaatcaagaagtgtgatgcctctagctttattcttctttctcaagattgttttggctatttggagtcttttaagatttcacatgaactttagaatttttttcctatttctacaataaatgccatttggattttgatagggtttgcattaagttcgtacattatttcgggtagtgtaaatatttttaacaatattaagtctaccaatccttgaacacaagatatctttccaattgtttttctctcttaattttgttcagcaatgttttgtagttttcagtgtacaagtcattggttaagtttattcctaactattgtaaatgcgattttaaaaaaaatctatttggattgtccattgttactatataaatgcaactgacttttgagtgtttattttgttctattctgcaactttactgaatttgctagtctaataatttttgatggagtctttttatatacagttttctacatataagaccatgtcatctgcagagataattttactacttcttcttttccaattcagatgcattctatttattttccttgtctaattgctctggataagacttccagtactatgtagaataaaagtgctgagtttggacatccttgccttattgctgatcttagaaaaaaaaactttcagtttttcactatggcatatgatattagttatggcttttcatgtatgaaatttatgatgttgaggaaattctttctattcttattaatatattgttgaatgtttttatcatggaaaggttatttaattttgtcaaatacttttcctatgtctattatgatagtcatgatttttttcttcattctattaatatggtgtattacatttattgacttgtgtgtattgaactatctttgcaacccagtgataaatcccacttggttgtggcatataatccttttaatgtgctgttaaaatcggtttactagtattttggtaaggacttttgcatcaatactcaccagggatatgggttgtagtcttcttttcttgtagtatctttgtctggcattggtatcagggtaatgctggcctcatataatgaatttggaagttttctctgattctgtttttttggaagaagttgagaaggattcatattccctattctttaaatgtttggtaggattattcagtaaaaccatctggttctgggtttttctttgttgagaatttttttctttgttgggagattgtatgtttctaagaatttattcatttcttctaggttagccaatttaaataaaaatttctgtggcaccagttgtaatgtctcctctttcatttctcacttatttgaatgttctctacttttttcttttttaggctggccaaggatttgtccattttgtttatcttttcaaaaatccaattcttagttttattgacttcatgtttactatttttctattctctattttgtttatgtctgttctgattttatcatttttgctaactgtgggcttagtttttcttctttttctagttctttgaggtataaagttaggttattgatttgagctctttgtacttttttttttttttgggacagagtcttggtctgtcacccagactggggtgcagtggcgtgatctcagctcactgcaagctccgcctcccaggttcacaccattctcctgcctcagcctcctgagtagctaggactacaggcacctgccaccacgcccagctaactttttgtatttttagtagagacagggtttcgccatgttagccaggatggtctcgatctcctgacctcgtgatccacccacctcggcctcccaaagtgctgggattacaggcatgagccaccgcgcccggcctctttgtacttttttaaatgtagatgtttattactatgaatttccctcttggtactgcttttgctgtattccataagttttggtatgctgtgttttccttttcatttgtcttaaggtatattctaattgtatttattattcctccttgaagcaatggttgttcaagagaatgttatttaattttcacatctttaaaagttttctagttttgtttctgctgttggtttctagtttcattctactgtggtctgaaaagacacttgacataatttaaatcttcttaaatttgtcaaaatttgttttctaatctaacacgtaatcaatcttggagaaagatctgtttgctcttgagaagaatatgtattctgctgttgttgggtagaatgttctgtatatgtctgttaggtccatctggtaaacagtgttgctccagttagctctttctttattgattacctgtctggaaatcctattcatcattgaaagtgagcattgaagtggcctattacaggattgctatcaatttctcctttgaaatctgtcaatatctgctttatatatttatatatttatatttaagctgatgttgagtgcacatgtcttaacaattgtttattcctgttgaattgacccttttatcattatataatgacttcctttgtctctagggatagttttttattaaagtctattttgtctgatataagtatatccacccttactttcatttgattatcatttacatgaaatatatttttccgtccctttacttctagccaatttgaagtgagtctattttagacagcatattgatggatcttttttagataattgttcagccactctgtttttggttggagaatttaatgcatttacattcaagttaattactgaaaggtgagaacttattctgcctgtgttgtggttgttttattcttttccctctctttctgtcttccattgttatttgatgatttcctgtagtgatttgctttgactcatttctctttatcttttatatctattgtaggatatttcctttgtggttagctcccagcttgtgtaaaatatcttgtagttataaccacctattttaagttggtaacttcaactgcaaacgaaaactttactttgacttctcccataaccacccactttgagtacctgtagtcagggtttgcttctttttatattgtgtgtttattaacaaatttttatcttttactttcatattaaggttcaaagtaattcatgcatcaccttcacagttttacattattctgtatttatatatttacctttctcaataaggtttatgcttccttatgcttttgcattgctattcagtgctttttcatttaatttgtttttgtttgtttgtttgttttctgagacaaagtcttgctctgtcgcccaggctggactgcagtggtgcgatctcagctcactgcaaactctgtttcctgggttcaagtgattcttttgcctcagcctccagagtagctgagattacaggcacccaccatcatacccagctaacttttgtgttttttttagtagagatgaggtttcaccatgttggccaggctggtctcaaactcctaacctcaagtaatcctcccacctcagcctcccaaagtgctgggactgtaggtgtgagccactgtgcccaacctttcatttcaatttcaagaaccctctaaagatttcttataaggcaggctagtggtgacaaactcccccagtttttgtctaggaaatgttttatcagtactttatttttaaaggataattttgctaggtatagtaatcttagttggcaagttttttctcacactactttgattatgttgtcttactccctcctggcctgcaagttatctgctgagaaatccactgataattgtatgggggttcccttatatgtgatgagttgcttttctcttgctgctttcagaattccttccttaacctaggcttttaacaatttgattaaatgtatttcattggacagggtgatatggaggccagggtcttgggtctgtgttgaggagtctggctttgcatgagtagacaggtcacagattgccaagtacttgccaaatcccattttctgttcttcttgagaaaacagctagattacatttcccaatctcctttgcaaatatgtgggaccatatgactgtattatggtcaatggaatgtggattaaaataataaactttgcttctaggcctagccctttaaaagcttctgtgtgagcccccatgatacctttctttccctattgctggttgaatgtagaggaaccagtagagaagcccctgcgagatgacagagctacagatttaaggagctacattccttgaatcatggcagggatgactgcccactgaccaccctcagtgaaatgcattgtgaatgagaataacctttcatgggttaactgtattaccccatgaggtttgtaaaaatctgcttgaatatttgctccagcaattaaccaaactggttcatacatgggtctaactgggaaggcagaactgggcacctctgcccatgattgagtggaaacaactgttgggactgctgaggattgcaatgagagaaattaagtcatagggaggaagttaaaaaaaaatatgcagagccctcaggttgatgtagcagtttatttgacaaaagcttcagggtaaagaggtcaaggaaatagcagaaaggttaccagctagagccagtgggtgtcccaagaaggaagtaggcagcactcttcttagaccagatggtcatccttcagcccacagtagtgatcggccaatagaatctaggggtttagcattgatttaaggggctctctagaagagaaaagttagtcaaaagtcaagaatcctgggataaatccatttctaaaattaatagcatcctaggccccagatgaaaaaggacagcaattcttctgctaaatcagaagttacccacttttaagcaatttcccccaagaagtttgccaactgaacagacagatagataccaggtctccttgggcctggctgagagtagagcgcccatggagacgcccaactaaggggttagtaattggaactttggataaaggagggatgtatgaactgttgggtgatatgttgagggaagcaaagggaactgaataagagtgaagaaaaaagtagaggacctcatgttggtgtcttggtttattttgcagtgaggagcagcctaggtttggagataggaggacattgtcttttgctgcctatttctttaaccaggatttgggtggctgcggtcttttgaatagtcggtaaggaccagtgatgaagcatgcccaggccctagccttcccaccccaaccaactcactcgttgtctaagcagatgtttccacagtaggtccagcagcatgtatgatttggacgtacacaagtcattattttagtacaccttttctcacagtacttatatggaggctgtacccagcactgctcagtttctcttatcatatctagaactgagatggaagaagttagcagggtccgtctattcacaactcagacaagaaaccttttctaagcttaacaatcccttctgaaacttgagctccaagccacaaagtatttctctgccttccaagaaaatcccttcctcaaattataaccagtgtcttgtcacaagaccatccttgcatggcctgtgttcctccatctacatgtccctacagcatttcagactctaaagataggacctgggacaccctgaccatatatgacaccaaccaccaaatttattctcatgtaaccttagatttcagggcctgcaatatcctctaactccaatttccaaagccaatttgcagagtgggaaactgagccaagggagaatagaaacttactttttttccccttctcttttttttttttttgagacagagtcttgccctgtcgcccaggctggagtgcaacggcatgatctcagctcactgcaacctccacttcccgggttcaagcgattctcctgcctcagcctcctgagtagctgggattacaggagcacaccaccatgcctggctaattttttgtatcttaatagagacggggtttcaccatgttggttgggcagtctcgaacccctgacctcgtgatccgcccacctcagcctcccaaagtgctgggattacaggtgtgagacgccgtgcccagccatttttctccccttctatttgtttccctgatgatgccacctaagaagtcagtctctccataaattttatttccctggcccacaaccctcctgctcagtgtctttgttgtccacattttcttatcatatgaacccaaactttgacccactaaggagcctttatttgtcttttccatttttcatgttctaaaagactcttcccctccaactaaattaacgtgttaaatattacccttttggcattcatcaaaggctcacccaactgaggcacaaaggttctgaaaatatgggcttggagggaagctctgtgttggtttttcctctactggtctgatattggaaaatattatttcctgctagctgatggaatatagacaaaagatacgttcccttttcacatacctagtgttgctttcagagctgaaagagaaaacttaaaggaattgggaatatctaacctaatcttgcttgaatatctctacttaaggagagatcctttaaagcctgattcttgacatgcaggccctggatcagctacaatagacatcccaggactgggcagagcaccccgtcccttttcacaccacccacagggatctttgttccagaagcttcccagcacaggcagaagcatcacaactccagagatgaacatgacgagtagaagaatccagggcttcatggtgctctctgtgtgtatttgggttaagttctggcagaaggcaagtcttttcccaatactgctagacgtagaaaatggattgaggagaacagggtaagcaacaggggtaaagtgcttatgactatcatgttattctttccctttctagtacccagtagcataccaaccaactcccaggctagccagtgacttccccaggtttcttctcatctcatattacataccccttcctttgcaaaattatttcttattaaaatgaatttctcctgtctgattaaaaacaataaatcctcagattatataatatgtaaaattaaaaatacaaagaggaaataaacaagcattagcaattccaccatctagagataatcaatatatgtctatacttttatgttgtagtcattatttttatgaaattggacacatcaagtgtcctgatattttattttgaagcatatgaaacatgatgatgtaaagaagttttagtgaagatcctaagacaaaaggcactaaagcaatttaagagggaattacagatagataacaggacttgagaaaagatgatggccaagaactgttaggggactcaaaactttaatgcactaagatggtccaaagttggaggaattgtagagaagattttgaaggaaattttattggtaaaaagctttgctcgtgaaagccggaatgctgcctcctaattccaagttgagagaaaaggttttatgaatacgactcattgagcttgctatgtgatcctagaagtctatgggaacacagtagacttgaatcatgactgaagactttaaagggtgactttaaatctggccaaagcggcctgtagtagcagagaagagggctctaatttgtgaagtatctgaactgcaaatggccagacgacatttcatgtttccaatgaacccttgaaatctcccacgaaagagtcaagaccagaagcacagaaccagctcatgatagtatctattacacaagaactttcctactactcttattggtccgtcctccctctactccctaggagacagaaacttgctttagtccagagtgggtggaggaatagaattacaaagagccagagtgggggtggtgggaggcgggggagagagattcaccacatcctgttccataactggagcttctgagggagggaggaatccatagttctgaacaatttatgtagttgtgactaatttcatgggcctgcacattttacttattatattgagaagatgtttcatgactggagaatcacataaaatttgtggagacctacctaaattttcctgaagaagcaaggaaataaactaacaattctgaatgaaatatacaggggaggcaaaaatatgctcacatcatacaagtcatgacaagaattcagtcatacttattactatcatttcctcatatcatcaagacctgaatagtttcaatttcttctcgttataaaaatgtcctgatgaacctccttatagttaaagctttggtacatatattgttatttttatagcatgagttaatgaagaaagatttctaggcaaaagacattgtctttcccaggctttggataattgccgccacatttctctcactaagggttaggttacatttccacctaccggatatcaaatgcatgtccctccaccccttgttctactctaggctatacaaaggtaattttcatcaccacactatttgctgatgggtattttaagaggaaagaacatgggccccagagtcagataggcttgaattagaatcccaaccccaccaactcctagccgtggagcctgggccagccacataatccccagagcctggttttccccatccatattacagaaaaaaatatcaatactcatctcatctcatagggtcactgggaagattaaataatatgtatgaaacactaagcataggacctggaatatagtatatacttcataaatgttaactgtcagcattaagctcagaatatcctcctctggatatttgaaaactattttcaattacaatttttttctttttacttttttttttacacttagcattttaatctgtttagattctatgcctctgtgtgtggagggagacagggggagttcattcactcaataagtacttattaagtgcctaactatattccaagttctgggtattggaatatattccaagttctgggtattggaatatagtggtgaacaaaacagacaaaaatcctcccatttatacagctggcattctagttaaacaagataaggaaatgcatagatggtaatcagtggtaaggagaaaaataaggaaatggaagaaaataaaatagccttcagctgagtgacagctgaggggtaagggaaactagagtatgggaacagcagaaaaatcttaataaaaaggaatagatagacattttcttaacactgtaaaaatttaactattgcaatccaaaatccagcattccacattataaaactgaaagtactcccattaaaattagaaataggaaaaaaagatatgcactattaagactactttttaacattattttcaagtgtttaagccactataattagaaaagagaaaaatttgaactataaataatagaagagtggaagaggaacctaattacaatggaaacttcccagccttctcccatctacccccctcattctctattgctctacttttctagaaccaaataggaaggaaaataagagtcaaagaaaaggataaaattctgacatgaattgcatcattgcatgaacaaggcagtgattttccctctgcctgaaagtctttatatttgttcagaaattttcaatgaagcaaaagagatttctttgtgctgtccaatgtggtagccactagccacttatgactgttcaaactcattaaattaaatcaaaattcagtttccagtcatttcaagtattcaatggtcacatgtagttagtggctattgtccccaaagtctttctctgatgcttctcattccatttatacataggacgatgggaatagtctacatcaacctttgacttcttgtgtgtcctatttaacattccttatttctcaggcgcggagcctttccatcatcacagaaagttctactgaacaatgctgctctagatgaatccaccaaaatgactctgctcaaaagcagaggtaatactagaaaaattttaaagctgccaaatttttcagaggagactttgaaaatgtattctcctcttagcttctgtgaaatttggaaggtgaaaaatacaagttttaggcacatgtcattagatgtattgacttttagacaaatcacttttaagagattcgagcagaggcaaaagcagcaacatcttagcttggcaacttcatcaagtcatgcttaggtaagctggcagagacacaggttcttaatggagaagcttggagagcaggaataagcatctaagagtagaacccccacacacacaaatatctgatctgatctacaatttaagggcttctcttctcctttcgtttctctccctaatctcctgctcttgctagctagcaatggcaagatactcattccttgagcctgagtccttgagaacctcagagtgttcttctgattatgtgaatataccagcacatggcaagacaggtgaaccatgaagatactctgttatctgcttacagccagggatgtgagggatgaggtaagtgggtgaaagtgggcatagattgcagtaggcctctggattcctggtaccaaccctttgcataaagaaggaggaatactgatatacagtgacaggaacaccataaatccaaagcattggattccatgaggctgtttctttgtattccaaaataccaccctagacccaagttttccagagctttgaaatctgttcattcacacggcctcattcttactctagttttctttctttctttctttccccttgccctttaaaggtgttcaggaatctgaggatgcctagtctcctgttttgcacaccctcaagtgtactaaatgatcccagacaaaagaaacatcattatgcccaggctgggtacttctcaacttctcatatacagagtgctgtgaattttttggtcatcctgagacaaactgcaggacaattcaaagatcccccaggatcagaaagacacagaactactgctctccaccaatctggctttccagataatgttaaagaggacagagtgctggatttagtgtcaggaatgctgaaatctttagtttctgtcccttttacctatggaacctcagacagctcatgtcaccccctctcaattttcttatttgaacaaaagaaacaataatccctacctcacaggaatagtgacaccatctgggctaggaattaatccaagcaagccacaaatagaagctcatgtctcaagacctttatccccacctacctctgaaggtgtctgcattgagtgtctgtagtaactggctgacagctcttttgtctggccttttattatgaagttgtttgaagtggggctcgaactgggggcagaagagcagaaaaacaatgttcaaaggccaggaacttaatggtgattttggttgtgaccgatttttaatttctacccagaaactacatgttggctgtatcacagattctttcctttgatattcacccatccagatgtactcaattttctaaggtgcaggtgggatcctctgaaaagctgggaagaacattgtgtacctggattgcagctcaggccacccccagcagacccaaagtacatgttcccaaagtctctcaaatacatctcagtccattcatatgtaggaagttgggaacagtctacattgacctttgacctcttgtctgtcctatttaacattctatctttctcagtattgattctcttttaccaataaaatcataacaagatctcccaccaaatgccctctgacttttatgtagctaaaaagagactgaataggaagaattttagaaaaagtagatgaccacctaacaaatgaaggaagcgacgtgaccaaatccagcaccaagttcttgccatgagcttgttggttgaggtgcagagggatttgttcaccaaatgtcagggaagggcattatattgggcacacaatacacatgatttggagatcactagctcatgagaaaagagaacagtcaagtgggcaggaggcagggacttccaaggggtaaaccttctctcaaagcctgtctgcaggaatattatacgcagtgacaggagatgtcaatataaaattcttcctaggatacaggcatacctcggagatattgcaggttcagtttcaggctaccataaaaaaggtaatattgcaataaagtgagccaagtgcacttttttggtttcccagtgcatatgaaaagtatgttttcctgaagtcttttatttatatatttatttaaactagaaaatgaaatatttaatagttgaaagttgtttctctgaaaaagctagtaaaatttgcaaacttctgatacaaatctgtatatgtttcagtatacaactgtacctctttcatattctaaacagtttctaatagttttcttatgatgaatttcattattacttattaaaatattaaaaaggtatgtttacactatgctgtagtctgtcaagtgttcaatagcattatgtataaaaaataatgtgcataccataattttaaaatactttactactaaaaattgctaatgattatctgagccttcaacaagtcatcatctttttgctggtggagggtcttccctcaatgttgatggttgttgactgatcagggtggtggttgctgagggttggggtagctgtggcaatttattaaaataagaacaatgatgtttgccacatcaattgattgatcctttcaagaaagatttctccatagcatgcaacgctgcttgatagcattttatacacaatagaatttctttcaaaatttcggtcaatcctctcaaactgtgctgctggtttatctaagtttatgcaatattctgaatcctttgtcatcattccaacaatgttcacagcatcttcaccaggagcagattccattcaaagaaaccactttctttgctcatctataagaagcaactcctcatccactcaagttttctcatgagattgcagcaattcagtcagatcttcaggctgcacttctaattctcactgttgctattttcatcacatttgcagtgacttcctccactgaagtcttgaaaccctcagtcatttataaggattggaatcaacttcttccagactcctgttaatactgccatgttgacctccttccatgaatcatggtatgtagaatagtgaatcctttccaggaattttttaatttactttgcccagatccatcagggaaattactatctatggtagctatagccttccaaaatgtatgttttaaataattttgacttgaaagtcaaaattatctcttggtccatgggctgaagaatgaatgttgttagcaggcatgaaaacattgatctcttcatatagctccatcagagctcttgagtgaccaaaatctttttttctgagccgtaggcctcaacagtgggcttaaaatattcagtataccatgctgtcacacagtctttgctgtttcatttatagagcagagcaagagcagagttagcatagtttgtaagggctctaagatttttgaaatgataaatgagctttggctcattattactttaagtcaccagctgcattggcccctagcaagaaagtcagtctgtcttttgaagttttgaagccaggcattgacttctatctatgaaagttctagatggcatcttcttccaatataaggctgttgtgtcttcattgaaaatctgatgtctattgtagccaccttcatcaattacagttgacccttgaacaaaatgggagttaggggtactgaactcctgcacagttaaaaatctatgtataggccaagtgcagtggctcacgcctgtaatcccagcactttgggaggccaaagcaggcagatcacaaggtcagaatttcgagaccagcctggccaatatggtgaaaccccatctctactaaaaatacaaaaattagcctggcatggtggcaggcaccagtaggcccagctactcagaaggctgaggcaggagaatcacttggacccaggtggcagaggttgcagtgagcacagattgtgccactgcactctagcctgggtgacagagcgagactccatctcaaaaaaaatttaaaaagaaaatccatgtataacttttgacttctcaaaaacccaactactaatagcccactgttttatttttaattttagagacagggtcttgctatgttccctaggcttgtctcaaactccccgctccaagcgatcctccttcctcatcctcccgagtagctaggactacagacacacaccaccatgcctgaaatattctttttattgagatggggtctcactatgttccccaggctggtctcaaactactggctcaaacaatcttcccccactcaacctcctgagtagctgaaagtataggtgtgcaccatcatgcctgactaatagcctactgttgaccagaagccttactaataacataaacatttgattaacacatattttgtatgctatatgtattttgtgtaccatttactcttaccagaaagtaagctagagaaaaaatgttattaagaaaatcataaggaagaaaaacatatttactatttattaaatggaagtggatcatcataaagttccttgaggatgtataatgaacccgcacagttcaaatctgtgttgttaaagggccaacagtatcttagctagatcttctggataacttgctgtgtagcttctccatcagcacttgctacttcacattgcccttttgtgttttagagagggcttctttccttaaccctcatgaaccaacctctgctagcttcaaacttttctgctgcagcttcctcacctctctcagccttcataaaattgaagagttggggtctttctctggatgaggttttggcttaagggaatgttgtggctggtttgatcttctgtctagatcactaaaaccttctccatatcagcaatagagctgttttgctttcttatcgttcctgtgttcccggagtagaacttttaatttccatcaataacttttcctttgcattcacaacttggctgtttggtacaagaggcctagctttcagcctatctcagctgttaacatgccttcctcactaagattaattatttttctagttttttatttaaagtgagaaatgtgggactcttcctttcacttgaacatttagagtctgttgcggggttattaattggcccaatttcaatattgttgtgtctcagggaataaaggggctgagaagagggagcaagactggcaaatgaccagtcagagcacacacacatttattgttcgccatgtcctatgggcacagctggtggcactccaaagcaattacaatagtaacaacaaaaatcattgatcatagatcaccttacagatataatgataagaataataataataaagtttgaaacattttgagaattactaaaatgtgacacaaagacataagtgagaacatgctgttggaaaaatagtgccaaaagatttgctcaatgcagggttgctgcaaaccttcaatttgtaaaacatgcaacatccataaagcaaaaattaattaataaagcaaagtgtaataaaatgagatatgcctgtatgttgagtgcactgaggggcaggaagtatatgtctggactccagggacttggctgaggaaggtggaccagtacagatacaaagagctttggaaccaaggtaaaaaggtgtgggaacaaactgaaggaaattttgacagggactgaaaatggtgccaaacctagagtgattgaattatggatttctaagatatttatttatatggcagcaaaatgatgttccatgcatgacgatcatagtcttttgctctgtgtggcccagctgctggagagctgaggagcacagtcactaatgagtagcccaggagtgccaaggactcctgccactcatgattctggatcaagctatgcagaatttaggacaatctgtatactcttctattttagttaagaatttcccagtgcagtatctgaaatactgtatccaataattctatatctagcaaagctatcctttcctgatgaaggtaaaataaagacattcccagaaaaacaaagactgagagaatttgttgctaccaggtctgcctttcaagaaatactagagaaaagctttaaagctaaaaagaaaagacatcaggtagtaatgagatctacattaagaaacaaagagaacagataaaagtaattatgtaggtaaatataaaatctgatattaataatttttaacagattggaatgacaactgtataaaacaatgattataatcattcaattgtattgataggcttaaaacataaagatgtaacatgcatgaaaaatagcacagctgggcgtggtggctcatgcctgtaatcccagcactttgggaggctgaagcgggtggattaccagaggtcaggagtttgagaacagcctgaccaacatggtgaaacctcgtctctaccaaaaatacgaaaaattagccagccgtggtggtgggtgcctataatcccagctactcaggaggctgaggcaggagaattacttgaacccaggaggcggaggttgcagtgagtcgagatcatgccattgcactatagcctgggtcacagagcgagactctgtctcaacaaaaaagaaaaggaaagaaaaatagcacaaaagagggaggaaggcaggcatgtaagtatagttatgatcatccagtttaaatactttgtaagtatttttaagtatgagagccatggattattaagtagcgttatttgtttttcagacatatgggatttgcttttggtattgattttctattttcctgcattttcaaaagaaaatattgtatggcattagtcatttggaattttttaggctttctttgtaatctaagtcattgtaactaagtactcaaacctgctcaattgggccgggtgtgatggctcacaccagcacttttggaggcagaggtgggtggattgcttgaggccaggagttcaagaccagcctggccaacatggagaaaccccgtctccactaaaattacaaaaattagctgggtgcggtggcacacacctgtaatcccagctattcgggaggctgaggcatgagaatcacttgaacccaggaggcagagattgcagtgagccaagagagcaccgctgtactccagcctgggtgatagagtgatactctgtctcaaacaaaaaaaactgctcaatctacaactttgtatagataatttattttcatttattgaggccattttgtgtgtatgtgtgtgtgtacacatatatacaattgttaaggtttcttgatctgtttttctttaccagtataaaatattcttgtctaaattgtgtcatgtcctctatgttgaatgttaattatattatgatatttaaattgttatatcatctttctttttaattcatatttggtggggcatccttttttattcctttattttaaattacttgtttacttttgggaaattacacattgttgaatcatttaaaaattttaatctgagaatctctgtcttttaataaatgtctctaacccatttacctttaataaatattcttatagaaaacaatcttatgttagggcctatctctggcatcttatttcatatttttaatttatcatgctttttaaatatttgtttttatttctctcttcagacatctattggatgaatgaaatatcttctactattttaaaagccattattgtattctgatcccttagaggattttttatttaagcccacattacttttccacatagacttaaagatttctaaaacttctaagttttcctaaaacaagacagctctttcagtatgctaactgttccctttagtttaccttctgaccttgatattttctagacagtttttagttcatgattataatagatattggtgttctcttattctatctcttccttccactttcttcttaatccctaaatttttagacaacaccaaactttatgaattgacttctcactatgcaaaattgttgacatggcaggcctgcagttgctatctttaaaagtcctgcttacaaggttggctcttggttggcatccataagcctgaattttgagaaagttcccattgttctcagaacaaacaagtatggctcactgtgcctcaaccatttgtacaaacaacttggtttatggtagatatctgcttttattttgggagtctggaattttggtacatgctaggcagaagctgctatatgaccagcccccaatagaaaccttggacactgtgtttgtctctcatgagcttccctggtagacaacacttcacacatgttgtcacaactgatcgatgggggaattcagcatgccctgtgtggctccactggtcattgggaaaagacacttggaagcatgcacctgatttcttctggactttgccccttgcaccttttccctttgttgactttgctttgtagtctttcactgtaataaatcatagctgcaagaaaaaccatgtgctgagtcctgtgagtcctcctagtaaagcactgaacctggggatagcgttgggaatccccagcatattcacttatattgcccatatacttttgtatagtggttctagatttattttcctagtggagcacatccttcaagcaggctttcaaaaagggtctttgtgtggtaagcattctgatgtttcatatgtcttagaacaattttattgtgccctcatagttcaggatgtaaattttcacttgaaaagtttttaccttaaacatcttgaaaatgctactctattgatttcttgtcctattgtcactatttgaaagtctaatctcagtctgattattcttcttctttgggtgatctaatctttctctatagaatattttaaaatttatttgtatttgatgttcctacattttataatgtggctagatatgcaagttttctttctctattcttttatgatcatttccagtctgagatctttaatagttctttcatttggggcaacttcaatgcattgtttcattaaatattttttaacctgctaaatctttttcttttagaactactatttggatgtttacacttatacctctcgcttccacataccttaatcttcctttttattttgaaacaatcttaaagtagcagaaaaactgaaagtacagtaaaaataacttcttttccctgaaacatttgagagtcagttacttaatggtgcccaatcacccccaatgctgtcatgtacattttctctaaagaaagacaagttcttctacataaacacaacatagccatcaaaatctggaaataaatgatgccaatatctactctaatctatttacatatattaattatgtctattttatgcatgattttaattaattctgtattatttgctatcagtcattcagtgtgagtgcagaaacatttcatgtaaatgtgatgttcactgctaggtttgatttgaaggccaaaaggaagcataggtttgttattctcatcccattaaccagctcaacttgatgggggaggtgatgcaaacctaaacagatttgtattgtcaaacctaaaacagtttaggttaagttaagctaagtgtgcatgtttgagaaatggctcaggagtgagggggaaactaatggatgggaccagctgataatctagctatgaagatctgggtaaaacacccagagagaaattcagaggagcccaagctgacacatttcattataatggtcatacagttattcaccaagaaaaacaaaattaggccaggaaaatagcaaacagatggaagcttcaaggatttggggattgttacaaagatcccaaaattaatctggatgttgttgcatctttatttcagatggcacatcaagcaactcctcttattcttttctgtttgtgcagaaaaaccagatctgtggtgtaggttttggatgtttttaggccaggcgtggtggctcatgcctgtaatcctaacactttgggaggccgaggcaggtggaccacctgaggtcaggagtggccaacatggtaaaaatccgtctctactgaaaatacaaaagttagccaggtgtggtggcgggcacctgtaatcccagctactcaggaggttgaggcaggagaatcactttaactcagggggcggaggttgcagtgagccgagatcatgccacttcactccagcctgggcaacaagagagaaactccatctcaaaaaaaaaaaagtttttaaattgacaagtagtaattttacatatttatgtgatacatagtgatgtttcaatatgtataatgtatagtgatcagatcagggtaattagcatacccgtcatctcaaacatttatcatttctttgtgttgggaacattcaatatcttccttctagctatttgaaattatattattcttatgtatgttcatcctacagtgctatagaacactagaacttattcctcctgtctagctatgacgttgtatcctttaacaaatctctcccactgggcacagtggctcacgcctgttatcccagcacattgggaggctgaggcaggtggatcacaaggtcaggagttcaagaccagcctggccagcatggtgaaacacccgtctctactaaaaatacaaaaattagccaggcatggtggcacgtgcctgtagtcccagctactcaggaggctgaggcaggagaatggcttgaacctgggaggcggaagttgcagtgagtcgagatcgtcccaccgcactccagcctaggcgacagagcaagactctgtctcaaaaaacaaaaaaatctctccctatcttccccttcccactatgcttcctagcttctagtacctgctgttctactttttacttccatgaggtcgacttttctccagatatgagtgagactatgtgttgtttaattttctgttcctggctatttcacagaacataatgtcctccagtttcagccatggtgccatgaaccacgggattttattcctttttgtggctgaataggattgtgttgtatatttgtatcatagtttctttctccattcctcggttgttagacacctaggttgagtctgtatctcggctattgtgaatagtgctgcaataaacatgggggtacatatgttgatatgctgatttcctttcctttggataaatacctagtagtgggattgctgggtcatatggtagtggagttctatgtgtaggcttttgagaaattgcaataccattctccatagtgactgtactaatttatattcccaccaacagtgtataacagttccccttcctccacaaggtcaacagcacttgttattttttgtcattttgttgttattgtagcgatcctgactggagtgaggtgatacctcattatagttctcacttgcatttccccgatgattagtgatgttgagagaacaatgaagtcatttttttcatatatttgttggtcatttgtatgtcttcttttgtgaattgtctgttcagatcatttgcccattttttaaattggattgtttgtgtttttgctgttgagatgtttgagtttcttgtatattctggatattaatcccctgtcaaatgaataatgtattagtctgttctcagattgctatgaagatactacctgagactgggtaatttataaacaaaagaggtttaatttactcacagttccacatggctggggaggcctcaggagactttaaatcatgtcagaaggcgaaggggaagcaaggcacgtcctacatggtggcaggagagagagctcatgcaggggaaactgcaccttttaaacaatcatatctcatgacaactccctcgctatcataagaacagcatgggggaaactgcccttacgatccaatcacctcctgccaggtccctcactccacacatggggattagagttcaagatgagatttgggtggagacacagagccaaaccacatcaaatactttgaaaatattttctctcattctgtagattgtcttttcaatgtgtcgattgtttcctttgctgtgcagcagctttttagtttgatataatccaatttacctatttttgcttttgttgcccatggttgtgagatcttatattaaaaatctttttgtaagatcatgaaaatgtcctgaagtatttcccctgtgttttcttctagtagttttacagtttcaggttttacctttagatctttaatccatttttagctgatttttgtatagggtgagaggcgaaggtctaatttcattattctgcatatggatatccagttttcctagcaccatttactgaagagactatcctttccccagtgaatgttcttggcatctttgtcaaaaagcagttggctatcgacgcatggatttatttctaggttctctattcttttttttttttttttttttttttttgagacagagtcttgctcttgttgcccaggctggagtgcagtggcacaatcttggctcactgcaacctctgcctcccaggttcaagtgattctcctgcctcagcctccagagtagagtagctgggactacaggtatgcaccaccatgttcgtctaatttttgtacttttagtagagatggggttttgctatgttggccaggctgatctcgaacacctgacctcatgtgatccacctgcctcggtctcccaaagtgctgggattataggcatgagccactgcacctggccctaagttctctattctattccattagtctacgtgtctgtttttatgccagtgctatgctattttggttactagagcttggtagtatatttagaagtcttgaaacctgttccctccagctttgttctttttgttaaggattgctttggctattctaggatgtttgtggttccatacatattttaggatttattttatattactgtgaagaatgtcactggtattttaatagggattgcattgactctgtagatggtttagggtagtatggtaattttaacaatattaactccttccatccatgagcatgggaagtttttccatttgtttgtatcctcttcaatttcttttatcagtgttttgtagttttcaatgtagaagtcttttatctccttggttaaatttattcctaggtatttatttgtagctgttataaatgggattgccctcttggtctctttttttaactagttcattgtgcatagaaacaccactgacttgtatgtttattttgtatcctgtaactttactgaatttctttatgagttctacaggtttcttggtagagtctaagtttttctctacataagagcttgtctgcaaacagggtaaatgtgacttcctcttttccaattttgatgtcctttattgttttctctttcatgattgatctaactaggacttccagtactacgttgaataagagtgggtaaagtgagcagcatgctcatggaggggcatggaggctccctagcctttcctctatatcttgtttcagttcttagaggaaaagttttcagcttttcaccgttaagtatattgttagctgtgggtttgtcatatatgatctttattatgtggaggtgctttcctttcatacataatttattgaaagtttttatcataaagtggtgttgaattttatcaaatgctttttctgtatctactgagattaccgtatggttttgtccctgattctgttgatgtgaagtatcacatttattgatttgtgtacattgagccattcttgcattcgtatgataaatcccacttgatcatgccacattatctttttgatgtgttgttgaattgggtttgttagtattttgttgaggatttttgcacctattttcatcaggaatattggcctgtgggtttctttatgctgtcttgttattgtctggttttggtattaaggttatgtgggcctcataaaattgagctaagaagaattcctgccgcatcaattttttggaatagtttgagaagaattggtattaatttatatttaaagggtcatagaatttggtggtaaagccatatggttctggacttttgtttcaggggagactttttattactgattcaatctccttacttgttattcgtctgttcaggttcttctgtttctttttggttcagtgtggtaggttgtatgtgttcaagaatttatccatttcctctaggtttttgaattataaaggatatcacaaaggatacagaggaagaggtgcataaggtgagatatggggaaaggctagagagcttccatgccctccatgagcatgctgctctccaacaacctctaagtgttcagtggtagccacctggaagctctgacttatatattttaatttgaaatttctgttcagttttgagtaattgtctttttttagactaatttctaattatttccattatagtctgaaactatgtcctttgtgatgtaattctttaaaattttgttcagactttttttatagcctaatgtatagtcactttttgtacatgttttatttgtgcttgagaaaaatgtgttcctctagtttttctatgcagacttctgtatattttaattaagtcaagcttattaatcataatgttcaaattacccatctctttactaaatttactactctatcaataatttgaatgtataaagtatagaccttctatatacccataaatctttccccttataaatgtcagtacttgagcctgccacaatgttgactagactgctttaacagaaagcctccatcacataataactgaaatacaatatactttttatttcttgctcaaataataattcaaaatgagtattctaaaacaatgggtatccttttttcatgtgataaaagaagtcaaggacccaggctcctttcaccttttggcttcactaggctctagaaccttgttgtcatctatactgagctggtggaaaagaaaaagagtgtgaaagagacttgccatcttcttagggtcttgacctagtagtgacaagtctgttagccaaaatatttacattgtggcactggctgcaagatgcttgggtaaggaaaatgcagcttctatttgagatgatgattctcctctatataacccctctttgctaggatagttatgacagtgtccagtctctaaattgttcatttatgagtggacaaaaagaaaaactaggaaagagagagcctttgggaagggtcaaataccactctgtaaactataggtacaaatatcagaatttttgaattataaaggatatcgcaaaggatacagaggaaggtgcataaggtgagatatgggggaaaggctagagagcttcctttgaatgtaaattacaactgtggactgaaggagtctgcattaggagttcagaatgtcagaaagaggttcaaatctttagaagattatcatcatcagaggaagagggtgatcttcttcccagcttgcatgcctactgggagtccagtgaccctaggttgtcccctctttctcctgttagggaagaagaaacatcttcacttctgagagttcatttccttcatgatattcaaggtcagtgaccacctcctcctggacagcctgccaagcctttgactgataggtctctccccctgtctgagctctaagatatttactatgtttctccactagcccttctgtcccatgccctacaatagtctctctttctgtgtgtttatgtgtgtttaaatttgtatatgtatatctgtgtatgtgtttatatacatttatatatgaaacagctacttactctttcactcaggaattctagctctcttagtctaaagaaatcaaagatttataaataaaaataatatgacattctctagattattagtaattagtacaatacaaatacttgattattagcatttgagagctgtgcaattatgaaaatccacattttgagaaatacttacatgattaaataagggtggcaaaaatagataacaaaagttgtttatattaaaaggattgtttatattaaatatggagagaaactaaaagataatgcaatgaaacatcagttaattctaagcaactctttttaacaatatattttttcttttcttttttccataaaacattttgtaattagaaagcagaaataaatgatatctttcattctatcggcaagaacacaagactggttatgtgaaaggaggaggcgtcattcctgcggaagccctatcccacatgacgaacgacaaggccaggggcaagcaaaaagaggaaggactctcttgctctgctccgacttggccagtagaggcagtgaggagctaaagatcattccttctttccttccttcactctccgtagacagctctgcagggaagtctgtgacaacctggccagacatagggctcacgatctgatcagagtcatggcaccccagactctgctgcctgtcctggttctctgtgtgctgctgctgcaggcccagggaggataccgtgacaagaagaggatgcagagtaggtgatgggctgctggatgggtgagggggaattgggtagggggaatggagggcctgtgtccagtctgagtaggacctaggagttggaaactctctgcatatccagctctgaccacaatgttgtgtagactctggactgtccctaaaccatggccctccagccccttagctggccctgggaatagtaatgggaatgaagaagaaacctgcatattttgctgttccttctcaatacttagagagaaatggcacatcccatagtgaaaggcgcaccagggctgagaatccagtggggaaagcaagacaattattatttgatttatgcacatttgtgaggagtaaagattcagaagtggttatgacggtaggtgtaggtgtagaatgggtataagtgtagggaaataggacataagacaagcaaaagttggggtacacagagccaagttaaggttatcatcaaaggggcaaggagagtggtggtggaaagggaactaaagaaggggcaggaagactagagacagtgacagtgagcagaagagagggagagacaagaggcatgttgatcctcatctctgaattctactattcagagactaggagagagtttgaaagatgtctcatgcttctttgagctctcaggatcagactgtagattctttggtggtgacttcaccaaggccatgactagtaagggagatggagttctgattgctggtgtgtggagaaggtccaggaagcccaggcattgtggtctaatggggtaaggtgtacagtggagagacaggatttaaaatatgaccaatcactaggatttggtgatgggcaggaaggtagttctatgaagaaggaatccaggagtatcatgactgagacctgggttcaagggtcttggaggaggcttcagcttgagaaaaatgttctctaggaaactgcgtttatttaccgttctattctccttgtcagaaacacagctatccccagaaatcaaagtctgccagcagcagcctaaactatatctatgcaaacacttatgtgaatctcaccgagattgtcaagcaaataacatatgctgttctacctactgtgggaatgtttgcatgagcatcctgtgagtgggagagtgggctgggatgtgcatcctgcttcccaactcctctatccaagactgtgcccacatccgaagcacaaggacctcaagtcaccagcataagaacatcaacaggaatgccgccctctctactgtctgaaccccttgtccctgtcaaataaaccagaacaaatgcccagggatcctacctcttttgctgccactacagatgatcattgagagctcactgtggcccctacagatgccccacttgtcttgcgtcctggtgttcaatttctctccctggctatgcttctctaccctccctctccctctttggcccacgtatccctgccagccctcaggatgcccagccccttgctgttttgctcactgaaccagtactcccagggggaggaactgctcatgtgcagcatctcctgatgctaaggagaacatttctcaccctggagtcagaaggacccattaagcatgagatgggtggcagttagaacccgagataaagagtgggaggcccccaagcactgctttggtctccttagccttggtgcaccgccatcctatgctccccaatctctctgtaaggttcagattactgtctatcattaggataatgagtcccaggaagtccagcaagcccaaggccacaagagagtgagaggatatgatgtgactggaagagggtgtttcctctaggatcactttttcctcacttctctccattacctgagaccagaggcatcctagtgagagtgagtgcctgcaccaaccccaaagctcctcctatccagcacccaccaatatggctactcctctgatgggacccattttgggcctcaggatctgacactccagcaccttccattaactgaatagtccttatctttcccaagccctcttccttaggggctggttcattctcttttctttagatcaagaggaacactaagggatgtggaacaggtggttcatgctgctgttgctaaggagtaattggcacagagtggctatgggtcttccctgtcatcctactgtgagttggtggaaattaatcagtgtggtacagaatctcccactctgcaatcgcaactcctctgaaatgatcctggggctagatccagggttgggtcacatgtagctaactgggacatgaagccaaatgtgaagaggtttcaggaggataggccatgcccagaggcaggtgtgcagtgttatgctccagtctagtgcttcttgctgggccattcaatgaaagagacatcagagaagaaaacttccttcatcagaccagaggctgtgagccacctctgaggcatcaccgggctctgggtatctcaggcttgtcttcacctttctcaagagcttcccttggacaaggaggtcttaggaaagagatcatgatcaaccatcaacacagacaccatcagatgtactctgtgggctgtaagggcatgatctccaagagaccttatttggtgtttccttggatagcctcccttaccaagcatcctctcaagccacccccaaacatgcctactagacactacaggcatatcttgttttattgagccttgctctattgcacttcacagctatagcgtttcatacaaattgaaggtttgtggcaactctgcatcgagcaagtcatctggcaccatttttctaacagcatgtgcttacttcatgtctctgtgtcacattttggtaattctcaaaatatttcaaacttgctaggcgcagtggctcatgcctgcaatctcagcactcgggaggccaaggcaggtgaatcacctgaggtcaggagttcgagaccagcctgaccaacatggtgaaactccgtctttaataaaaatacaaaattagctgagtgtggtggcgcatgcctgtaatcccagttacttgggagactgaggcaagagaatcgcttgaacctgggaggtgaaggttgcagtgagctgagatcttgccatagcactgcagcctgggcaacaagagcgaaactccatctcaaaaaaaaaatttcaaacttgttttattatcatatctgttgtgatgatctgtcatccataatcttggttattactgttgtaattgttttgggacactatgaactgcgcccctaaaaaatgattaatggataaatgttgtgtgtgtgttctgactgctccaacaactggccatttccccatctctctccctctcctcaggcctctctatttcctgagacataacaatattaaaattaggccaattaataactccacaatggtctctacgtgttcaagtgataggaagggttctatgtctctcactttaaatgaaaagctggaaatgattacagttaggaaggcatgtcaacagcaaagatatgccaaaagctaggcctcttgtgccagttagccaagatatgaatgcaaaggaaaagttgttgagggaaattaaaagtgctactctagtgaacacatggatgataagaaagcaaaacaaccttattgctgatatggagaaaattttagtggtctgggcagaagatcaaactagccaccacattcccttaagccaaaaacctaaccagagaaaggctctagctccctccaatattatgaaggctgaaagaggtgagaaagctgcagaagaaaagttggaagttagcagaaattatttcatgaggtttaaagaaagaagccatctccgtaatataaaagtgcaaagtgaagcagcaagtgctaaggtagaagttgcagcaagttacccagaagatcttgcaaagtgatgaagatgtctaaattaaacaatagatcttcagtgtggaaaaataagccttctgtaggaagaagatgccatctaagactttcataactagagagcaaaagtcaatgcctggcttcgaaacttgaaaggataggctgactctcttgttaggggctaatgcagctggtgactttaagttaaaggtaatgatgatcatttaccattctgaaaattccaagtcccttcagaattctgctaaatctactatgcctataaataagacaccatcttgatgatagcacatctatttacagcatggttcactgaatattttgagtctacttttcacacctagacacattttgagtctacttttgacacctagacacctactgctcaaataaaaaatactcattcaaaatactactcccattgacaacgtgcctggtcacccaagagctccaatggagatgtacaaggagattaatattgttttcatgcctgctaacacaatatacattctacagcccatggctcaagaagtgatcttgactttcaagtctcattgtttaagaaatacatcttataaggctataggtgacatagatagtgattcttctgatggatctgggcaaaataaattgaaaaccttctggaaatgattcaccattctagatgccattaagaacattcatgatcgacaggaggaggtgaaaatatcatcactaacaggagtttggaagaaattgattccaactctcatggctgactttgagagtttcaagacttcatagaggagcccactgcagatgtgatagaaatagcaagagaactagagttagaagttgagcctgaaaatgtgattgaattgctggaatctcatgataaaacttgaatggatgaagggttacttcttttttttttaagagataggatcttactcagttgcccaggctggagtacagtggcatgatcagagctcactgcagtcttgaactccttggcttgagctatgctcccacctcagcttccctggtagctagaactacaggcatgcactactgcccttggctttttttttttttttttttttttttttttttttttttggaaagacaaggtctagctaagttccccaggctgatctcaagttcctggcctcaagtgatcccctcctacctcggcctcccgaagtgctgagattattataggcataagccatggcacccagtcaaggagttgcttcttatggatgagcaatgaaagtggcttcttgaattagaaacttctcctggtaaggatgctgaaaacatttttgctacttgggaggctggggcaggaggatcacttgaacccaggagtttgaggctgcagtgagctatgatccttgccactgcactctagcctgggtgttaagacaagaccctgtctcttaaaaaaaaaaaatagcaactcttcatccatgaaagttgtatcattagactgttgaaatgacaacaaaggatttaaaatgttacataaacttatgataaagcagtagcgggatttgagaagattgactccaattttcaaggaaattcttccgtggaaagaaattcaaacaacatcacatgctacagagaaatctttcatgaaagaaatagtcaactgatgcagcaaactttattgttgtcttattttaagaaatttccatagccactttagtaaccaccaccctggtcagtcagcagccatcaacattgaggcaagactctctaccagcaaaacaattatgactaactgaaggtcagatgatcactagcatttttagcagtaaaatacttttaattatatacactgtttttaacatataatactattgcacacttaatagattatggtgtagtgtaaacataacttttatatgcagcaggaaaccaaaaatatgtgtgattctctttattgtggcagttggatccaaacttgatctctaacgtatatctgcattaagagaggcaaagttagccaggcacagtggctcatgcctgtaattccagcattttgggaggccgaggcaggtggatcacctgaggtcaggagtttgagaccagcctggccaatgtggtgaaacctcatctctactaaaaatataaaaattagccaggtgtggtggcgcacacctgtagtcccagctactcaggaggctgaggcaggagaatcgcttgaacctgggaggcagaggttgcagtgagccgagattgcaccactgcactccagcctgggtgacagagggagactccatctcaaaataaacaaacaaacagaaaaacaatgagaagcaaagttacctgccagtggccacatggagagtaaacttccatgtccaaatccagagcactttgccatgtaaacacactatgggttccaaactgctctatttcctgtcactggtgcaagtgccatgaactatgaattttactagaagcagttgctccaatcactgatgtcctgacctatgttccagagagctctctggacagcctaccctgccccagggaactcagaggctacacctagaatattgcagctggaaagggtgcccatttggttatgactgtgtgctctgtcttatatggaagcatctgtatacctccatattatttacaatagggtggtgaggaatcctggaagactttgaacctcatggagatataggaggaatcaaatgcctattctgccaaaatctggatctccaaaatgttaagtcctagtcatcagagaatcacagatgaggtctggcctgttggtgaccaaatgcaagtcttatgattcccactgcttttgcattatttgttctcttcctatgctccagacatgccccttcaagatggcgaatgcagatgggaggatcctaaaagaatactccccacctctgatgtcatggtattggccagctcctgcatcatttccatactttggccacagctgatgctcatagtgagtccataactgatgctgtcatcagcaatatgtgccccacccaacctctagttcatcctaacaaacctaggatgcctaaatcatgcagtacagaaggttatctgaaatgcaagggttgggtttaggtgctaagtgcaatatctatcaccaagaaaagtccattagccaaaaatatagttgcaataactatgacatgaagcattcaaagatagtcttctatccagaggaagtctcttataactctcccattaaatatacattctttagaattatacccatcagttaatgtgtccagtgtcttaacttgggaagagttcacttcttgaaaatttttagtgacagatggtaaaatgtagaagtaagtatctgagtgaaagggcactaaacttcagatttctgaggctattctggatcattgtggctagtacatggtgacaccttgccatgttgattcaagtattctattatttaaagtcttcttggattatagtttttaaattaatttatttatgttttaattgacaaaaaattatatgtatttatcatgtacaatatgatgttttgaaacctggatacattgtggaatgatattgtggaatgactaaatctaactaatatatgcattacctcacttattttttatggtgaaaacactcaaaatccactctcttagtaatcttcaggaatacaatacattaactgtagtccccatgttgtacagcaaatctcttagctcacttctcctatctaactgaaatattgtatctccaacatctccccagcatccacccctcagaccccggtagacaccattctaccttgttcctgtgaattgaatttctttggatttcatattaaagtgagattatgtgatatttatctttctgtgcctgcttattttacttaacataatgctctctaggttcgtcatgttgttgcaaatgacaggatttccttctttttaaaagctgagtaatattttattgtttatatatgttgatgcttccatgtcttggctgttacgaataacactgcaatgaactggagtgcagatatctctttggcatactgattttatgttccagtatgccaaagagtatccagtagtctaattgctggataatgtggtaattctatttttgttttttttaggaacttccatactattttccatatgggtatactaatttgcattcacaccaacagtgtgcaagaattcccttttcttcacatccttgccagcccctaggatattctgtctaattgataataaccattccaacaggtaggtgtgagatgataactcatcatggttttaatttgcatttctctgatgattagtgatgttgagcattttttttcatctacctattggctatgcatgtcttcttttggtcctttgccaattttttaatcaggttgtttgcttgctggtgagttgtttgagttccttacatattttggatattagcccttatcagatgcatggtttctaagtattttctcccattccataggttgtctcttaactctgttagttgttttctttgtggtttgatattatcccacttgtctagttttggttctcattgcctagaccaatgtaatggagcttcccttctatgttttcttctagtacttttacagttttaggttttaggttttacatttaattatttaatccatttagaattgatttttgtatatgatgtgaaattagggtccaatttcattcttctgcatgtgagcatccagttttgccaggaacttttattgaagaggctgttctttgccagttgagttttattggtatctttgtcaaaatcagttgaccataaatgattctgtttgtttctaggttctctgtcatattcctttgatctatgtttctgctttaaatgccagcattatactgttttgatttttataactttgtaatatactttaaaaccaggtagtgtgatatgttcagctttcttgtttttgcccaagatagttctagcaatttggggtctttgggattccatataaattttaaggtttttttctatttctgtgaaaaatgtcattggaattttgatatgattgcattgcatctgtagaacactttgggtagtatggacattttaacaatattattaattcttccaatctgtgaaaacagaatgtctccacttatttgtgtcttcttcaatttctttcatcaatgtttcagtttccagtgtacaagtttttaacctccttgtttaaatttatttctaagtatcttttttttgctagctattgtaaatgggattgtttcctagacttcctttttgatagttcatttttactgtatagaaatgctactgattttttgtatgttgattttatgccctgcaactttatcaaatttgtccattatttctaaacagttgttttagggttttctgtatatcagagcatgtcatctgcaaacaaggacaaattaacctctttcttttcagtctggatgccttttatttatttatttatttttttttttttttctttttttttgagatggagtctcgctctgtcacccaggctggagtgcagtggcgtgatctcggctcactgcaagcttcgcctcctggattcacatcattctcctgcctcagcctcccaagtagctgggactacaggggcccgccaccgtgcccagctaattttttttgtatttttagtagagacggggtttcaccgtggtctcgatctcctgacctcgtgatccgccctcctcggcctcccaaagtactgggattactggcgtgagccaccgctcccagctcttgtattctctgcctaattgctccagctagcactttcagtactatgttgaatagaagtgacaagaaagagtgggcatccttgccttattcctgacattagaggaaaagttttcaactttccaccattaagcctgatataagctgtaggcttttcatatatggccttcattgaattgaggtacgttcctcctttacctaatttgttgaaagttcttatcatgacagcgtgttgaattttgtcaaatgttttttctgcatctgaggagatgatcatatggtttttgtcctttgttatattaatgtggtgttatcacatttatggatttgtatatgttgcatcatcgttggatcctagagataaatcccacttgattttggtacataatatatttaatgtgttattgaattagttggctagtacttcgttaaagattcttatatatgttctattaggctgttcttgcgttgcaaaaaggaatactcaagattgggtaatttataaagaaaagaggcttacttggctcatggttctgtaggctgtgcaagcatagtgccagaatgtgtttggattctgggaaggcctcagggagcttttactcatggcagaaggaaaagcaggagcaggcacctcacatggccagagtgcaagcaagagagagagggggcagggaggtgccacacatttttaaacaaccagatctcatgagaactcatcatcatgaggacagcaccaagccatgaggggtctgcccccatgacccaaacacttcccaccaggccccacctccaacactggggataacaattcaacatgagaatttgttggaacaaatattcgaaccatatatattcactatgggtattggcctataattttctttctttttttttttttctcacgcttaattcactttatttttcttgtataaaaaccctatgttgtagccacagctggagcctgagtccgctgcgcggagactctggtgtgggtcttgatgaggtggtcagtgaattcctcatagagagacttggtaaatacagtctccttccagaggtcggggggcaggtagctgtaggtcttagaaatggcatcaaaggtggccttggcgaagttgcccagggtggcagtgcagccccgggctgaggtgtagcagtcatcgataccagccatcatgagcagcttcttaggcacaggtgcggagacaatgccagtgcccctgggtgcagggatgaggcgcaccagcacagagctgcagcggcctgtcaccttgcaagggacggtgtggggcttgccgatcttgttgccccagtagcctctgcacacggggacaatggagagcttggccaggatgatggccccacggatggcggtggccacctccttggagcacttaacacccagaccgacgtggccattgtagtccccgatagcaacaaacaccttgaacctggtgcgctggccggcacgggtctgcttctgcactggcataatcttcaaaacctcatccttgagagacgtccccaggaaaaagtcaatgatctctgattccttaatgggcagggagaagagatatatctcctccagggacttgatcttcatgtccttgaccaagcggcccaacttggtgacaggcatccactccttatcctcgggcttgccttcgcgagctccgcggccttggccccggccccgtccacggccgcgaccccggcc

SEQ ID NO: 396 - DNA, 353099 bp, Homo sapiens
gtctcactatgatggccaggctggactcagactcttggcagcctcaatgatcctctagccttggcctccgagggtttgggatgacaagagggagctattgcacccggcctcaatcttcctccctaattagtaactttaatttcatctgcaaccttaattcccctttgccatgtaatgtaatgcattcacaggttctgagggctaggatttgcacatcactggaggcctttattctgcctaccacagtacaggaacttttggcagagcgaagtcaatggactgagctaagcaaccagaagaacactagtgtgaggactcacgtcaccaactggacttggcccacagctatagtatttctctttcctgttactgttttagggaataaaacccacatttgatgaaaggttgattatgaacagagcttatgacaaggcaggtacgtggttggaacttactacccagagtgcaggaactacaaaagaagaggttttcatgtttatagaataacaggagaaatagtagtgtctcagcaagagagagtgtggctgccggctggccagggtgtgtggctggttcatggaataaactggagtagaacagtctttcctcaatacctgcatataactgacatttaattaatactggtagatgaactgacctccaaggccaagtctcttttactctgtcaactgcttgaccaaagaaattggaagttcaccagatcccctttaatgccagctgaaaaataagaaatggacacgtgtaaacctagataaggcattaacaggcagacataatgaaataggggaatgttttagaatccattattttttcccctattgaaccaaatattaaactctcattgcttaaattaattttagcttaatagtttaaaatattctggcttctgcaatttacattgtaaatttctcatatgtgtttgctgccttgtatgaagcaatgttaaaataaagctaaagtcaccattcaagacattaatgacagtctggatatgtggagacacaaatgagtggactgggtgaatagggtggtgatggacagatggacggatgcacagagacagagggatggggaaatgaactcataaaggtgaaaatgcaggagtacaaagaggctacattgcatagtggttgacagcagatgttcaaataccagctctgacatttactgggtcaccctgggcaagttacttaatccctccatgtctccacttgttcataaaaataaaggccatgtggatgagcatggtggctcatgccggcagttccagcactttgggaggctgacgtggcaggattgcttgaggccaggagtttgagactggcctgagcaacgtagcaagacccaatctctacaaaaaaaattagccaggcatggattttatagataggcttgaggaggcagtgtctgatttatgtagggcctacagattgtgtagttgttctcgtgtcacaggtgtgacgtttacatattgcatggggaagactggccactccactctaatcttattaagcagataggctttccacttggtcagcaccatgttgtctgctccctactgcacacatggtttgaaaggaaaaaagaagatggagctaccgttttgaacacgcctagtcccacgtagccttttcctattggcacagctgccagcattcacttgtgcaagcttctagcttgcttgcccatgtttgcagctcgattttacaggctgctctttgttagaaaagaaaatgatttggagactgcttttcatcaaaaggaaaaccttatcaatggttcccataccctcactatctgcctaagtaattactttttaactcctatgtcagtatcagtgggacctgacactgggctgaaccaggggtgtgcagggaagaggtggaaacagagcaattgctaaggaggcactgaggcccctcagacatttgcaaagttctgacgtcattgttttaactgtgcctctgttggcatcctaggttaccaactcccaggcaactacatcctcctctcctaccctacccccattggccatgttgccactctatcacccaaattaaatcactgttagttctgagagcagcttgactggattaattccctgtcaatgcattccccacccatttgctggagggcttaaaaaatgtaaatttgggcctgcaaggtagctcatgcctgtaatcccaaaacttttggaggccgaggtgggcggatcacctgaggtcaggggttcgagaccagcctggccaacatggtgaaaccccgtttctactaaaaatacaaaacatgagccgggcatggtggtgcgtgcctgtaatcccagctacttggggggctgaggcaggagaatagcttgaacccaggaggcagaggttgcagtgagccgagattgcgccactgcactccagcaggggcaacaagggtgaaaatccgtctcaaataaataaatatataaataaataaataaataaataaataattaaataagcaaatttgattgtgtcactcccttgcttgaaaggctcccttggctagacaggtgcttggctatatatcctagaggtttctcagagtaattcttaataacaccctcttgctctctccaatgtgtctccattaggaatataaagttatatggtcaccctacttaaggggctcagagtgatcttaccacttcccctcctgaccccatcacaggcttctgcagctgtagctaacacttggagtgtcctaagtgctgatgctggagagctactgtttcctcctgttgctctcagatccattccctccctttcttctggagaggagattcttcccaggtgcccaaagccctctggcttctgagtggtttcatccgatgagaagccctggcaggtgacttcagggagccagctattcttctccccatgacctctgcagggttttcctgcagcaattattctttctccagggtccagtcgcctcagggcagcctgtcgtggatgagcagtgactatgtgggctggtgtcgtgggtgtaaaagaatgaaccaagacagttgtaggtaaagaaaggcggatttattaaaggcagtaggaaaatctgttgcaaggttgcaatgggcagaatcagcagaagaggagctgacggcaaggatacaaaggcttgttggagattttatatagttttaaaatgattcttgggctgatggataacgccaaggtagcagggagctaacttgcattcttctgtcagccgaagtgtttgataaattgaagagttagatgacaagcaggaaacttgtgtgctgtgtgcgttatctgtgcaggagggccatgtgtctggggccgtaaagaaaggccgatctatagcttcctctttgctttcccctggtcctgccagcctgactcctttttcctaattaggactccacatagcccccttcttgcctctggctccctagcttctgtcatagctcctcttcgtccctccagcctgtgtcctggaaatgactttccattctggctcatctctcacttgcatcattagcccgaatttgtcttctcagctgttccataccctgtgtaatgaattccctctgtcaaattcgaaatgtttgctggtgttgggagctcatgcctgtaatggcagtgctttgagaggctcagtcaggaggaccgcttgagccaaggagttcgaggttacagtgagctatgattgcatcactgcactccagcctgggaaacagaccaagaccctgtctcttaaaaaaaaaaaaaaaatccaaatgttaatcctggcttattttcctgatcagaccccatcatatatatgatgacatgtgttgacttatttaatatcgtaacacggctgtgaggtgggcattactattattttcatttttcagacaatgaaactaagggaagttgaagggcttggccactgtcacagtttgtgacataagttgggttcaaaagataaattacaggaaactaacatgggaactctccctgtttcagcataccttacaggtcttggtttaaatttgtcttagaaccttcaatccacagttctttgggttgactgttgaccttctgctaattcactgttatttctggatataaggagtctctctctatatatatatcagagacagcttttttttttcatttgtgtgtttgaatgaatagatgaaatacaaacatatcttcctaaataaggacgcattgattagaagagttttccataagactgctgttcaacattcttccttattggttacttctcaatgagaaattatccgaagagctaggatgcctcccagatctcattggtacattgagttttgcaccaaagcatcaggcttaattttccaaggaatggcaatttaagttaaatcaggtttgcagagttgtcggggtgtttgtgtatttgaggttgggaggggaaggaaacgatcatcttcagggtaatgataataaactaataaaatgtggctccaggaatgttgcactaaaactttgtgcctcctgcatacatttcttttgagtaatgccaaattgtgttcagtaaaatctgatcaatcttatgtgcgtaaattgtcagttattgcagaagtaatcagtcaaaaagaaaagaaagtttaaatgtagagacccttgttaggagctgggctttagcctttaaaatcgtgggtggatagggccatctggtgtgcagttgtgtaactagacattgctgttttttttttaacctccttgctaataatcaatgtgattcatttgtctttacaaaaacaaaccattcttttgttttgtttttttttcttcaacttttactttaatttcaggagtatatgtgcaggatgtgcaggttttttacacaggtacatgcgtgccatggtggtttgctacacagatcttcccattacctaggtattaagcccagagtccattagctattcttcctgatgctcttcctcccctcctgcctccctctgacaggccccattgtaggttattctcctccatgtgtccgtgtgttttcatcagtcagctaccagatagagaacatgtctagtctgttttcatgctgctgataaagacctacccgagactgggaagaaaaagaggtttaattggacttacaatttaaaaagagatttaattagacttactccacatggctgaggaggcctcagaatcatggcgggaggtgaaaggcacttcttccatggtggtggcaagagaaaatgaggacgaagcaaaagtggaaacccctgataaacccatcatatctcatgagacttactcacttcacgagaatagcatgggaaagaccagctctcatgattcagttacctcctgctgggtccctctcacaacatgtgggaattttgggagataaaattcaagttgagatttgagtggagacacagccaaaccatatcaatgtggtgtttggttttctgttcatgtgttagtttgcagaggacagtggcttccacctccatacgtgtgcctgctaaggacataatcttgttccttttcatggctacatagtattccatggggtatatgtaccacattttctttatccagtctatcatcgatgggcatttgggttattctatgtctttgttattgtgaatagtgctgcaatgaacatatgcgtccatgtatctttataatagaatgatttctgttactttgggtatataccaagtaatggaattgctgggtcaaatggtatttctgcctctaggtctttgaggaattgccacactgtcttccacaacggttaaactaatttacactctcacaaagggtgtaaaagtgtttctttttctccacaacattgccagcatctgctgttttttgactttttaataattgcccttctgattggcatgagatggtatctcaatgtggttttgatttgcatatctctaatgatcactgatgttgagctttttttcatatgtttcttggctgcatgaatgtcttgagaagtgtctgttcatgtcctttgcccactttttaatgggattgtttaaaacaaactattcttaaggctttcttagggtaacatttggagaacattggctcattcccaaacataagccttctcaaaccgattaaaatctaatcctcaccaagttaagtagggcttgcctgctgatagatcctcatcagagcaaagtcaaagctaaagttcagggggacagaaactgagtaaacagaggaagccagtaaggagagagcagaaaatgtagcccatgggagggaggagacaaacctcaagaggaaaaagttcccaacacttgcatgtcttacttctttaacctcatagaacccaacaaataagttataagaaagggagaagaggccgggagtggtggctcatgtttgtaattccagcactttgggaggccagggcgggtggatcacaaggtcaggagttcaagaccagcctggccaagatgatggggaaaccccgtctctactaaaattacaaaaattagctgagtgtggtgacgctcacctatagtcccagctacttgggaggctgaggcaggagaatcacttgaacccgggaggtggagattgcagtgagccaagattgtgccactgctctccagcctggtgaccgagtgagactctgtctcaaaaaaaaaaaaaaaaatggagaagaaaatgtgatcatgataaccattcccgccattactggagcctggaccagccggccagatttccacaggatgtctctgacctgcagaggggctggcaaggtgggaggcatccagaccatgttacagaactcagtaatcagagcctgtgctggagccaccagcatcccaggaccaccatgtgaacctcctgacaggagcaggctcctcaatgactgaaatgaatctcagcagaactcctgtgattcataagtgactcatttactaacttattgtcagtatagattctccactgggagaagacgggcaacttctggagacatttttggttgttacaactaggagaggggcatctactactcgcatctagtgggtagaggccagagatgctgctaaacatcctactgtacagccccaccacaaagaatgatctggctccaagtatcggtaatgtcgaggttgagaaaccctggtgtcagcagtgggagaagccttagagggaatttccaaagtggtaggatcagcacaggatagaccctgaagtttaaacttcttccagggggaccgttacccagtttggggaacaccatggtatatcactagctgtgggctgatgccaagttacaggtaacagatgccagcagaagctctgggcagaggaaaccaagataaacctaagcagacagtccttgtgaaactgaacagagtcaaagataatgaatggagaaactgaggctaatcagtttgacctcattccttcctctccccacaatcaggggatcttatgactgaatttcttacaaatagcaaaggaataagtaggcttaggtgagaggggaaaggggctaaattgaggggagcagtggagcaacagattagtggtagcagatttatttttatttatctttttttgttgttgttgttaagacagaatcttactctgtcacccaggctggagtgcagtggtacaatcatggctctctgtacccttgaactcctatgctagagcctaggagtaaatactaggattactagagtaatcctccgacctcagcctcccgaatagctgagactacagacatgcaccaccacactggctaacttttaaattttttgtagagatggggtggtgggggtcggcggggggggggggggggtctcactatattgcccaggctggtcttgaactcctgggctcaagcaattctcctgccttggcctcccatagtgctgggattacagttgtgagccactacgcccaatccaatggtagcagatttaaacacaggtggatttggaaaaaaaatcttacgataggtttaatatgagtcagcaggcctgttgaaacaaaacagtgctttgttaagcttgtttttggttggtcaaatgtagaaaggcaggtgtctccgctaatgagtacgtagagcaggaatcctaagcaatcatccatttcagaacatgaagacaaaaagcagctgcccctcccatacactgcccattaaaatacatacttttaaaattccttattttcaattttatttttttgctctctcagaagaatcaaatatatgtaattattctgatggaggcttgcattctttgggacctaggcctgagaaatcacggtcagtagatttccctataacatggggctggggagcaagtgccaaacagggaatgttctgaaaactccttaggcacaagctgaagatatgtttgaggttttggatacagaacatttataggatatcttttggtggtccaagaggacttgagtgtaccttgtaaatacaggattttgtttttaattagattgattcacagagaaccaaacctaaggaatcacatcattcattcatttgttcatttaataaatttgtaggttgaagcatttaccaagtgctggcaatagaaagaagtcccgggtgtgctttgtcagtttagtcgggactacacaaatgagtcaataactgtagtggagtgatgcgatctcaactgccaggaatcccccggctctcctctcttcctgtgcctcttcaggtaattagctatcctttctttcttttattttccttccttccttccttccttccttccttccttccttccttccttccttccttccttcctccctccctccctccctccctccctttctttccagattctggacctattccagacttactaaaggaaattctctaaaggtgaggcagttttttaaagacagcagctctctctgtcgtccatgctggagtgcagtggcccgatcatagctcactgcagcctcgacttcttgggctcaagtgatcctcccccttcagcctcaatgagtagctgggactaccgatgtgcactaccacgcccggcaaactaaaaaaataattatttttggtaaagacaggggtcttgcgatgttgcccaggctgttctcaaactcctggcctcaagtgatcctcctgcctcagcctcctaatgtgtttggattacaggcatgagccactgagcccggcctagctaccctgtctgagttgtgcccactacacaaaggtgtcagctacatgtgatgtctgtgcatttctggcctggaccgcacattaagtgctccgtaaacatcagtctctattatcaacagtctctattatcaatcagtctctattatcatcagtctctattatcatgagtctctattaaacaacagtctctattatcacagtctctattatgtgttttggctgaaagaaagttctctaaaaccaggaaatcaggaatcagcagttttaagttctccaggttatattttaacattgtgttcatatgcaaaacaaaggttgtgaatcagcacgaatgctggcaagccctggaaggtttgtgatcacggactttcacgagaccccaaggcaaggagagacagaagcccaggacaacagcatgggcgccgctttttagtcgggcgccgctttttggtcaggcgccacctggactacatttcccatatccaattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctccgtcgcccaaactggagtgccgtggtgcgatctcggttcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagggaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcctttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgtttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccctgctggccctcagttctctggatcagggttgaaaggctgaaattctttgggtgttagcttaggatgcctctgatccatcctaacccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcacgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctctaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtgcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttactgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaagggccaggtgttttacgactctttggagttagcagcttgttggctctgatttggtaaaagcaacggaaatgccttcagcacggtgaacattacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcgcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagtagtccccccttatccgtggtgtttcagtttttttttttttgagtcagagtattactctgttgcgcaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtactatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccagggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttgttttttttttttgtttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagtagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtgcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactagactctaagaggagatctgagacagagagatgggggcggggaggaaacctatttcagtgtctctactatttctacctaggtggaggataactagccagatgaacggagctaagccttttgtatgaagtttatttcatataaagaggaacaaaatcagaatcaaatttcttctgtagttgcacagaaactgaagttaaagctaatacaatgtttttcatttttacccttacctctacaatgtacttaattgttacagattcgtatttattgattatcatgttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgcggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaataagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactattggatatgtatcgattactaattgattgcttgcctcatgtgctatcatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggagaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgactttttttttttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgtagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgctgttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttataaatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaatgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcaaccctcataggatgtacttacaaatcctacgtggtataacccattatacacagaggctgtatgggatagcctgttgcttccaggctgcaaacttgtatagcatggtaccgaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgttacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtacacttgcctcagcctcccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacagtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctgttacgacttagccctgtagctctgggctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccgtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttattagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcagactgctagaacctccagactgcatgtcatgcgtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactatttttttttttgggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgatctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatccctatgcttttaaaaaattattgtgatacagtgaaacaaggaagaacgtgtagctggaaaaatagtatttgcttgtaatatacattcagattcataacaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattaaaattatttctcagattaagagccatgctatgatgcttgccaacggatatttaaaacatgtaactgatttgttttttataatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccatatcttttgaaagaagattttttaaattccttatttttcctttctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaaaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgagcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttctttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagatcaaggtcatcttcacgtctttagttcttgttttgcttcaggtcagtttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcacgctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatattaaccatctcagtaggcttcttcgtgttcacatagtctcctcaccgtgtgctgtgtccagatttccccttttcataaggacaccagtcctattggattagggctcccccattatgacctcatttatccttaattatgaccataaaggccccatctccagatgcagtcatgttgggggttagggcttcagtgtatgagtttgggatggcaggggagcagttcagctcgtgagaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggcaagccgtgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaagaactccttcccagctctcccttctgagtgtctgattttattcaagctcagatggcttctcagatagcgtaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttcgaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttttttttttttttttaaaaaaaaaaaaggtgcttgaattagaaaggtagcacattgtccacatggacagtgcaggatggggctggctttttcatttctgagagctggcaatggaatgaaggtctttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacgttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattggttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccgtctcaaaaaaaaaaaaaaaaaaaaaaaaaaaagtgccatgtatattttgattacaaaaaatttcatgcggtgttactttctttttattggtagagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttccggacagctgcttagtaggtttagcttaaattatacacatgccaagcatgtacacatatgagaagcctatatctcgtaatatccacagagaatagatggcaaatcccatgatttgtatttgactgacagtcaagaccctgtggggtgtgagcctggtgggggcattccaggctggtttctcctgcctccaggagctgcttctagtgtgtgctcttaaccctaaaggaaggaaacactgtgtcttcctcttctctcatacagagcccttcccatgacaaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctcccggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggcggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatgagaccccatgcctggccaatttcaaggattttaggagctctgtgccaggaacctggatgaagacccagtatgtatttcttattatatcacaatatcacaaatccacagtcacatggtgattgtggtagtgtggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaataccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcccatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattcctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaaatgtgatcattcaggtaatcaaagtaactacagaaacagaggtatggattagctagtcattgcagatgtggcattgagcatataggcgtggtgtacttcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatcgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagggttcccaccttcatgttttttgtgcctgaggattctgtgggcgactgtccccacctgtccaacctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacagagttgctccccaatccttgatctttttttttttttttttttttttttgccaagcaccctgcctttttgcttgtctgtttcgtctttatctctccttccagtaaagttcttggcccagaggttctgctgccactcagtgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacatagtagggtttgacatggtttaaataaaatctcaaccagatcagtgggagatgttctttgagattcggtgattgagttgtgaacgtatggactgagggtgttttgtggtaaggcttgagtcatgtctgtagcaaggatgtttcctgaataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcaccacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtataagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctcttacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcccaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaaatgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggtaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttctttgggttcataggatctgtagtccttttctttatttttcatttttaaaaacaactttattgaggtatgattgatgtacaaaaagccttacgtatttgatgtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattagtgacagtgagccccttttcatacacttggctatttgtatgttttctttggagaattgtctatttggttcctttgcttgtttttaaaatctgtggtttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcgaactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccattataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctgactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggatcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaaaatattttcactaggtatagaattctaagatgaaagttttattttttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatacaaacgtacatttctgcttgtagcttgcacatatatatatacacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcactttgtttgtcttatgaatgaaagcatgagcaagtccattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggaggctttaaccctatctctaatttcttacttttctctgtctatgtagaagttgatgttgatacgtgtctacataaatatttactaagggcttgccttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcattttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttacgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgcagtggactctcttttatttaacagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgagatctcaggacctctgcatgtaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattaccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgattagcatcggaaataatgactttaacattattttcagatagggagcactcagtaccaaccattatattaggctcatgggctcaacattttgctgtgcttttcatagatactgacacctgtgttttcattttgttgttgttgttgttttccctgccgggaaactgccgcatcctgtgttttcatggcatgatattaaggaacgatgggtaggatgctgaggagtaaattgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggggcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagagcgcatcctaaatcagccattagatttgttcctcatttctttgctttacaaattgtttttctgtatagtattggattttcaataaataaaggatgatataaacaagtctgcaaaccagcaagaactatataagccacttgctcaagtcaataagcgcatgctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctctttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtcagcaagagaaaaatgaggaagaagcaaaagcagaaactgcctgataaacccatcagatctcttgagacttattcactatcatgagaatagcatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttcttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaaaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataataataataataataagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgtcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggttactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggagtcaccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgctttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaacaaacagccgagagatgaaatgccacagggatgtctaggttcaaacagcaacagaggtgcgtaccatagggatgtggaagccttgcttgtcttgttcctcttggtataaccccagtgagtagcatagcgcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagcttaaaaggctgcacctgagagtagggggcatatgggtaaatccagctgtacccaagagttgggggcatatgttagccctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggtgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcataagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtggtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatatagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaacgtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaaatgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctggctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggatttttaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcagtctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgcctcatgcctgtaatgtcagcactttgggaggctgaggcaggtggatcacttgtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcggaatcttttctccaggtttcaggacccatgtctgttgtccttcctttaccttaacttcagcagggcaagaatggttcaagccacattagaaagcagttactttctcacccaattttaaaggagaaaggtagatgcggtgggttctagggatttcagtgacgtaacaggtgtttcccaggcattaagacctagtaaggtttccatttccattaggtattatggatgcattccaagaatttaattactataacatcacttcattcattgtaattccttactagagttatgagaacttgggattgtgtggtttcttattcaatcgattaaaaggtacttgctatagttttctaactagctatttatatgaaatttagtacttgtcaatatgtattaaatcaatacagttatatttatcaaagtggtgagaagagtttacatctgaacatagaatagattgcttgccttggccgggcgcgggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagctgggattgtgccactgcactccagcctgggtgacagagcgagactctgtctcaaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaataatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccactgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacaactgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgcttcaataccaagaagctggtcttatttagatctagtcttatatcattgaaatatcattagaattcttatggaaaatatgttttggctgtttaggggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctcttaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagtcctgccaagctgttccatccccagttccttggtgcctgctggtacttcaccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaagaaaaaaaaaagattgaacatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaaccacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcggttggtaagccatccagtctctgcaggcatctacgctccaggtctccagtctgaggagtctggctcctggggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactgatggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcgcatatgtcaatatgtaaacattttatatatatatatatgcattcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgactcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatataattaggcaaacttgttttagttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatgattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcggtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtggtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagatctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggcccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtggcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccatgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatcgctaaccaatggtctcatccgtcagccacactgcctgtctcagcatgggccctgtgtggaccattccatctcaatttgtttctgattcttgtcaattaaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgctagaggctgacacattcctctgctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggcgaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttatatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcatgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccgagcaagttttatttattcactttcagtcattactgaagtgaataacaaacatataacaatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaacgcgtatttcttcagggccaagggcccagctgtgcctcattaggggtgagagtttggctgtgacacgacttaatagaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtgacatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattttcctgcctcagcctcccaagtagctgggactacaggcacccgccaccaagcccagctaattttttgtaattttagtagagatggggtttcaccacgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacgtttcccccagccttccctacctgctgagggctgctcccagcctaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccaccatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatatgtcattgaagtttcatccttcttcatttcagagtctgctggaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctagcaatcctcccacctcggcctcccaaagtgttgggattacaggcgtgagctaccgtgcccgtgcccggccttacgtttcagcatctttcaatccatctaatacgcagtgccagggaaggtttgtgaaaacatttgaatcacagagtcacaaacagtgagaatagctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatggtatatattttccacacatttagattctccatgccactccttatctctttagtgcagaaaacggagaggaggttcagtattcttaagaaactcccatgattgctttgaggcaatggatttaacaggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttagttaatctgttcaataaactcctctgcagaatccaaatgcttaaattcagtttctttttgtctttatggtgtttttcattgttaacgtggcatcggagtagctcgacttttgcatcatgataaattcataacccaagagaaggcagaaaacataattattatcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggttcaagcaattctcctgcctcagcctcccaagttgctgggactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccacgtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttttgagatggagtcttgctcttttgcccaggctggagtgcactatcgcgatctcggctcattgcaagctccgcctcccgggttcatgccattcttctgcctcagcctcccgagtagctgggactacaggcgcctgccactacacctggctaatttttttgtagttttagtagggatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcagtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcttttttttttttgagtctggattttagaataaattcactgtgtacatagctattccatctttaaaaacctttgtgaatgttaatatacagcctttataaatttgaggtataatgttcaaaatgctctaatccctaaattttccagtctaggttattatacttttatgactattcattttgatgtaggccttttaaaatcaattcctccctgttattacaatgctgctttatggtatttgtgatatatcatatgaatatacttgagggtcatgagaagttcatatgtgtgtgtgtagtgtgggccccagactttcgccataccgctggctaaagtggccatgtttttgtacgtctctgcagagcttacaagttattcaacagccagatttctattctgatatgcccttttagttttcaaagcatcgaaaaagggtaatctttagaaccgaagtatttggaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggagaggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttgtcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacattaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgggaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaaccctatctctactaaaaatacaaaagttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatgtcattcagattaatgatggcactgaaaatgtgtaatggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcgttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaatagttcttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcctttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctcgccatgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacccacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcggcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctggccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggcttagcctgtggtggaaggtgtccaaggtggctggaacacctcctgctgggggtgtcagtcttggctctcctgttttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgtatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcactgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaaccttgttcaggtggcgtggggcggtgtgtttggtggggagtgatgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaaactcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtgggccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaaggggagaaggggcaccagaaggagaaatgggaggaaagggcgagtgagatagcaaagagaactcagaaagtaataaagccctgcagtaatcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttggcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcccctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttctgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttgtttttttttttttttttgtttgacacagggcctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacttggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaacccgggaggcagaggttgcagtgagcctagactgcaccattgtactccatcctgggcgacagagcaagactccatctcaaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaaatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcatattagccacttgtacaaaaacaaaccagtcatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattcccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcgacagttaaagagtattccagattcctccctccaaaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagttagaaatagagttttaaaaaactgtctgttcatatagttcatctgcttaataagtaagcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgactgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcccaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggcgttgccagagaacttacacaggagcgtttctgctggaatcagctcgatgcctcttgaggacagagactcccagaggaaggagcaggcagccatccttgctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcccacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtaccaaacatacaaaaattagctgggtgtggtggcgtgcctgtaatcccagctattggggaggctgaggcaggagaatcactcgaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtgtggtaaggtagatagatagatagatagatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttctaaaacatgttgtatgtgggcccatttgccatgtgtgtgtgtgtgtctgtctatctatctatctatgtatctatctatctatctatatatatatatatatatatatatatatacttataatgtggtgggttctcgaatcacagttgtaattcacatttttctccaccaattctgataacttgcattaagaaattgactgtgtaagttaaattttagatcaataatgcaaattgcaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatagagagcattctgttagatacagagaatctctggtagatataaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccacagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagaaagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttgtttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcccccaccgccagccctgcttaaattatcccctctttttaaacaaaatatcctaatcttggaagtggcatatcatgttccttcttttttaagagagaaggagaaattcctgcagatcatcagggactgaggctaactgaagctttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctccccttccctcccctcccctcccttcccttccctttctttctttctttctttttttttttttttttcagacagaatctcactccgtcgtccaggttggagtgcagtggcacgatctcagctcactccaacctctgcctgcctggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcatggtggtgcatgcctgtaatcccagctacttgggaggctgaggcaggagaattgcttgagtctgggaggcggaggttgcagtcagctgagattgtgccgttgcactccagcctgggcaacaagagcgaaactccatgtcaaaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagtctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcaggctgtttgaaaacacacacacacagttttccagtggctaatttgaaaaatgtcaccgtattagttttcatttacatctgtcaggaaacatatctatacataaggaagttttttttttttttttttactttcaccaggtatttttttgtggagtatgcatttaattcacatttacaaattggtttctgtttttaactaaagatactttttcagcagaaatgatgtgtatgatgtcatatctaacttttgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacagtgtgctgaggtttcacattgttacatcctacaagcgtgcttacctgcatcaccttgctgggctgtttcagcattggaatatcactgggaatctcaagttcccaggagccaaccacgagagcttcacagctcagaattttcaagatgtggatgtaggcagggagcctatgtagtaattcaagtaagcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttacgttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctgtaagttggggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttacccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttgtccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatcctctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcacagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaacttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcggccagtggtcactgcagtttaacagattccccccgggtgtgaaggaaagcgagataaatgcaggaaaaaggatacattttgaaatctggaaattttacataacaggcatcagatttgaagaatgtccaaaatattacgaatcatagcacaacctttgctaacaccgtggaaatttttgaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtccttctgtcctgggacccaggtgtgagtgcatagggaaaagggaggagaaatttaatcctgtaactatctccttatggaaaacaggaaaccacagatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaaatatttctgaacagaactaacatcagaatcatctgaatcatcagaattgtgtattttggaaaaatcggattcatcaaatgaatcttcagccaacaactgttcgagaattatgttaacatcacatgcaggaatgctacattttctcggatttgacattttcagtgatggagaactattatattttgtaaatggaaataccactactaaaaacagaaggctataaatagaacgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctccgccccagtgattcaaatacctcccattacggacatgtttcaacatgagatttgggcggggacaaatatccaaactatatcaggatcccagcagactgggtgggtggaggttcagggatatctgggaaggactaagaatagctttttcttttagtagatcaggagtttcctcttacacacaaaaagctccaaatttaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcgaaaacaggcataaacgacatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttaatcccttagttttgatgatcttttatgggttatattcttcaaagggaaaattctctccaaatggggctgccactggcagacgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacggagtctgagaggccccgttccctaatggtaaaatgaggtccaattttgcaaaaggaggcacctggggaaacattctggacacacaaatctatagcttctaccgtcaatctgctatgatccttttatggttctgacgttgcaattttatttttgcatgtttctagagacatcaggaggggatcttttcgggatgtggcttcaaaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaagtgagaagagtggcttagaacagggaaaatgtggccgggcgcagtggctcacgcctgtaatctcagcactttgggaggcctaggtgcgcagattacaaggtcaggagattgaggccaggctggccaatgtgatgtgagaccccatgtctactaaaaatacaaaaaattagccgggagtggtggtgttcgcctgtagtcccagttactcaggaggctgagccaggagaatcgcttgaacctcggaggtggaggttgcagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattgtacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcctaaacttacatgttaacataaacatggagctcagaggaaatgtgttgtttgagatgaaccatcgtttcaaatgtcacttacttcttgttttataaagtatcattactcttttcttggacacagtctcatctttgaggtgtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaactaaaaaaaaaattaagttagaagggagggattacgaccctcatgtgtatcaagaaacaagctccatgaagccccataggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcgcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctgtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccaatcccttgtattttagaagagcctgatacatttgcaaggtctctctttatattcctgaattttgcatccctagacatcatcctttttgagagagaaaattccgagtgtcagttttcctttatcggaacctccttttatttgaactaaccacaatgggtcataatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctacttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattcttggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacagtgcactttctctctctctttcttcttttggtttatgatgtttttcagtagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaacgtttcttgggattttcagaaaggattggcttggctttttatcaaagttacacaacggctgtaaaaaataaataaaaaaaaagcaaaattagcactttatcaagtttggggcatatttccaaggccaccagggagcagggaaagtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggcttatgagatgaggatgatttttaccttttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacgtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatcttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccatttcagtctgatccggtcaattctggtaggacttcatccaagcacaaagaaacctttgttttcattcaagacttccctaaaaggtggctgggtgcggtgcctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggatgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctctaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtaccgccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtcaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtatcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatatgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttctctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatctttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacatttatccatccatctacccacccatccatccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttaggattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtatttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagagacgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatttcgctagcattgggaaaatccccattttcctcactatccatttttcttcctctctttccttcctcttttcccttcttcctctttttttttcttttctttccttccctttttccttttctttccttctttccttgccatttaaaacatactgataacttggcagcacagggcagtgattaaactcaggcactcaccccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttccttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagccccagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtgaattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcataacccatttccaaccttctgggttttttccttcaacgtttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgtttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcagtagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatcccgacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcagtgtctgtcttgtggtcctgaagtctaactctaatcctggctccactacctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatcttcccttcctcctccttccccctccttccccctctctttttccttttctttctatcatcatccatagctctcttgccccattgttttaaacccatctgtttttgttgctggtaactgtatccaaaagtaatacagaattttccgtaagaacatttattgtgtttccttctacccacgaattttcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacttagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttaatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggcgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtgatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttatattgctagtgagtggccagctggagttgtaggtctaattctttttttttttttaagacggagttgtgctcttgtcacctaggctggagtgcaatggcatgatttctgctcactgcaacctccacctcctgtgttcaagcagttctgcctcagcctcctgagtagctgggattacaggtgcctgccaccatgcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatgttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcagcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaacccaggacgcagaggttgcagtgagccgagatcgagccactgcactccagcctgagcaacagagtgagactctgtctcaaaaaaaaaaaaaaaaaagtacaggacatacgtaggacccctgaacatttatccccctgctgccagtacgttacagcaaccaccaagtccacctctatcaggatggtgccaatttgtggggtttttttttttttttgagtcggagttttgctcttgtcgcccaggctggagtgtaatggcgtgatactggctcactgcaacctctacctcctgggttcaagcgattcttctgcctcagccccctgagtagctgggactacaggcacaccccaccctgcaggggttttttttttttgttttttttttttttttttttctgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtggtcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccgggaagcagaggttgtagtgagctgagatcatgccactgtactccagcctgggtgacagagcaagactgtctcaaaaaagaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaatttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaacatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatacgtatatatatacgtatatatatgcgtatatatatacgtatatatgcgtatatatatacgtatatatgcgtatatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcgccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaacccaggtagacctgaattaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaatgagtatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcccccgccaccatgcccggctaatttttttatttttagtagaaacggggtttcaccatgttagccaggatggtctcgatctcctgacctcatgatctgtcagcctcagcctcctaaagtgctgggattacaggcgtgagccactgcgcccggccggggatcttgtattaatagtagggagacagtaagcaagcaaggctcagttaatgataaattgttatcaggagacccagcagtttctgctttttctaccctcctctttgagctctatttaaactaataggttactgggtttgaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggtcaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtgtgcatatgctcagttgcagaaacctaaattgctaaattgcaaggctgtatatgatatgccaatttggcatattctgtctttttatattctgccacccctatcatacttaggaaaatgccaggttgtaatcattcactgggagaaacaaggggttgaacgttgttatcgcgcaaaggaagctgggcctagtaaaggaatgtaaatactaaaatgccagcatcactgttacttactgtgtttctctggatgtattacttaacctctctggctttatttctgcctgccctccccccgccccccccccccgcaatgcctcaatctgtggcagagttgttacattattgaaaaagaacataaagcatattttctggcatacagcatatgtttaatttataatttttgtttttatcattaaaagcaacagattgctgtattcttgcctgccactgacatggacttaattgtttcatttagacatttaagtgggcaatacacttaaaatgcagatataactttaattgtcaaaacatgcttattttaggaaatgtgtttctccagtaaagctcagtatctggggctttttcggttgtattctatatgaatcttgaatactgaagtttctcaccatggagatgacaaacacataaaatgtttactttgcaaactgaatttctcttgctgctttttctgaagttccccagaggctcatcatcatcaataccatcaattaatagtcatccttggcttcctcgatcctcagcactgcgctgggcactgccccccaggagcatccatgcacctcaaatcctgaccttgtgactttcaagtccctaagtgaccccacactgaagaatctggtgaaggccatccaagcccagagttcatttaagtggcagcgatgggaccaaattataggccaggtctgtcttatgaaagatgataaatggatgtgtcatatcgggaaagaaatcactctgtcatcatatgacaggctggcttgatttctttgcaccagtgtccctaaaagttgggatgggggtgtgaagcgtgccagctttcaaagccagttgtcactccattttgtgctgtacctccccagttatgaatctggggcatcttcactggactctccaagccccagtaccctcagtgtggaaggagaaagcatgacccactgggcaggacacagaaggcttctgtgagaatgaagctctatcatgcttgtagaacatggagcgctcagcaaatacaaatcacagcccatctcctccaatcatttggggtattaggattcccttcactccaactcccactggaaaacctctttgccatgacacagagattccacaatcttctatttttatttaaaaatttttttaaagagtgatctttggttttctcagtagatgctttcctctgaatagcaagcatatagatagtcttctccttcagacccccgaccatggctatattatttagtctacagtggttctttgtacaaagtgcttctgcaaagctcttagagcacccagagctggctttggaaagcaagacattaggaatgagctagcctgaatgagtcctgatttttttttttttttttttttttttttgagatgatcttcttctgttgcccaggctggagtacagttgtacaatcttggctcatggcaacctcaaacttctgggctcaagccagccgcccatctcagctacttagtagcttggattatgggtttgtaccaccttgcctggctaatttgtatttttagtagagatgacattttgccatgttggccaggctggtcttgaactcctggcctcatgtgattgccccaacctcagcctcccaaagtgttgggattataggtgtgagcctctgtacctgagttctgatttcttaaatttcacagtcccttacctgtaactcaaattcccgaaccttcaaaaaacaacaagtggcagcaaaacttgatttggaattgtcgtggtcttgtttataatcgtcatttttcttgtcatgtgatttgatgtttgggtatatgttaacacctcactagggatatttcatagcatatgattgatgtaagtcgtaaaaaatttagaatccttcaacacatacttggattttagatgaagaatcatagatttttatttctgtggctttggatgagctgtttaattttcatttcaagttgctggtaagatgatgatgataatagagataatcctgtaagaatgctgcaaagggttagtactttattcttgcaacaagtatttattgtaggcctgtattcaaaggagaataagataaataagatcgaatgtggaaattagatgaatccggagttagtgcaatgaaagttactaagagagaacagaaatactcttgataatgctgatgtgactggacttttgacaagcagtctgggacttctgctgaaaagtgctcttgaagccaagcaaaatcatttccacaccctcagcacctccagtttttcctggccttggtctcagggtggttgaccttttgccgatgtgtttttcttttttcttttcttttgttttcttttcttttctcttctcttcttttcttttctaacagtcttgctctgtcttccaggctggagtgcagtggtgcgatctcagctcactgcagcctctgccccctgggttgaagcgattctcctgcctcagcctcccgagtacctgggactacaggctcccatcaccatgacaggctgattttcttttttttcgtaggacgaggtttcagcatgttcgccaggctggtcttggattcctgatctcacatgattcaccaaccttggcctcccaaagtgctgggattacaggtgtgagctaccgcacccagcctgctgatatatttttaattatcataagaaacagttaaagtgaaattgcaaccccatggtatcggtggactgaacgtttggttctcatttccttgagatggtagtttcctcctctggctacttttgtccagccagttctcctctgtgggcatttggggaagggctctctgatagaaatatgaaatgatgagggatgcaaaaaacgtggtttgtttcttagaacaacctccaccacgaaggttccagacagagtgaaatttctgtatttgctgaccctgtcgccagtagcctggaataaacagcaaaaatagttcttgaggcttcgtggcaaatgtgacctacctttgtagttcttgggtaggtgtgtgactgtggcctatgaggccaagttgcaaggtctttggatgaactttgtggcatctggcaatgtccccagtgcaacctatgtaaaatatagcagtttcctgcacacgcttaagggaagaaaccgttgtggggaagcgtgctctgttattcttgccaatgtagccaacatatacatggggaggtctgttttatgttttatgtttgatggttttttctttttctttcttttttttttttttgagacagggccttgctttgtcaccctggctcaagtgcagtggtagaatcatagctcactgcagcctcaaactctttggctccagtgattctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtaaatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgataattttttttttttttcccctgagaaagtcttgctctgttgccaggctatagtgcactggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggatgctctcgatcttttgacctcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttacgacttcatttgtactttcaaacttcctcctggaaacagaagaaaataaaattagatttttgtaagctgagatgatatgcatgttcttattttcaatacagttagtctctccactttatttttaaacacaacctcataatacaaataatctagtcttttctggagcagtctatttattcagacaggtggaagttgatgctaaagattggcgttaaattgagtaaaccattcatgtagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttcttcatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacattctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagacgtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtattttacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctagctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcacgggacactcctccagcggagtagcctgtgatttgtatgggctgcatgaattcctgcactaacaaggtaaaagaaggatgttaaagaaaacccgagatcttttgggtacatgctataaggtgaaaggcttattccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttccgttgcttataatcttaactataataatcataaaccatgttctgttgctcagaacccttgtacttataatataaaacaatctttttaaccaagattcttcgcttgggtattctgagtagcatggaagagcattatacttttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacaggagcatactcccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggtgtgtgttacattttttaaaattttattttaatgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttgatacacatgaaataaaatttcaaatggttcctctgttcagcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctccccctcttcttctcttttagaaaccttgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcctaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattccgcagaaaaaagtactgattgtccagcagttgtgtcaggtagaaaactgggatgcccgactgcattggtttagccagaactatggccatgaaaccttgcctggcccccagggatggggtgaggggggatatcatatacgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcgtggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgtatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctatgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgggataatctgcctgtttgaaggtcagccaattagcaatcttaatgccatctacaaccttaattaccatttgctatgtaacatatttatagatatcagggattagttcatgaacatattggggtagagggcattccacatacagcagtacctataatgtatatgcttcttaaagaatgcatgagtcttaaatttattttatgtccttggagtgtatagcagagttagatagatccttctggattggcggttgattgaatattggctgtacaaagaaactggataggagtatagagaaaagatcaatcatagcactagcttatagtttattttattctttaatgattttttaaaaatatttctctcacttacttgaaaagcagtcttagaaattaactggaatgggtaatttattcgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattaggattaagggaaaatcaagtaaatcgagaggtaaagcactgtgcagaaatattggccagaagctatgaacagatgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaagtgaacatctgtctaattgttcacctccatcgctttcgtgctttcctcatgctttctctctttccagacaataaactttattttcttcataagaattcagtctacgcaagggtattaggcagcttgtttgcaccttttaattcctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccccccacccctgccagaaataaagggattaatctctttttgcttggcatagggagaagacagtgtctgctgatgtgcttaacttttttttttttttggtcaggtgtgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttagaaatatccagcaagccacttttaaaggctttttatcacattttattcttaagctttctgaattccttattatattttgcctgataaatagttggattttgttttttggttcaatgtaagaatattcttaaactaggtaaactgttttgtttgtcattatgttctctcattctgttaaattttgttttctatttttcatgtttttgggtttttctagatggcctgtctttaacacttcttgatatttttgattaaattttcatatatcatcaaaaacagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtgtctgtatataaaaaaaaagtatgtatacatatacgtatatgtatgtgtatagataaaaatgcgtgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacaacgtagaccagcagcaaactaccaacactgtggaggatcccctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttgcccctccactgagagttggctgaaacaaagaatttgtcctgtacggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgattgaacccgggaggtggaggttgcagtgagccaaggtcatgccactgcactccagcttgggcgacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaatactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggacagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaggcaggagaatttcttgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgagagtactccttatgaagggagtcatatgagttgctagctgggttctctggatggtggtgtcatgccaacatgggagccactagcacaaagaacatgctaggttctgttgagacctgactttgggaatagcataggtacttacctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccagtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgtttttgtaaaagcatcatgcactaggtaaaatgtttaataacacagagaaatctaattgtcaagtatcttctcaacacacattaatcaacaattctcctatcgaaagataacctcttgtatttacaaaaaaaagaagaaaaagtgctgtcatcagtaaattcattcatgtatgttatacactcacatacaaaacgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattagctgggtgtggtggcacatgcctgtaatcccagctactcaggaagctgaggactgagaatcgcttgaacctgggaagtggagtttgcagtgagccgagatagttctactgcactccagcctgagcaacagagcaagactccgtgtcaaaaaataaataatatgtgtgtgtgtgtgtgtgtgtgtatgtacatgaattatatacaaatgagggaaaatatacaaatgagttgaatatatacaaatgagggaaaaattgttccttgtgtcaggaacaattactgtgaattttgtgtagctctttctgactttttaaaattcaaatatatttcataaagttgaaatcacactgtggtcttttttttttttttttttaaccagacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctgggctaaataagaagtttaaatgcaaatagataatgcttgagaaagcttcttcccatatatactctttctgtagcagtgtctgagtgtctgtaccttcctataccttcaccatatcatgtatttgtcattttatagtgagttgtattacttgctaggtgagctggtatctcctctgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgttttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactattcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcacagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaagttgcagaaatagcaatatttcacagtacctctactttcttgtaattttagcagtttacctaatcatggtataataatcaaaactagaaaatagacaatggtgctaaatattaactatacttgttactcaaatttcaccactaaagcagtgtcatctttttattccaggatctagtccaggatgccacattatatttaattgttgtatctccttggtgcctttagtgctttttttttttgagacacggtctcactctgtcacccaggctggagcacagtggtacgatcatgggttactgcagcctccacctcctaggctcaagcgatcctcccacctcagtctcctgagtatctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacaggcatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtgtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcctgtcgcccaggctggagtgtaatggtgcgatatcggctccctgcaacctctgcctcctgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaagtgctgggattacaggtgtgagctacagcgcctggcccctcccccgtttatttctgattcaattactttatattagcgtagattcacaggtatttcctttttttttttttgatttattaatacctccatttattctgttgctgaaaccattccagctttttctggttggcttctatgaaggacgctattttaatggggtgatttttttcttctcactacattcttcctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagcctgtaatcccagcactttggaaggccaatgcgggtggatcacctgatgataggagttcaagaccagcctcaccaacatggtgaaaccctatccctattaaaaatacaaaaattaacaggcgtggtggcaggcatctgttgttccaggtactcgggaggctgaggcagcagaattgcctgaactcgggaggtggaggtagcagtgagctgagatggcaccactgcactccagcctgggcaatggagcaagactctatctaccccccaccctgcaaaaaaagaaaagaaaggaaaaaaaatcctggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactagtattttgcttgcaaagatgagggaagtgagtttccgaagttgctaaatgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgcagtgcagtggcgcgatgacagcccactccagccccaaactcccaagctccagtgattttcctttctcagaccccaaagtagctgggaccacaggtgcacaccaccacttccagctgattatttaaaaaaaaattttgtagtgacagtgtcttgctgtgtttcccaggctgtccttgaactcctgggctcaactgatcttcccagcttggcctcccaaagtgctgggaatacaggtgtgagccactgtcccaggccagttttaactcagaatgatttcataagaaatccacatctgagagtcccagaaggtaagatattcccctttcttctaaatatacttgaccaccaccattcaggttcttctattaaccttcctatatttgccaaccctcaacctgttagaaacaagaaatgggactctggagtagatgttagcaacatcatgagctcaaacccctccagcttacagcggagacagtgaggtcctgtaggatgaggttggagagcaggaacttgcccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttctgatttattaaccatttacttggctttggagaaggcagcatttttagtagtactgttgagcctgcatgtagcttttccaggagggcagggtgcccggaatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgctctttctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcgtgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacattatcagtgtgattgtctccaacgcatccatggaagtgaaaccgctggaggaagctaatgccgtgagccagctgttggttatgtttttgttttgtttttcttttttacttgctggatagtgggttctgtttattgagaaatatttacatccgtctaaatcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttgttttttgttcttttgttttttgtgtgtgcttctgcgtgcccctcctctatggctccccccaccaaatttctgtgtcttcatttgcaactctcttttctccagtaaagaggaaagtgtatagttctcctttccttacagaaacattattttgttattgttgttttggtttgggtttctgaagtataaatgcatatgaactggacagaagtattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacactcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttactatctggccctttagagaaaaggttttccaatctctgttctagaggattcgtggtcatttggaaagaaaagtatgttaagacaaaatgagcaggtggttggattagtattttctttctacacatatagaaactgttcctatcatacgtgactcagttttcaaacttgcttaatccaaagcctggggggtggatgtaggagagaagttgaaattagctggggttttttttttgtatcacaaaagttacattttttttttttttttttttttttttttaagacgtagtcttgctctgttgcccaggctggagtgcagtggtgtgatttcagctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctcctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccatttttttttcaactcatcagctatcattagggttagtgtattaatattttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagtggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttctgcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtgtgcactgacagaatggtacatcccaccactgctctgtgtctgtgtgcgactgtcagttgctctctactgctcctcatagacttcctgtctgcctttctctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggccgaggcgggaggatcacataaggccaggagtttgagaccagcctggccaacatggtgaaaccccatctctactaaaactacaaaaatagccaggtgtcctggtgcatgtctgtaatcccagctacctgggaggctgaagcatcagaatcgcttcagcttgggagctggagcttgcagccagccaagatcacaccactgctctctatcctgggagacagagcaagactgtctccaaaaaaaaaaaaaaaaaaaagggcatggatctagatgccagacaatctgggtgcatatctttgctccaaaagcaaagattgtaaactctctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgtttttttttttgatttttttatgtcattttaaatgtttctattcttctgttctgttcttaaagtatgcctgtaattattaggatataattatggattctgtcttatttattttttaatcttcttattgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggggcaatgcattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatttcttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttaagttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtgtccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttaggggaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgacattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgaccttgtggtccgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcggcctcccaaagtgctgggataacaggcgtgagccactgcgcctgtctacattttctgtctttactggtattatggtgggaacccataaaccactgcgaggcagataccattttaagcaggaaaccttatttttttccgaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattctgcataccaagcacatatccgtcacacgcagtgtggccaacttccgagaggccggcattcagccaaacagcctgaagaaccaggagaaatgcctgagtttccaaatggcttatggtaagttgttgctgccactatgagtagcctacttgcatttctatttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggatttttttttttttttttttgacggagtcttgctctgttgcccaggctcgagtgcagtggcatgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagacattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtctttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagacttagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcctaaaaaaaaggaaatccagggctttgctagggatcatttttggtgtggttctgtgttttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttccagtgaagatgcgatcacccattgccaccgttaccattacttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgacgacaggggaacagcccagtgtggcagtcatgtgacgacatgagcattggaaccagccacatctcagttggcaacacgtatctgtgtcttactagcttggccactgtcacgtcactcagcctctgttttctcatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgagtacatgaatttagtcctgtaaatgttttctcccttatttgggacatggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccgtatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagatccttccagtagctttcctgaagtcaagttgccagtgcattggacatactgggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatactagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtaggtagagtctgtatacataatttaaaatacattaacatttctgttttgcctgagataagcttgtactggtgtgatcagaaggaagaatgaagatttggggaaggaaaattttgagagccattttacagcatttcaagattcagtgatctcagaacctcttttggttaaacaagcatgggaggatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaaggaaatgtgagcagaagcaacaccagtcactattaagtggaagtctttgagatgccacgtgtaactcaccacattgccttccacatgccgtagaggctggcagtgttacagacaacagaggctccatccacctggtccctgagtggccacggtgagctgggcccactgacctacaatgagtgtgaagtgtgagcaagtcataattctgggttattctaattaatggagatttgggggttgttccttactgaagcacatcctgattgatgcagaggatcttgtgagccatgctaaggaattcagcccacgtcttactgaccactctgacgtactaaagggttggttttgccaatgaagagagcaggctctgactgaacgaggcctgaacttttcatgttctagatggcatgtgctaattctaacacttcttaatgaaagtcatggtttgcttggtggtgatggaacagttctatgtcttgaatgtggtgatggttatatgaatacatacacatgataaaatgtcttagaattatgcacaaaggtacagcaaagaaaataaacgcatctcaagttgtgttagttccttctcacactgctatataaacatacctgagactgtgtaatttataaagaaagcaggtttaattggctcattgttctgtgttcatgttctgcttctggataggccttaggaaacttccaatcatggcgaagaggaagcaggcaaatcttagcaggagcaggaggacgaatagggggaggtgatatgctcttgtaaacaagcagatcttaggcatactggatcacgagacagcactagggggatggcactaagctgtttttaaccagccccatgatccaatcacctcccaccaggccccacctccagtattggggattacaatttaatatgagatttgggtagggacacagagccaaaccacatcaggtgacatcccagtaatgactgtggtctagtaaattgtgttgtgttgatgttgattttcaggttttgccattgtattgtatgtatgtaagatgtatatatgggggaagctggatgatgggtatagggtgttctctgtaccagtttggccatgttttgtgaatctataattagtttcaaataaaagttaacaaccagaagatcatgagctaaaccaataaagtgaattatggtcagttgcagattcactgccagacctgggaggaaatctcaccttggcagatcgagtctcttgtcctcgcctaacaatcagcagttcacctctcgaaaaggggttccgtttgcaatctgtcagccactaccttcttatttagagcatgtcccactacaaacatttctataaagttactaagtttgttagacaattagaattgcaaacccccaacacacacataaacacatatgcacaccctaatttaaaggctgcattttccatcccctggacttactgtattgcctccagtttctctccatttctcaggattggtagcagaaatgggaaacctgatacctagggcaagagaattgcctgaataacagtgtgtggacttgaatcactatccccaggagcctagtaacccacagcttgtggattagtctgttgaactacttgatggcttgtgacccctttttcccttagagttatatgttctgattttcttcttattgatagtggcagctctgtgctttattttgaagggaagcaggggaaccaaaagaaaacttagcagttgtaagttacttacagagaagactgggctagttggctgtgctatcatttttgttgaaatactgctttggggtcgccatctgggaatgttcttcctgttttatgggggaaatacatacatgcgtttttataatatgtagcctgcatatcccttggggtttccactgggggcttggctgagcagagcaatttctttaccaccccctccacagcataatgaatggctgcctttcctcttgtgatacattcacatttctgtaagattctgcacgtggcagtgagtgtcatgctccaagtaaaacgaggcagggaccagaggacttaggatgaggatgaaaggtcactttgtttgctgactctgaatgtcaggtagttgtgtttatgaggcatcagcgtctctgtggggtattgaaacatttacactttgaaaatatttttaatcatcagataaatatcagttactcagacagcttatgagggttctgctcctcatctggaggtacacacctttcacggggtgtgacttcaccacatgccttcaatattcttggtggcagttgccctctttataggggggatgtggcgtcaccttatagcagaccctctagctctgttatttcctgaacgtaggaaactaacaacccacgtgtgggcgttttccccttttcctagatcaggttcatgtttctcctcctcgttccaaaatctgcacactttggcatctgccactgttacccaagaccaggaatttaaatctgtgtttgccagtttgcctccaccactgatgtgctgttggggtttggggacataatttcatcactttctaccacctttccttaaaactaggctttgtgccaggtgcggtggctcacgcctgtaatcctagcactttcggaggccggggtgggtggatcacaaggtcaagagattgagaccatcctggccaacatggtgaaaccccgtctgtactgaaaatacaaaaataagctgggtgtgttggcacgcacctgtagtcccagctagtcgggaggctgaggcaggagaatcgcttgagcccaggaagtggaggttgcagtgagccaagatggtgccactgcacttcagcctgggcgacagagtgagactccatctaaacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagctgcaattacgctgaacgtctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttgggttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgctaggcgggaacttgggcttctttatcagtgactggggtcagttcttgtactcaatttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcgtcttatattaaacaggggaattccgacatgttccataacacatttactgtaacttgataccatgaactacacttgctgttatttatcatttctttttattttctctcattgcagcataaagccaaggtagaagcaatgaccctggacctcgctctgctccgtagcgtgcagcattttgctgaagcattcaaggccaagaatgtgtgagtgttccagtggagggttatagatcataatttcttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgtgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgtaatcccagctacttgggaggctgaggcaggagaatggcttgaacccgggaggtggaggttgcagtgagctgagactgaaccagtgcactccagcccgggtgacaagagcaaaactctgtctcaaaaaaaaaaaaaaaaattgactcaggctcttgctggagtatgtcagtgtcccaagtcactgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccacccgttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtatgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctcttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgtgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacgtaaaacaagaaacatttcttttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggattgtctagttctaggaaaacaagctcagggctcccaccgattgtacattatggtgagttggataactatttcattatatattacaacgtaataataatagaaataaagtgcacaataaatgtcatctgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgattgccaaagccagttttcttcaggcccagcacgtcctgacctcctcactcctctgcccactctctgtttactcactcccattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctatattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaaggttaaaataacggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaatatgagaaatccatttttggtttgcctaacagaagatcatcttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccatagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatatatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcaacagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctagggtgacaagagccaagagaaattattgttactgtagtgatgttccactgaggatcataaagtactttattactctactgagtatggttttttgttttgttttttctttttctttttctttttcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgccctcacctcatcatttattcagcagtcacaacagtgccaagaacttggctagagattggaaataaagcttatgccttctctcatatctcctgtaccttatttctttcttacagtagttgtgatgcttagcagttttttgataactttttatgatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctctcatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttggacggtggcccagagaccctttaaatgaaattcattttactagcaccctttttcatcatgagaaatatattctgtttttcttagaaaatgggttatgttaggtctggtcaaggtaaataagtgttgagagtcgatgttgtgtgcatagttaatttcaattctttgaagaaactcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgactctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgttgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttcggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctctacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttcggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcaatctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaccctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagataaagagcaagggaagaattcctggagaaaggaagagtttcctgagtcacctttgggaggtaggaagggtttgacatgtaggctgggcatctgggaacgagtgagggattctgtgagccccatctcagtggaccactcaaggaaggtgggtaagccctgggtataagtgtgtaagcagggaacagaaagtactgtgatttaaaatatgttaatttttctactgtacagatgagagccagcttggagatgggctgtagctcaagcatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccagaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctactccataggcagagcagcaactttggctgttggactaaggatatttatagttaattattgattagctataatatattttaatataatatatataattataatacaatattatatataatatatattttatgtaactataaacaaggggtagattactcatgagttttcacggaaaggggtaggcagttcccggaagtgagggttcttcccctttttagaccatatagggtaacttcttgatgttgccatggcatgtgtacactgtcatggtgctggtgggagtgtctcttagcgtgctaatggattcatattagggtataatgagtagtaaggatgaccaaatgtcgttgccatctttgttttggtgggttttggccggcttctttactgcaacctattttatcagcaaggtctttatgacctgtatcttgtgctgacctcctatgttatcctgtaacttagaatgcctgacctcgtgggaatgcagcccagtaggtctcaatcttattttacccagcccctattcaaaatggagtcactctggtttgaatgcttctgacaaacctctgagactaaggacaagatggagtctgttaggttagttttaatttcctcagttattatttcacaaagggggtttcagaaagatagaaaatgctagaaagagacggggtagtcagtggtagggatcttgaggggttaaaaaagggaaggagctggtccctttgcagtaggaagtgccacctcactccactcttgccagaaagcctggctctgtcataaggaatcttggcccattgtcactctcattgatgacaacccccgcccccaccactaccaccttaactactgaggggatgtcctctggcccagaaggaatgcattggctctagttgaaggggttgctggtttgtaaatagcatccccacagtcagcagacacagagaatgccatggggccactcatcagaaaggtggaggggctttatctgtgggtagatgagagccatgtagaacctgcatgctgccttccattggaatctcaggctctaaacaaggaggacaaccttttctgcccttaatcacctctcacagatgagaatccacccaagaagaagaaaaaaaatcagccccttaaaatgctgactagtaacatcagtttttggaaggatactatttttgtttccattctgtctttatagtttgaacttttccttttcatagtctgtaaatattcatcatctcagagccttttgaattgcaatggcttttagtcaaaactgagcgcaatgtgccatttgaataataagaacctcattaaagtgaggcaaaagtaattcttttccttttgtacaagccaattaagtgtctttacaattaaaacaaagtcaagcactttatagtttcatattccacaagcctgtttttaattaatagaggtgacaagttttaggtacaggatacatattttgcctctggagttgtgcaattaacattaatgaagggtattaaaatttggtgagagaggaaagggttttcccaggtcctctgtgggttcttgcctccaggcctgtctttggtagcaagttccttggtttgctgaggtttgcattttcttgagagaatgtacaggcaagaataaaagtaactagaagagacattgttgttattgagaagtatgaagttaaaattcccaatgtccaggcctgtcttaaaattaggtaaacactgcagaaactatctttgaggaatttaattttgtcttgtggataaaagtgaaggataaagaggagaaataacaattatctaagctggcaggccagcaagatactggggctttacttctcacaaccatgggaggagtatatttagtttacaggggaggacacagattcacaggggtgaactaactggccatgagtcaggtaaggaaaataacatggctgagctacagtttctctaagaagttggttctgtccatttcagggagcttatgtaagacagaaggtattgtgcagtagccttgaagtcaggtgaccctttgggggtgtgtgtgtgtttgcttctttatattagcttttttttcattttgagacagggtgttgctcttcctcagttgcccaggctggagatcagtggggtgattacagctcactgcagccacaacctcccaggttcaagagatcctcccacctcagcttcccaagtagctgagactacaggtgcatgccactggctatttttatttttttctttttagttttgagtttttaattttttgtagagatgaggtcttgctatgttgtccaggttggtcttgaacccctgagtccaaaagatgctgctgtcttggcctcccactgtgctgagattacaggcatgagccaccatatctggcctatgttagctatttctgaaacttcatttctgtctgtaaatggcaatcataatatatgtcacgtagggttcttaaatacaaaaagctcttaaaaagtgcctaacccatagttagtactcaaaaaaggaaaaaaaagtattaatagccctggaaaagtgagcaaaatatttcagatgcaacctgaaaggagttcaaatgtaagtctctcttcactttgcccatctttccctcttccccgcaaggtttttagcagtggtcctgtcttactacaatatatgaattatccctgctacaaattagtagattctgctttgatttgaagcagagtctaatgagtgttacaggtaggctcggtgcttcaaaggatttctgcctatctcttcacagagtagctgggctattgagggactgtgtattgacaattgtagtgggcaccctatgtggaaaacaggtgttgtcaaataactgcaactgaccccaaccacaccatgacttttcaggttttaggtaggggatgggtgggaaaacagatgaggcaacagaatgaattattccttaataagatccagattaccgagtgataataagatttgcatgaatacttcaaacaacaacagtgattaaatacgtttttctagttaaaaaattaatgagtgctttccagcaagcgcttaaagaattaatactggccgggaacggtggctcacgcctgtaatcccaacactttgggaggctgaggtgggtggatcacgaggtcaggaggtcaagaccatcctggctaacatggtgaaaccccgtctctactaaaaatacaaaaacaagattagtggggcgtggtggcgggcacctgtaggcccagctacttgggaggctgaggcaggagaatggcgtgaacccgggaggtggagcttgcagtgagccgagattgcaccactgcactccagcctgggcaggagacagagtaagactccatctcagaaaaaaaaaaaaagaattaatatcaattttccacaaactcttttaaaaaaacagaagaggaggaaacactttccatctgacactgtgaagccactattactctgacaacagaggcagacaaagatatcacaagaaaaggaaactttaggtcactttcacttataaatagagatgcaacaattttgtacaaaatgctagcaagccaaatgcagccacatatacaaagaattgtatattatgactaagtggaatttatccaaacaattcacggttggttttatattaaaaaatcagtcaatataatataacataatagtagaataaaagatcctctcaatacatacataaaaacatgttttaaaaaggtccagcacgctttcttgatgaaaacttttagtaaacttggaacaaagtggcattttctcaactcaataaagggcatctgcaaaaaacccacaaatgacatcataattaatgctgaaagattgagtaccgtccccttaggatcaagaaataagacaaggatattcactctcatcactttaatattctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatctatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagaacttttacaattcaataatgaaaactcatttaaaaaatgagcataagatctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcatttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtagatagagggtggctagtgattgctaatttttttttttttttttgagttaaaaaagtgctataaaattagaatgtagttatggttgtacaattatttgagtatactaaaacagctgtacagtatacataggtagattttatggtatgtgcattatatttcagtaaagttctttaataaattagctaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttgaactcctgggctcaagtaatcctcctatctcagcctccgaagtagctgggactacagccacacaccaccacacctggctcactttcgggtggttgttgttgagatggggtcttgctgtgttgctcaggctggttttgaatactgggctcaagtgattatcctgccttagcctcccaaagtgctggaatttcagaggtgagccactgtgcccagcctcctgttttttttacatgtatatatatatatatatatatacacacacacacacacatatatatatacacacacacatatatatatacacacacatatatatacacatatatacacatatatatacacacatatatatatacacacacacatatatatacacacacatatatatacacacacatatatatatatacatatacacacacacacacacacacacacacacacacacacacacatatattttttttttcttttagatggagtgtctctctgttgcccaggctggggtgcagtgacatgatctctgctcactacaacctctgcctcctgggttcaagtgattctcctgccttagcctcccaagtagctgggattacaggcgtgtgccaccacgctgggctaacttttgtatttttagtagagatgggggtttcaccatgttggtcaggctggtcttgaacttctgacctcgtgatttgcctgcctcagcctcccaaagtgctgagattacaggcgtgagccgccatgcctgcccttatttttatatatcttccataacctttctatctctttctttctctttctctgtttctgtgtgtgtctgtgtctgataataaaatacattaaattttattttataacataaatgttttataaggtcggtagatttgtttatgattttaatggctgcatagtattctatcatatggatatattctaaatgtaataattcctcaatggtatatttagtttactttatatttgctgctttagtttgtcacaaacaccgtggatagccttgtatatatttattttgttgtatagttcttattggtacagtatgatttttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaaattaaatatatacaaaataagggagaatactatgacaggcttccacttacctatctttaggcttctttataaaatgttcatttaatctgatctctataagaaattctgtatccttaaacaacatgtgcccttctctttacacagagcgattacccccttgctatgttttattaacagctagcaagtgctgggtcctgtgtcagttgttttgttttttctttttctttgtttttcttttcttttcttttcttttttttttttgttttttttttttttggagatagagtcttgctctgttggtcaggctggagtgcagtggcatgatcttagctcactgcaacctctgcctcctgggttcaagtgattctccggcctcagcctcctgagtaactgggattacagacatataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagggtatcctatttctacatggtgggaatctagaagacggagaaagaatttctcattcccgaaggagcatggattatccttggttgtagtgtttatgtccacatcacgtggattcccgaaggagcatggattatccttggttgtagtgtttatgtccacatcacatgggatattttatttttcaggcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctctcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaataataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattccttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatcctttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcgg

SEQ ID NO: 397 - DNA, 20686 bp, Homo sapiens
actcagaaataagaccacacatctacaactatgagacttcagtggccacatacaataaagaatacagtctatacaaaaatagtttagaaaatgtaattttcacagttaccacattataatattgaaaatgtctagttttcaacttcaaaaaacatggttatgcatgtatgaaagtatgactcattcacaggaaaagcagtagaaagaaattgttcctgaagaacaatggactgacttactagacaaagactttgaatcaactgtcttaaacatagtcaaagagctaaaggaaaccatggacaaataactaaagaaaatcaggaggactatgtttcactaaatagcagaaatcaataaataattgtgaaaaggaagcaaatggaaatctggagctgaaatgtacgggaagcaaaatggaaaattgactggagggcttcaagagcagattttagtttgcagaatgaagaatcagtaaacgcaaacataggccaattgaaattgcccatttgaggagcagaagggaaaaagtatgaagaaaaatgaacagaagaggtctaagagacaacatcaagtatatgcattttgggagttcccaaaagagagaaggaagaaggggggagaaagagtatttgaagaaataatgaccccaaacttctgaaatttttttgaaaacatgaatctgggtatccaaaacactcaaacatttaaagtagcagtaattcaaagatgtccacactgacagacattatattgaaactgtcgaaagtcaaagacaaacagagcatcttgaaaacaacaagagaagggactcattgggtacaaggatcctccatgagattaactgccaagtgttcttcagaaaccatggagttcagaagacattggcctgacaaacttaaagttcagaaagaaaaaaaaacctgtctcaactgacagttgcatatttgacaaaactctccatgagaaataatggagaaattcagacatgcacaggtaaataaaagctgatggcattcgtctctggtaaacctattctacaattaatgctaaaaggagtgcttcacactgaaataaaaggacattagatggcaacttgaagtcatatgaagcaaagaagtacacagctaaaagtaacttcataggtaaatagaaaagcaagtattttttggggggtggtaatttgtaactcctcttttgttttctctatttaatttaaaagaaaatgcccatcaaccgatgaacggataaacaacatgtaatctattctgcaatggaatattatttgaccacaaaaggaataatgtactgatacatgctacaacttggatgaaccttgaaaacatgtcaaatgaaagaagccagtcacaaaaggccatatattgtatgactccattttaataaaatattcagaagaagaaaatctagagagacagaaactgggttaatggtgccaggtgctggtggcaggggagagtggaaggtgactgcttaacgggtacagagtttccttctagggtggtgaaaatgctctggaacttgatagtgatgatggctgcataatgttgtgcacctactaaatgctactgcattgtacacttaaatggtcacaatggcaaattttgtatttacgtgcattttaccacaactaaaaagaggctggcaaatatattccaagtttgcttgggaatctgcccatctgtcttttcccctcaggatttcatctcttattcagagctcacccttgctcttctgcaagtagaaagcctcctttcatgcagggaccagccccacagggtcagtgggtctctccctttgtgtggtgatgagagagtgtagaaataaagacacaagacaaagagataaaagaaaagacagctgggcccgggggaccactaccacaaatgcgcggagaccagtagtggccccgaatgtctggctgctctgttatttattggatacaaagcaaaaagggcagggtaaagagtgtgagtcatctccaatgataggtaaggacacatggatcatgtgtccactggacagggggcccttccctgcctggcagccaaggcagagagagagaggagacaaagagaaagacggcttatgccattatttctgcatatcagagacttttagtactttcactaattttctactgctatctagaaggcagagccaggtgtgcaggatggaacatgaaggcagactaggagcgtgaccactgaagcacagcatcacagggagatggttaggcctccggatagctgcaggcaagcctgactgatgtcaggccttccacaagaggtggaggagcagagtcttctctaaactctaagtctgctaagtagtgggtgttgttccttgacacttttcgctaccgctagaccacggttcgcctggcaacaggcgtcttcccagacgctggcatcaccgctagaccaaggagccctctggtggccctgtctgggcataacagaaggctctcactcttgtcttctggtcacacctcactatgtcccctcatctcctatctctgtatggcctggtttttcttaggttatgattatagagtgaggattattataatattggaataaagagtaattgctaccaactaatgattaatgatattcatatataatcatatctaagctctatatctggtacaactattcttgttttatattttattatactagaacagctcgtgtcctcggtctcttgcctcggcacctgggtggcttgccgcccacactttcagaacacggtccaagatcagccaggtccaaaccccaaaatgactttctgtctcgcttccaaatgctcagatgcaactctggggctaacttcaggggaagttaggagattatccaaataagatggttcactgggagaaagaatgtttggctttaatgttagggaagttatgtttgcatttctaaaaaggatcctgctcactagtgaatatatggtttttgtctgtgcagaatggagttctcagcagaggaatgaaagacagccctaggaacatgatacacctcatgggtagctgactgacccacccatctgccacccccagctgaaggaagcagctagactgtacccttcacccatccttcagttgtattccactggacgtggaccctctacaagtgtggacattcctggatctcagttgctcttcctgctgttgaggagtctccactggtgtggctcatgcctagatgggctctgcaggaggcttagtgtctcccagttctcaaggctaatattcagtgaacccagaccaagcctcaaagtacacaggggctcagattttcatctatgaaatggaagaatccatctccctctttcaggtgtagtggtaattatatatatacatatatatagacacacacatttatacacgaacacatacatgacaatcagtaatctatatattgatggtgttcttagtgttgcctttattgctcagctgaactctataaccaaaaattggatcatggattgtgaaggaagaactcatttcttttctctggtggagcactcggtaggcatttctgccctttgggttcaaatgagaaagtagctttagcctgagggagaaagaagattatgactattattattattattataatagagataaggtcttgctatgttgcccaggctggggtgcagtgactattcacagctgtgatcatagtggactacgtccttgaacttcagggctccagcaatgttccagcctcagcctcctgagtagctgggactacaggtgcatgccaccatgtctggcctcatttcattgttattttacttcaaatgctttattttaaatgttaaaatatatgtttttatattcaaaagtgaaaccctatttgatcacagaagactttaagatgcacagacagttagaaacatcacctagacctttctttaaaaaatcactgctattatattgttgaacctttgtagactgcagtgcaaatggtggtccctggagctgtcttgtgcagtggtgctgattttcattttgttattttctatatatgtatttttatatatgctgtcattttacaaagttgcattcatatgttaagggttatcttggatgttgcttttggaatgtattattatacaagtagttttccatgttataagctctgcataaagtttatacactttttcaagccatatcccatttcagataagaagatgtaacccaacttctttttttggatccgtctgccttcatttcgtcttgttgtaaataatgttttgacaagcatctttatatagaaagattcttctatgtttggaattttagaaaattcatagaatactcaagtgataaacattaggacacagacttttaaacatttttaattattttcatcacattgtcacattggttctctaaatcgtcatactgacatattccacctcacctttcaggacatgctaggactcaaggctatttacgcatctggaatcacagaggggtgttgggggtgaatgttgagtggaatcacagggtcttgagggcaactccctcagagaagaccattaccttttccttagggaaagctggattaacttcgccaaatgtggttgaatgtaactggcaaataattctcagaggaatttaggagttcagtgtctttagcttcattaggatctgcccagatgtccccattctgattttcaggatcccatttattcccaatcaatgccttcacttaaataacagatattctttaagtttgggatttgttttgtgttgtaatttagctacccacagaatgagacgctgcgtttatttttcagaaatttcagccctgcagctacaggagattaggatttcattcaaaggaaacatagaaacttttaggtgatttatgtgactcatgagctggaagtttgcagccctgagttcatctttttctttccgcattttgtccagcacaattggcaaaaattagctaatcaccttacaatagctagtttaacaaagtcttctaaggtctcaaatacatagtcacccagatcttataagtatttgattaggtctatccaatggtgatattctgagtattcacactctctgtactaatggaaatagagtcatttgtgcctttaaatccaaatagattagagaaacaattcaagaaaccccccccccccccgcaccaaattcagtacattcattcttaaaattctgttccagtgtccctatgccccagtaagctaggctgggcatggtctgaggcttggtgggccaaggacagctggctcagctggggtgcactatgcactggtgggtcagcagcccagaatggtgctgggtttatgggcaccaagcctattcgggagttgcacacactgagtcgggctccagtggcccctaggcttctaaggggcactctcctcctgctagtgccaagctaagctgtggggagcagcatgcctctgcatgctgcctgacaaactgcagccccagccgctgccacagacaccctggcctgtaccctagtgctttgtatggctgtggctgttcagcccctacttctgatcccctaggactgggagcagcccgcctgggggagaccatcaggatgtctatggaaggctgcttcatgctacaagggcagagttaagtctttggtatagagactggttggcaaagttgaaaatgttgccccaggtccttttggggattatttaccagcccctggtttgagtgttgtctggcaggacccaggctctgggagctgatcctccctcactcaaggcctgctgcagcctcccgctgaggtcttgaaaccatcaggagcagttgttctttggcctccgggacaccgcagggctgagttgctccctgcctggaggtggtcccatggggcccactgtctgggtcaaggatggtgcagagctggtgtcctcaaaatgcatcctggtggagccccagcagctgcaggtgctgactgcctctcacgaggaccctgggggcctgcagctgcagcgactcacccagcatgagcggtgccactcagtgtgcacatgacagatgctccatcctcaggagatgacaaagacgggaggacaaggtgaagacacaggtgcatcatctcctactcacctcatctggcacattagaaacctgtcctcggctcatgcacaaatccacctttgggtggccacaggctccagcttactacagaggccatgtgtactctgtgtaatcaacacaccccagcttcttcccacctccagtcatctcactgtatctgacatgatgccagcagattgtctcagctcaaattccagctccattacttactgctgtgtgaccttgaccaagtcacttaacctctctgtgcttcacgagcttccattgtaaatgtgtgtgtttacatatgccaagtacccagaaagatgtctggaacatggcaacacccaccacagaagtagtagctgcaattattgcctccttaaaacagtggagatgtcacccatcggggctagagagaatttgggaaatcctgatctgcttctggtttcaggtggggaatcctgtaggaccagcaggaacacggctgcctcagtgcagctggcacagggcactgccagcccagagcaactcagagctcagaacactctggggtccgaagtccgaactgctggggctcaactgtggcgtcagttatggaatgtggacccctccctagggagtctcccaggctcaaagtcttccctcaactccagaaatgcaaacccaacactgacctcacggagttctgaaggttaaggaggagacacgtgaaaagtgcctggtggacaccagggatgccagtgagatgggggacaatggtgaggcagagtggaggggcaggtgccccctcctcagtatgtctcccccaggtgctgtgaggacaggtggaggctgtctccaggctctcacccggccacacaccagcacgtctccaggttcctctcagccccggttacccccagccctgcagttaatccctgagctgggaaggagcccttgaatccaccctgtcctgtgtcacagtgtcgtccacttgggctcacattgccactaggccacttggcagccaagggatggagccacgttttgtactttctgaaacatggcttcaccttcaagtgcgggtgatgacagtgccacaaagaacaaatgttactgtctatcctcatcaaccataattttccagttttccaaccctcagtgagcaaggaagagcatggcttccaccaaagggcgtgaggtcagcagtcacaggggcaaccaacaggcaaagacccctgaaaatagaccccgcagggaagcacaagtattcactgacggtgggaaccccacagatctggccgtcttcaagcacatcagagagattgccatgaggagcaacttagccagaaagacttatttgcctcctcaaaaagcgtaaaattatgtaacataatactttaaaaatttctatcaacacaaaactaatctgggcgcagtggcttccggtgagccactgggacagacggcatcgtcaggaaggctggctctgtggtgcctcaacctgccagagcccaggatggtggtggcctccccagaagcacctggcaactcacctgcacagggccagggtcccagctccccacaccccagccaccacaccttcttctgcttttttttttcccattattgtttctttctttctttttctttctttctttttttttttgtcaaatctcaaggaaaaatacatagttgccagagggtggaaggtcctgttcattcacattgaaaagctcgggtatttctattagaatcacatgttttacttgaggttgctgacgcctgtgtccatctcaacctgggcattgtgctgccaccttccagaagagaaaaactaggtagtgccttgtgaaggggcagcgtttctcatttccgacaacgtcagtcccacagccacccagatgagtagatgggggacacaggggaggacccagacctgctctcctcccacagcacattcttgagtcttggaaagagttgtgaaaatgccacaggtacaaacacctgcaggccactcccacagggacagctccgtgaggcggtgccgctcattcccacaacctcctgccacaggcaacacttaacacttagacagtgacccaaggccgaccagggaggacgccagccaggatgtgtcatcctcagctcttcaggacatgacgccagcaggggcaaagttatccctagcaacaagacagaggaagaaaggaaaacggaagaaaggacaatgtcacagtagcccccatgaccaagagagacggttccagaagtgcagggcaactccatatgcagatgctgttgctgtgcgattacactccaagaggggagtccagctggctctcagggtgctcactgccctcagctgggtgcctgcaggacatcaagtcctgagaacgccaggttctagtggagtaggatgaactgacagatacacagcaaagctccacatacttttccttttctttgtgcctgcaaagttcttgttcagtgtctctctctttcagctactactgctggttggttttaaaaaaacaagacaatagtaaaaattggagacaagtgtttggccataaagagaaacactggctacctcccgtattttcaagcatgggtgatggttgcaaggtgatccagctcaccttgtaggggatgaatccagaaaaagcctctgttacaaatcaaaatggacatgccggaagtattagctcaaatcaaccttgtcctgtctaaccacttactgacccaagataccacttggactattaatctcaggggccagagaatggagctggagaaggagttgttagatcagggacaaataaccatgttatagtggcaacaggaaatggaagaccatttattcataaccatttgaatcacagccaggtgtataaacacacatcattgactgatagtttcagttctatgcccaagaaaatcatcgatggagtgaagtaattgaactatcacagaagatacatttgtattttttcttttttcaacttttagattcagggggtgtgtatatatataatatttgtgtatataaaataatatatatataattaaagaaagcctttgtacagtttgctggagccacagaagcactgctccagagcagagcaatgccttaaatcttcagtgttcatttgtagaacattcactcacagctacaaaagtgacttaattttcttctggaaataatgcttgcctgttgtgagatgttggaatatatatgaaccatcattacatgttaacatgccataaggagtttttgatacctgattcacattattagagttgcttcttagtatccatgtgaattttcactccaaaaacacaagctagaagcttaagtgaaggacacctagggcaaatggtggctgaaagtgaggaagatccaaattactgttgcttgtactgtattaggaaaagaaaacaattcttttcttatttgccaatttaattcttaatttgctaatttgtagttatgcttatatacatttcaacattttaataaagtattttttatggttagctataaaatttttaaaaagattctgttcctctagaaccactcttcgtaccacagtctctatcagtccagattcttcagagaagcagaaccaataaggtgtgtgtgtgtgtgtgtgtgtgtgtgtgtgtatttgtattcatattatgatatttattcatgtgattattagggcggtaagtatgaaaatctgcaggataagctagcaggctgaaaacgcagaaagaagatgttctaattctgaggcaggatttcttcttctctgggaaacctcagtttctgctctcagagtcttctactgatcggatgaggcccatccacattattgatggtaattttctttttgtaaagtcagctaattcagcatggggaagggggtcatggtagacatgggggagggctggtctctccacctcctcacactaggctaacagggacacagacacattcagatgcctttgcagaaagagacaccagaggctcctgaagtcacaaaggggcggcatgaagaaatcctgcatctcagtccctcacaagacagctgcctcaggctacagaaaacaatagtcatgaacaaattcaggtcagtggccataaagcgtaacactctgaactccccactacacactcaaagtgtcccaaagaatcaccgtaatccagtcttgtcccctgtaccccatcccccttccacataaggccctccaggacgccacctttacaagctgtgagagacacatcacagccctggtcactgtcactgcctggggtagaacaaaaacaggacccggtcagagcctgcaggagatgtgggagaggaggaattatggcataggtgagctcctccacatccgtctcccatagttacacacagcctgagcacctccttctctgcctctgggaagaaatcatcctgtgaggggctagggaagagacagggccatgaggtcctagaggaaccccctagtcttggaccccagagaagtttccaaaactgtgactgcagacccagggcaggaaacatgaagaaagcaggtgtgaggactgaaccaactgcacggtatgtaaagacatacttggtacatagtagatacaaagttagctttggtctttggtgaattcatgaatatgattgtattaaaatgtaattgcattgcataaacattataaaatgaagaatacaaaaaattaggaaagattttatcttatacaaggagtgtacatttcaattcactaatttattccaatcgagaaaatgttatatgcttatctgttggtctatgtatgaattttctgttactgcataacatattaccactaactcactggctctacacagcacccatttatttctctacatttccttaatgagaaatccaggcctggtgtgaatgattctcagctcaggatttcacgaagctgtgtcctcatcttgaggctggggtcctccttccagcttatacagagcttggtggcagaattcagtttcaggcagttgtgggattgtagtccttgttcctgggcagctgtcaggtggaggtggggtggagctgttctcaattcctggagcccgtcatatcctttgccacatggccccttcattttcaaagctcacagcggaggaagcccctcacgttgaatttcgctcacactgtgaatctctttgctgaagaagaaataagttgttttaagagctcacctgattaggacagtccaaggcaggataatcatggtcttaaagtcaactgatttgggaccttgcttatatctgcagaatcccttcacagcggcacctacagtagtgttgattgagtaactggggaaggtgaatcaccaggggtggttatgtgggggccatcactgaatcatcctcgcatagccaggatcttccttttgtgtttaattgggtcgtggtaggaaactgaagttcaaataaataggttgttgtgaatgttaataaaatacatcctattgatacatggaaatactgaaatcttaaaaccaaataacactgaatatcttttagttaatttagaataaataaaaattaaagtgtagtaattcattctctcttttgaagcgctattgtctattgttgtataataaataacatgaagtttgacaacccaaaacaacaaatacttatcatctcccacagtttccagtggtcaggaatctgggagagatttccttgagtgcttctggctcagggcctctcacaaggtttattgggggacacacctgtcagagaatatggggagggagccagagaaccctgggaaaagtggcacatccagaggcaaggccgactccagtcctggacaaaaggaaagaagggttgttggacgcatcctagaccacaggcaatctgaggagagttgagcaaggccatggaggagtcctccagccacagatggccaacagaggagtctcctgttgcccaggaatggtctgtcttagtgtccctgctgttacgtgtcagtggctgggaacagcccatgggaagcagggcctctgcaccaatgctgctgagaatgacagagcacgggagggaggccttgggaaatttcctggaaatgcggctccaatcttcctcctgaggggtctgggcctttggaaatcaaacgctgtcagactgggttgctggacgattctgttcacatttacaatgggacaagggaaacaaggaggcccccaagtgaatctctgggttccacacaaactcctcctgcccttactgtgtatcagcagccctgcctcgtcctggggatgagggtccatcactcctgcctggagaggaggggagtgctcttcttccctgcttgtctctaggcccatacagtcctgtgggcaactgtaatgtgtagctcaatgggctcttgtttgtccccttgtctgagtgcctccctgtggaaaaccaggacctcctatactacaaagcccagatttgggatatgagaagtccaagttccacagtgggtgaatataagggatgggacatgcagccacactctcttccatcccttggtttctggacccaagtttcttcctactgagaatacagcaccgtagtgatgtctctgattcaataaatgcaccgtgccctgaaagatggcacccattcctcagtgtttcctccaagctggttctgagttgtgcctgttgaaggcctgtccaatgttctgtgtggccggcagcccccgcagggtgcagatggtgataggatcagtggatcccctggtcatggtccatgctgcacccacttccatttccctgtgaggtgggtcccccaggaagaggctgtgctgagagtaattccaaacctgtggatcaggaatgtcagtggtgctggctgagagtctgagaatagtgggggaaaaagcctacccatggaggaagtttctgtcccagtgaggatgaatctctggcccttccatgatgaggcttaatgtggtcaatgtgtcatttagtggcactttgatcacctaaagaaatagtgcctaagcagggcacatcagggcctatcacgggtgtctaatcctgacaagttggatattcagaggtggcagcagctagttcggccttggtaggtgggagtctcaccttttggaggctacctatgggtccagcagcactgactcccaccgaccaaggccactgagtgacctggaaggatgggcacatgaagggagctattgtgattcctgcatgcatgttcccaccctgcaaggcctgagatggcccccagtgaaggctggctaacttccatttgtctgcttggttgttcagtgccacctcaggggcaggtattttctgggcagatggggtgttaacttggggtttgggctcattccacatggaccatttccatctcatgatggacactgttgggcctgtccaatctataactctgtaggtcacacagaagccaattcatacaaccacttggaattacgtggttctcagtgtcctgtggtcaagaattctatctgatcagggccagcaacactaaaagttgcttcgagaagggggcatatatttctgctgtggatgacatgaacttactccagaatcccaggccctccattgtgactttccccactgatgctcagttcactccatcctgcatctttccccagccctgccacctccagcaccagggggtctgagggatggtggctgcctgcaccacagcctggatctgctgcagagtcctttcctgtgtaggctccacttgaatctggcatcctcctatgtcacccaaaatgtggccaaaatgatatacctagatgtggaatgtggtgttgtcagaacccaaagagattcaccaggcagtccgcttctctctcttttttttttttttctcactgaagatgaaagatgcaacgggtttttttttctgttttcttttgtttttacttggaagaaatatctctgcatgcacctagccactggacccataaaatttcactgcagttgccactcctaaatttctgtaagatttatcctcctctttctggggtgcatgtgttttaccaagacctccagcatactttccaccttctttctcatccatcccaatctatgatgttgccaatgaaatgaacagatttaatattctgtagaatgtccggcatctcttaagactatgttacagatgacagaagagttataatagctctcagggaaagtgtaaataaatgtggtatgaatgtgaataactccatatccactttctagctggaaaggaatgcactcagcaaatcctcggctgcacaccattggcctgcagcctcattaacttctgctagcagtgatatccagccagcatggcagctgcaatcaagaccactacttggtcaagtctgaagtaatcctgttcattctttaggtcctattgggcttctgcaaggacagaatacacggagataataggcaactccagcactatcccacctcctacagctctctaatggtggtgctaccccccacaatacctgcaataacctccaagacctgccctgggacgtaatatcgcttcggttgggataggggcagtttcagaggtttccctttagccttcagcgcaataagagccattaatccacaggttagagacgcggtgtgggggtcactccagctgccagtgcatcaatgccattatgcactcaaggaatagggaactaaacagggctgggactacgggattgtgagctataatgtgtcctggcctctggaagcccctctgtgatgggacacgatggtgctgtaggaatctgggcatcaatgttagttcacacacaaagtcaatactcacccaaattctgcctatttccctttcccggtgtacagtctcctgtgtaaatggctgtaggttcctttgcagaagagttcagggaattgacccagcatatactcccagggtgttccagggttcttcctcctagggatatggactcccctcctctgtcattgggatctgaatctgaaagttaggtgaggtctaggcattgagaacagattatgactttgtcttggatcaaacaccctcagcctcctgctcctcaattcttgctttcttttcatagatatcaagcagcgcccttgctggctgtccttctgttctgaacctgggacactgccctctgttaaccttccccacactccctgcaggtcaagcacaaccttgcctgctctgttggggttgtcatggtaactgtgacctctgacttttgcagatcactgccaccacttgatctagctgaagtagttctagctggaagaatagagaattaaaagaaatctttgtgaagccaccactcaggtttgtcaatttgtaacattttaatattattggctatatgtagtatacatagaaaataatagaaatatatgcagatagccctgattttccacagttctgttatgtatgtgtttcagtcgatactgtactgagtaaagcaaggactgccagtggggagtggcggatgtcttgaatttggtgaatgcctttatattgttacaaagtttttaaaatccctttgttttacatgattttagacttcgtataaattgttttttgttgaatgtatcattctgtggcttgctttatcatttaatatggtttatgaggtgaacccacacccatagaaacagttactttgttttcagttctggatagtattcatgggaggaatatcccacaatttatctcttctgtccgtgacctttagcttgtttctgttacagacactgccacaatgaacatcctgggtcatctctctctggtcccctgtgtgagttccccaagatatggatgtaggaatgggattactgtgcttttaccatgtggtgttataggatgtcaaattgttctctgaagaggttgtatcagctccccgctttaaaatcttctttgacattttacaggtcaagttctcttcctccccaactggctgctcctcctcagtcccccttcattggctccttttgctgtagatgctggagcactctggggtgttactaccttcctaatcactccggtgtcctccactctcaggattttaaatatcatctagacacagatggctcccaaatatatatctctacatatttctataatcaaaaaaataatggtaccaaaacaggtactctgatatactgcagatgggcctgcaaactggaaatgttttcaggaaaggcagtatggctatttctgtccaaattaaaaatgcatacacccagtagtcccacttctagaaatgtgtccaaaacacacctgcattcctgaaaaatgactgtattcagaattatatgttgcaaccctgtttgtaaaagcaaaaagaaaagaagaaagaaaatgacagataaaagaaaaaataatccaaatgtctgtcactaggggactggttaaaaaagcattgcaagctgggcacagtagcattcacctgtgaatacactctactccactctgggtaacataaggaggcctcccttcttaagaaaacccaaacaagcactgcatagctacacggcagagtctacaaacatttaacacaaaagaagaaagacatagaaaactcttgatattccctcatgaagaaataaagcaaggtgtagaataacatatagagtctgctaaaatttgtgtgaaaagggacaaaggatatatatgtacacatttatatttgcttgcatatgcataaaatatatttggaagaataagcaagaagttaatatccttggttgcctgttggggatgagacagggtaagagagagacattttaccttttgaacattttgaattttgaattttgaactatatcaagaaataaaagataattcctaaggagaccaaacaaacccccaaaaaattcaaaatgaaaaactttttaaaaactaatggaattttttaacctttatcgaaataaaatttaaaaattttctaaatattatgttattcctttaacaaggaggtttaccgccattttaattcagtacgttgttttctttttaattgcatgatctttctttacatctgtcttttttccattacaaggtaaaataacagcatgattaattaaatgcagtttgtttggtgaaggaaattttgttcaaatcttggtctaagtgggaaagggattctaggggatccagtgcagcagttatgggtttcagtatgctcacgacgccctccagtgtttgtgtgggctcatggatgccatatctagaaaacactggaattctcaagcacacgtgactgaagccatttgccaaatgttcaaggtcctattaatggcccatctgagtacttgtcatacgcggtcaccctatctttggatcagaaggtacactcagagctcctagtgtcacatcccaggcccaacctgctgagattagtcgaggaaggtctggaggtcagtgtcgtgaggggtgggaagactgagggtgtgggggccagttgtggagtggcgggagccccaggtgctgtatgaagccgagcctctggatcaccctgtgaccccacatttggtcccttcctgggtgtcttccattcccaggactcccaggaaataaaatgctgcaagaatggggtggggagctgtccagggtgggtcaggtgtggtcgcactgatcctacacctctgcctcccagcccactcccagccctcttctgatattagaaaccaacacagattgccttagggtggtggttctcaaagtgtggtcctgggggaagcagcattggcatcacctgggaacttagatatgcaatcttcagggcctggcctggacctactgtatcagaaactctgcatttaacaagcccccagcagaattctgcttttcaaatcagatctctctctctctctctctctctctctctgtctctctctctctctctgtctctctctctctctctgtctctctctctctctctgtctctctctctgtttcaagtctcaatattgagtagctgtgacttctggatagtcaggtgtcagacaccctttcttgccaggaggcaccaggctcctcaatcagcttagtctcattcttggcctggcccagggaaagatgttcacttcctggattctgagcaaagctctcctaccctgggtgcctgtggggctcccacttagaccacaaaacaaagctcaaataatattattttcttttatgagatttttggtattccttcattagtcagagctgaagatctacatatatgtctaccaagcaagtgtgcatgtcccactagccagtttgttagtcttgccaatgcaccacaacgtagcagcctctcagtctctccttgtgaggtgttacctggagttctttgtctcaccaccaagagaattaaggagcatggatacaaagggtgaggttggagcaaaagtttaataagcaaaagaagaaagctctcccccacggagagggggcttggaagatggttgccatttttacagctgaatgcaaagccttttataagaaactgatgagggctgggtgtctcatttgcataaggcacgaatttccggtagctccaccccatcctcctagtgcccatgcaggcccttagcttaagttactccatattgctttgtttccctgactgcccacgtatcgggggacagaattttccattgcgggcatgtctgggcaagtctcctgtgcagcctttcttatttgtgcagctgtgggcatgtcttaggcaagcccccctgtgcaagttcccttctttgtgcctgcaggccgttcttttgtttgaaataattcaactgaggacccaccataactgcccgcctgaccagtttcttcctttttcctctctcaatttgtgttatgatttccttactgatctctgcctgagcaagactgggcacgccttgagggcaaggagggtttatttcctcttatctcagtcccagctcctcttaaaacaatgccctgcacacagtaggtatttgataaatgtttaccaaatgaagggattgcctggaatggcttggcagacaggaaagcagaatgaaaacccacaggccaaaagtggctgggaaaagattttccaaatcctagtgatgggcacagggccccctaaagttcacttttggaaccttcccatctgtcttgttctcctttcatcagggacatccatgcccctcaaagcccccctagtcacacactacctttcaggaccaccttccagatcagccaggtgcaaatcccacagacttcctgcctgtggctccaaatgctcagctgaaattctgaggctaatttcagtggagttagaggcttatcccttaggagtggcaatggctggctttaagattcgagaagtagtgtttacatctcaaaagagaagaccgcgccaccagaaatgcagaattttggtatgtgcgggtccggggtcttcaggagataaagaatgatagctccaggagcgctgggacccccgtgcagccaccagtcaccacagcctaggcaggggttgggctctcacctcggcccctcccctgcacgccctggatgtggatggtccccgagtgtgaactcgcctgggctctgaccctgggtgcccttcccgccgttgtggagcctctgcgggtgtggtgcatgcacagggggcttcacaggagacccggggccctttagagtctgaaggccaacattcttggagaatccatgtcaggcattcaggctctcagggactcagatgcccaaactatgaaaatgagagaatctatcccactctctcaggtgtggtgagattcatattatatgacaatcggtcgtctacacattgatcacactctcagtattgcctttatcagtcggccaatgcctaaaacccaaagacgggtcaggcatggtggaggacgagttcctttcttaccttctgaaggtgccatcaacaggaatttctaccctgtggagtctagaggagactttccttgaagctgagttgggaatggacatttggacttttttttttttttttttgagacagagttttgctcttatcacccaggctggagtgtagtggcacgattttggctcactgcaagctctgcgtctcgagttccagcgattctcctgcctcagtctcctgagtagctggaattacagacacccaccaccacatccagctaattttttgtatttttagtagagacagggtttcgctatgttggccaggctggtctcgaactcctcacctcgtgatctgcccgcctcggcctcccaaagtgcagggattacaggcatgagccaatgcgcctggccagacgtttggacttctttaaaattttatttcaaatttttaaaactttctaataggtattttatcttcttaggaagtaaaatctcaagtacagaaaatataaaaaggtataaagaagcagaaggatggaaactgccagtgtctccactgggaggatcgggatgaaacgttgcctggcagagcctcagacttcagagggaaggggcctggagctgtgctttgcagctgcccctgagtttccactcctggtttttgtgcatgcgggtgact

SEQ ID NO: 398 - DNA, 87115 bp, Homo sapiens
tgggaggactttaagaccctagagaaaaacgtggtggagtgtgttactgaggaaagtactagtgtccatcatgtgcagccacatcactgtcagaacagttttgaagttgtataaaataagcattttaaaagggactctaaattatgacattctgtgatgaaatagtaaacatattaatttagcagatattttatatgatctcaaatagaattatacatcattaaaaaagaaggggcaaccttgtcccaggcctttttctttttgtttttgaattttgtgtgtgtttgtgttttaaagccaaacttgcaacagaacaccccccttatttctggtgttctacccctggtcctccgtatagattctaccttgtcagccgcaaagttcatagcatttactgatcacatgaaacgcaattccctgcttatgtggtctttgtcactgcagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacggtatggaaatgcagattctttgcctctgtggaagttcaaaattaaaagattagaatggcacctaataaggatattctttattttcaattagtatgttctctgctttgccttcagcatttaggaatttttttagaagacaaagataggtaattctaggtactcactcacaaaaggtaaatgaggcaaatggaactcatgggtttttttttttcttcttcttttttgagacagagtctccctctatcacccaggctggagtgcagtggagtgatctcagctcactgcaacctcgaccttctggattcaagccatcccccgacctcagcctctcaagtagctgggactgcaggcacctgccaccatgaccggctaatttttgtattttttgtagagatgacgtttcaccatgttgtccaggctggtctacagttcctggactcaagtgacctacctgcctcagcctcccaaagtgctgggactacaggcatgagccactgtgcccggcctgttattgttgtgttgtcctgcttttatggtgcttctttttctttatttgtaatagtttcccctcccactcccactgttttcttaacatggagaaactttttttttaattgttcccagtgaatgctgtctcttcccatgttgactccattcacttgccatgaattgacttagtgccagacctctgtgccttcttcatgtaaccagctcaccttagccttcttgtagagggcttatgatcttagttggattagttaacaagtttttgttcagaaattggaaaatactagtcaccattactttcatctgtacttgaaaatttcgtctctcagacatccatcatctctaggtgttggtgacaaggcttgacatctttctagcagttgactttggcttcttaaattccttgaactaattgagagttttcttaagcagagcttagagggagtacttgcagcccccaaaacaaaggcagtttttaaattattgcctatagtctttgttattccagctgtcaccaaatgggattttaggcatttacaatcgtaaagggcaaaacgcaaattagggatgacaaaatcactcactgtggatgactctttaatgcttacctcaagacttcttagagtgtgattatcaccagtgacttcattgcctcttccagtattttgttaacctagtttggttccccctaaagctcttggataggccatttaaaagatgtacatgctgttttatgagctaaagatcatgtaacatattaaataatattttaaaaattactcataccctgttacttaacttccagtcttaattagaagagtgtgaactttcatcagtaggtcatagaaatagtacacacagcagcaaaataagaaaaagtatacttccctcttgatttcctttttctcccatgcctcccatgcctcattctgggttgaaggaagccagaatcgctttgggtaatagtagaacattatagtgactttaatttaggattttttatttactcttttatctttttctttccccacaccctgtaattatatcctaaattttaaaataaatgttcttgctgtttatggagcctttttattttatagtaatttcatatttttataagtattcttttattctgaaagtaatccttctatagtaactaggtaagttacatggaacactttcccttttccttaactaccagtgggcagttgatgaatgcacatacatccaaagaaagcttttccacccattttaagaatttctaagaaggtaacatttgtattggaatgctaatgccttgaagctgcatgttttgaaaaaagtagtggaataaaaccaaaacactcactccactgtttgtttttagagaacacttctaaggcgagccactccacacccaggggagttaaagcacatgaaaaagacagtggagaatttacggaatgacatgaatgctgctaaaggactggactcaaacaaaaacgaggtcaatcatgccattgaccgagtgaccacttctgtgtagagtttcacctccaagttttacctcctgtgtcttcctctgctgtcgagacgttcctgtctgcttcccgggagcctcacgtgctccttgtcctaaccagcccccgcgcgccatcttcccgtggagtgtggggaagctgctgtctcccaggaagtgccttactcatcccgcaaccagtcagcgcaccagtggtctcccggtgtgattttttttttttttaatttcagttgtttgtaataagtagaatacactactgtaaacatacgacctttgtttttgtcttatgttggggtaaaggaaagcaggaaggggaatttttatcctcctcccttccgtaaagtgctgggatattttgaatcccccaagttcccttggacctactgatgagagatagttttatgtatggggaaaaatggatactttttaaaccttttttggcagctcagatggtgtaaattttaaaattttgtataggtatttcataacaaaaatatgtatttcttttttgttattttatcttgaaaacggtacatattttagtatttgtgcagaaaaacaagtcctaaagtatttgtttttatttgtaccatccacttgtgccttactgtatcctgtgtcatgtccaatcagttgtaaacaatggcatctttgaacagtgtgatgagaataggaatgtggtgttttaaagcagtgttgcattttaatcagtaatctacctggtggatttgtttttaaccaaaaagatgaattatcaatgatttgtaattatatcagttgattttttttgaaaagatgaaccaaaggatttgactgctaatattttattccttacactttttttctgaataagtctctcataatgagtgcagtgtcagactgtgcctactctgatggtatgtgccatttgtaaaataaaatagagcagaaaaacacaaaaagagaacactggttcagacattcagtgggcaagtaaattatggactgcaaaataatgatttttattcaagaaagctttaaaagttttatatccagatatacaaccacaataaagcaaaataacctactatcaaaatagaaatgttgctatctttataagtgcaatttaatttgtaaatagagtttgaatcaaagtatcacaaaatactgcttcaagatttaattttaaatctgctaatttaagggatattgggaaaagttttggtgtgtttctgttgatttcttttttgtatgctgtgataaaagagaaatgaaaagtgccagtcactgtgtggtgtctaggaaaatcatatatatttttttctccaagaaataaattcatcctggacattggccatacagctttttaaaattattactttgtatgttcaagtgatagcaggtagccaaattctttgacagtgtgctctggtctgttaaatatctaaattacccgtcagttgtgagtgacctcctgtgggacttgcattcacatggggcagagcccagaattgcctttgactctggctagtaattttgggttgtggctatctggccaattggactccttataaacccgtcttcaaccaaccaaatacaatacttttttttacttctatacatttacttattgggttcacttagctttttagtctgtgtgtatgtaaatatgtgtgtattttaaaaactatttatggagctgaaagtacataacacataagtgagtttcggctggtcagttttataccttgttccctaatctgtgcataccaattttcttttctctgttttaagatttttgacatcctctattttgttttaagcttataaagataatgccactatctcatgggctgattatatataagcaaattggttttatttaatgagaattgtcttgacgtggaagaacaagtagaacttgcatggcgtgttttgtttgtttttatataaagcccatcctttactactcagttcatcatggcttttctggactggaggtggacagaatggtgtgtgtgtgcttaaattttcctaggaaatgtcatgcacctagtttatttcctttggcctatctcctttagttcatgttcacttagtttgctttttgttttcagtttgggggattttgtttgtttccccgcttcctttgagagggaaatgtcgctttcatctgaatgttttacgctggtgacactgcagtgctcttgaacttcagggtgctggaaccaaactcaagcttcacagtggaaacagcaccagccagacagttctgccttgagaacatgccaagccgtttctaggaaggcccctctcatagttataagaaaaacttgattatgtgaaacgatacctttctctgtcagtgccccccccccccccaccacgacccccgtccccatccagcccttcctttaggaaagggaggagtacagtatatggctggctgtttgtcttgtgggagtgacaggtgaaagcaggaaaggaggttagtatgacctgttcacccacttttttttttcccatagccagttatttcttctttttagcaagaaaataatgtctcagtgggtaaaatagccagagaaaaaatgagaggaagtgaaataatcaaagtcattgataatgaatagagggattggtaagaaatcataaaatgtctgcctagatattgttttttttctggaaagtttggaggaattgtcctgactgacccaatctttctgtctaaaaacatactagctggctgtcaatgaggtgagcaggcaaggtgggatcactcgcaccagcctctcatagcagcacttctgccatctcctgtgaaatctaccacacccaacaagacatgcttagtgaatggggtggaggctgggaaaattctgtgtctgagagttactctgaacagccagtccttccctggtaaaatgactgacgcttggtcggccacagtggctcatagctgtaatgccagcactttgggaggctgaggtgggagatcacaaggtcaggagttcgagaccaacctggccaacatggtggaaacctgtttctattaaaaatacataaaattagccaggtgtggtggcgggcacctgtaatcccagctacgcaggaggctgaggcaggagaattgcttgaacctgggaggcggaagttgccgtgagccgagatcgtgccactgcactccggcctgggcgacagagcaagactgtcttagagaaaaaaagaaagaaaatgagtgatgctctgccctgggcatgctgctggtgtgtggcaaggctgcagcagcactctcaaacaagggactgcattgcagctgcttattaatagaaggcaattagggacattgccactcagtgacatccatggagagttgcaatctcacttcaccattgttgttgtcttacctcatccaattttccaaagagccaattaaaaaaaaaaaagagataactttattatggaaaattcaaaacatacaaaagtagaatcatcattgaccctcctatagctatcactcaccttcaataattagcaacacaagactaaggcatttaaaaatgcatgtttttaaaacatgtattatgttttaaaatatgtctataagaaagtgcacaatgaagcatttttttttaaagctctggaaaagcaagcaaatgtgctttttaaaactgctttggagttacaatttttgagtcaatatgccagtggaatcatgcatatggatataggtctgaatcccagcctgccacgtaggtatggacaaactaacctctctgggcctcaggtccttcatctttaaaatggggcagtaatagtcctttcaggcttagagtgaggattaagtgggatacataaaacacgctctcaggaagtgggtggctgctattattacaggtcttgctgtttttgttgttatagtagtgttattagcacccctgcaattcctgccaccaagccaacagtgtgtcatcagatgggtatgttctcaggaatgaggacacacactagttctgatggagaaaactttatttgaaaactgtttcacctgtggttttatatatagactcctgcattatgtaatgggtggtgattttaatttgtcctgtgtgcttacttaatggtaggtctagcaatggtctcatggtaaccacctcattttaaccagacttactaactagccatccttaaggtaaaactagatcctaccaagaaaccatgagacagctagttgagaaaagggtctccttttccagaaaatgtccccctctttgtcatattcttggttttctaggttcaggtctctggtgctcattttgccttgtctctatttcaccctggattttcataacatctccttttttacctcttgctttgttctgtctcctttctctcaaaggaggctttcatgtatcagaaggaacgagtcaatttaagacatggatcatccagggagaaaaacctgctggaacaaataaattagtgcagcctgacgtggggcatgtagagaacactcccatcttgttggagtggtttcttttttaaaaagcagacagctggcgggaaagggaaaccagaaaaacctgatctgttccttgtgttcagtgggctgtgtggaagattggagatgaggttttgtgtctggcagtaggccagaaggatagtgtaactttagactctgagagtgggcaatcattgtgacaagcatggattttagccaagggctcttgagttctgactggacaagaacctgactgggtcaatcctccaagtttcttttttttttttttttcttttgagacagagtcttgctctgtcgcccaggctggagtgcagtggtgcaatctcagctcactgcaacctccccctcccaggttcaaacgattctcctacctcagcctcccaagtagctggaattacagttgcatgccaccatgcctggctattttttgtatttttagtagagacagggtttcaccatgttgcccaggctggtcttgaacccctggtctcaagtgatcaacctgcctcagcctcctaaagtgctgggattacaggtgtgagccactgtgcctggccccaagtttcttttgcagcatcaacatttaacttctaaacaaaaaacgagctgcccttttttacagtaagatagtactatgaactacagcagccattcactgagtacttactatgcgccctacactgacctagctgaacacagcctcagctttccagaacaccaccatgaggtaggtgacgcgatttcctttgtgcaaagcagataattaagactcaaatagttttaggaatgtgcccacgatcaaacagtaagggacaaagtcagaattcaaattcacatctccgttgacatttcaatcacccctttattttactttgctccccttccccagccaaagcactgtaacctgtaattacatttagagttgtatttgtcataatggtgatggttctgtttttgtcaaaattacataggctataagttatagactaagactggcatggaactgagtgaaatttaatgaaattgatgcagaattgggccttcatttaagcctagtgattgcaaacactgtgattctgcattctctaacccaggggtccccaacctgtaccccagggccaggtaccagttcttggcctgttcggaaatgggccacacagcaggaggtgagcagtgggcaagcaagcattaccgcctgagctcctcctcctggcagatcagcggcagcattagattttcataggagtgcaaaccctattgtgaactgcacatgcgagggatctaggttgcacgcttattatgagaatctaatgcctgatgatctgtcactgtctcccatcacccccagatgaggccatcaagttgcaggaaaacaagctcagggttcccactgattctacattatgatgacttgtataattgttttattacatattataatgtaataacaatagaaataaagtgcatgataagtgtaatgcacttaaatcatcctgaagccaccctccctcactggtccatggaaaaatcattttccatgaaactggtccctggtgccaaaaagatttggaacagctgctctaaccctcccaccaccttcactcacttcttgtatgttgtcctgggctaagggctgtggaaatgttcatggggtctttgttctaccatctcaaactatgtgcaaatcctaagaaacttgtgagataaagtatttggctagtgggaaaaaaaaaattgataacgtttttaacattaactggagtgacagtttggtaattggctctctgagaaagcttcagcatattctgaaaattggcaggtagctccagagtgagctaattagttaggaatgacttttaatactcactacctttaatagcctacccttggagaaaagacagataatgaacactgggaaatctatggtgctgcaacttgacctttgtgccatttgggggaaatgaggaagatgagtcataatttattatttaaagtcctccttttataatgtgttgttgtgaaagatttgacaaataatgattgctcctttagggactaatttaatcaaagaagcagaaaacaggaagaatagaaaacttgtgtgactaagcaatgtttaattttatttgaaactggctccaccaccctggtgataggaacagaaggtcctatggagtcttcccatagcaagaaaccaggcttgtaacagggtgtaatagagtgacaccccacacctgatgccctgtaaatgcagagtctgcaaatgcctctcttttgatgctttctcaaggtaagtcataaatgaagtcttactgctttaaaaaagtagcttgccaacagttgcccaggctccccatgggactgcgcttcactgagcacctgaagaaagtattcactggaaatgggctctcctgggagactgtctggatcccgagtgtctggcgttcatgttcccacacctggctgctgcttcttgcccttccttggctgcaggtgtgagtgcttgtttgtttaaacctcgctcagcactgcttggaaaaacaaaacaacatggttacttgtctgggcattgaatgttcttcctgaattttggtcctgcccattggcccagaggcggaatgggtggggcaagtttcggtgtgagtttgggaagtttcgagaagacgctatgggctgggtctgttaggttggggttgctcttggttttaatccttttggaatgtcttgagggtcaggagcgttgccattgatggctatgggagttgtcaggctgtggctctctttctcacagagaatgccagaggcactcgggaaggcatttgccagggctctgacagatgtaaagtaagccttatccatgttgtgttctcacctggacacctggaaggtgctcagtatagaaaagtcacgagctagatgagataccagcttgatgtcgactccctccccaacaatggctgcctgtcttcgtcttgatgcctgccagcaggtaaagggggtgtgcccctgggacctgggtagcagcagtccttgggaaacccagggtttgtcacctgtggtcacttgacccttggtaaattacctaaccttttcattccacatctcaaggacagcaaatccatgtagcagttaggttgttagaagaaatgatgttgacaaccaaatgtgaagctctgatatggttcttttccggtatcatagctacttgctctttaaagaactggtacaatgttgggggcagaaaaaccacatcatgcagtgatgttgctcagtcaggcatacaggtagagaagagctgtctctatccttagctccttaggtttgtccagggctgctcagtgtggctgaccctgtcttgctcactgtcatgtaacctggaacctacaacatcactgcatgatgtgtagacctggaacctactgtagtatctttttcttgaaggctgtattgtgcagtagtttccaaacttgagcatgcatcagaaccccctggtggcagtgttaaagcagattgctggaccccactctcagagtctgattccataggtctggggtggggcctaagaatttgcacctctaacatgttctgaggtgctgctgctgctactggttcagggaacatacttagagaaccactgctctagtgtgctggaaggagcaggagctttggagttaagcagatttaaatccagctatggcacttacttaatgttgtgaccttgagaggtttttcttaatttccccaagtcttagtgaactcgtctgtaaaatgggaataatacttacttcaagactttctagagaattagatgacagagcacatagaaggttttcagcaattaccactctttttgctatcctgaaacgcatcatatttgctccatatggggaggcataagagcatctggtcttagccatgtgttgacctttaggctcttcttgccaatctatacaagctaataggagtagaggaagtgctaacggaagtagaaagcatgtttgcctctgggtgagtgcctaaggggaagactgaaaatgtggatggccagatgtggctagaatatattaacacttcctgacttgcctggtggcgtatcagcccacacaccatggactctcagtgagcaggaaccagatctgtgcctgacattcaggtcacaaatcttccaacccacaatctgtccttatacctgggcttttggaagaaatcttccaatcttggtatttcagattgggaaacaccgaagctcaggatctccaacctcatctgtattcttcatgtagcatcacaatcattttagtgtccttaggaaacaagttgccttattcaactgttccaaggtttaatgactctctccaaatgcattatcccgttgtcatactaaggatgatcctgaaaataggtaactggtatggaaatatatggtaatatgtagaccaatacacacattttagaaactgtcccttttttgtcatataaagcaatattatgtgtatcataaaactacttctctagagatctgagtagtagttctaatcatttatcatattgcataattatgcatatcatatatgcaaaatttttgcatctttagggcttatttaatgtaggtggctgctatctaaatgatgcccttccctgggccaccatttgctttgggaacatcagacttttttgatagcattcctattaaaatactcaagtccaggggctcttaaactataacccattgcctgtttttataaataaagttttcttggaacatgactatgtccctttttaaatgtgcagagaccaaatggcactcaaagccaaaaatattgattatttgaccctttatagacagtttgcaggggtttctgcctctagtcaataggtgcaacctgctatcttttgccaccagacggcgttggatgtgtcgcctggttatcacagccagacaccagtctggacaccctggctttccaaatgggcagaactcagagagcctgttccttgttccctaccaacagcatgacctgccctgccacttgctctgccaactctgggatgctttgcaacaaatgcctggggtcacccccttctcaggctgctcaggagctatagcacaccctcaacactctcttgagtcccaatgctattatgtttggggaccctactgttatcttacatttctattcaattttcttgaaggatgggctgtatgcctggctaagcaacatcactgcatgatgtgtagactccatgactgaaaccagcatcctataggaagagatgcaatattttaaaaatggccaaggcagcacatttagatactgaatgtcagccttattttatggaggaaataaaggctttcaggagcgaattgccagtttttattccctgctaccctcacccacagaatgcctttgctggactctgtcctctcccagacctcacttcctcatcacagctagctcttccagccactctccgatcctttttctcttagagtttgctccattgatgatccattttatcccatatctcagcagcttctataaacatgtttagataccactctaaatgagcaaaaaaccttgatcacctaggtcaaaaacctagagccactgcacccagccctgataggcattgtttctaaatccttgtggctacttttactcaactttaattgtctcaagtgttttcattacaatttttgaattaggaatagaaaattgaattggcaaataggaaaattgttttttgattactacgtgaagacttactctaaagaccaatttactttttgctttacttttaacttttgagtccctgagaaatagactcttaagtcccctccatcatagtcttccttactcttctctgccaaggttcttaaaacaggtctattcttgttctccctgcttctaagtttccatgcactaccgtgagaagtctggctcccatacacagcatggtggaactgctctagccaggtcagcagacctctgtggggccacatctgatggacactgattcacctcttacctttctagacctgtctgctgcatttgactctgtggaatgctccctctttctagaaatttctacctcagtgcttttctaacttttctgactgcaactcaactttcttgaaggaacctgtcacgtagtaacccagtaaacacatacatgtacatagctgaaactaaagtttcccaacatagtgctttttccttaactgtatataaggaactctgatatttccaatttcattatttttagtgctaatcaaaaccaaataaattaatttcacaactcattaacaggtcatgtcttgcagcttgaacccttatgcttttgacacaccttcctctgtaatgagtaaggaagtttctaggaagtttcttaccagttgattagcatcaaatttatagtttaacctgtaagaagctgtgttggaggaaacccattagcttggatgagagtgggaggaaggtaaagaaaaattagatgtaataggtgtttgtggttgttgatggggtgaaaaagggcaatgacaagaggaagactgggtttgtaaataggacatgtagggaggtaaagaggatgattacaaaagcaggggaaagaaatttgcctatttgacaggcctattgtgaaaattaactttcaaagtggaaatattatttggtagtgtctattgtacttttggaagaaagattatattattatgaaataagaatcacatatgctttttctctgcccaattaaagattgatggaaaaacttcacccaaactggagcattttcagtagagatctccattttctttgccacttgacaatgtattcagactagatttctccactgcacttatgcatcacatctagttaatcactggagacctctgcgtgcttcttaggctgacagaatttcaagcagaacagaatcaacctaagaaactggattttccagtactacggctgagataaacttgcctgttaacttcttagactcggcacagatccgtcttctgaggattgaacacatgtaaggcattgtttcctcttttttttttttttttttgagacggggtctctgtcacccagattgtagtgcaatgctgcgatcatagttcactgcagtgaacttgcccagctaattaaaaaaaaaaaaaattagagatggagtcttactatgttgcccagtctggtcttgaactccaggcctgaagtgatccttctgtttcagtctcctgagttgctggagttgtaggctagagccactgcatctggccctgataggcattgtttctgaatccttgcggctacttattacctgactttaattgtctcaggtattttctttataatcttcgaatgaaaaacggaaattgttttttgatcactacctgaagacttattctaaaaaccaatttactttttgctttactgtttttgtaacttgagtccctgggaaatagactctgagatgcccatttggatgcaggaggtttactgaggactgcactcgacaacactggtaaggagtgaggaaagcaaaactgggcagtgggaaaagtggaactgcaatgcaatttcaactgaggctttgaatggtcaataggagctggggatcccggctgaggcaagaaagcaggcctttgtaccccacaaccagtaattagatgtaggccgccactggaaaggaggtgcaaacttgggcaaggcagtttcctttggtagagggcagttcctgtggagggattcatgggtgagcaatgagcagccaactcactcaacagctggggcaatgagcaccttagttctgaaagggggatctcagctgcacactacaatgtgcactacagatgtgttagtcactccagtcatcttcaatctggttatttcctgagcatgtattacatttcaaataatttttcttctaagacttggttttttaaaaaaactcactttttgggcctggcgcagtggctcaggcctgtaatcccagcactttgggaggccgaggcgggcagatcacgaggtcaagagatccagaccatcctggccaacgtggtgaaaccccgtctctactaaaagtacaaaaattagctgggcgtggtggcgggcacctgtaatcccagctactcgggaggctgaggcaggagaatcacctgaacccggggggtggaggttgcggtgagccaagatcataccactgcactttagcatggccatagagcaagactccgtctcaaaaaaaaaaaaacaaaaaaacaaaaaaaactcactttttaaacttttaagtccaagttgtgcaggtacatgtgcaggtttgtgaatagattaacttgcgtcaaaggattttgttaagattttatgatgaagacaccaaaaaccattcaaacaaaagcaaaaattgacaaaggggatctacttaaactaaagagcttctgcacaacaaagaaactatcagagtaaacagacaacctagagaatgggagaaaatttttgccagtatgcatctgacaaaggtctaatatccagcatctgtaagaaacttaaacacatttataagataaaaacaaacaaccccattaaatagtgggcaaaggacatgaacaagacactacttaaaagaagacatatatacagccaacaagcatatggaaaaaaagctcaacatcactaatcattagaaatatgcaaataaaaaccacagtgggatagcatttcacaccagtcagaatggctattattaaaaagtcaaaaagtaattggtgctggtgaggttgcagagaaaaggaaagacatgctgttggtgggagtgtaaattagttcaacaattgtaaaaacctcactttctattagtatgtattgttcatgacaagagattagaaatcattaatttatgaaactaaaccgtctccagatgccctgaattatcctgtgtgcggaagtacatagtttatattttccccatttttcttgttacattgtttcatttctaatccagtgaaggcctttgcctttgcaggaccaaacccttgatgatacattttgttattaatagcgttaaaatcacagggctggaaaagtaggattattttacttttttcagagaatatttttagaaattaatcttacaagatggcatacagttgactgaccccatatttccttaatttcctacattctctgctttcccatcatcattgaattaaaaaatatatagtgtgtgcattcaacattttgcttgagatatgccaggagaatggagaaataatccttttcatcctgctgaaaagtcctgaaatcaagacctccttgatttttatcaaatatatgtagttacagtgtatgtcaaataatgtcatatgaaattaagttttgctttatgtactaaaaaggaaataattctaatcacccctttgctttctccccatcaaaaaagctagctagttgattgaatacattcatgctattttcatttcatggtgaaagttatcttgtaaacagaaatagctgctctcctaagcacgatcatgtgaaccacagtgttggtcacaagcatcagttcttctgcagggaattctgctgaccactgtccctattaaccagattaaaatcttttttatatcctataacaatacattatacaaacagtgactgcattttggtgcttatgctagaaaacgtttcctcaaatcaaaatttgaagtgaaagctgagataagatgttgtgaagaaggctattagtgaccattataatcgaagagaaaattctctgcaaaatattagagctaatacttagaaaataaaaggcagcaataaaacagggacactctaaattaacgaaaaatttatatagccagagaagattgtaaccacattgtgatatcaaccccatcctaatgatgctccaagttcacaatgtttatatattgtgctctgggaaagcatttccccgaatttaaatttgtttctatttgaaaaattaaacttgtcttatatgagctttgaagcatatgaatttttattttaagatctcacttttttgttttgatgctttaagtttttgttgttttgtttttaatgttttactgtgttaattccatgatgtatgaatcattttaggtcatttctaagagaagaagcattagtagatcaagaaagggctatagaaccaaggaagaaggatggggagaacaggaggagaagtgaaggaaaggacagagaaacttggagaataataaagagcagaagacatcctggagaccaagacgataaatggtgttaaaaaaagagaaactgtctaccagatgaggcagtctggctggtggaaagagttctgacctcagttcaaattggggcttagtttctcattatgcagcagacgtttgtcagctaactgatatttacagagttcctgttatgtgctggcattgtggtgataatggtgagacctcgagtgtccttgacaagttacttgaaagcttggaacttcttttccaccatggatatgataggttcttagaagagtaggaatgacaaacgtatgttatataacacacttaattattaatggcatttctaattttattaaggttttcagttgactaactttggcatgctatttgtatcttaagttcagggatctcacctttcctctatccattcccaattgattatcgaatggtctttaacatgtaaagaaaaactgttttttttttcttccagtgtgtttagggtgtgcatttcctggccctactgcttccttttcctgttgaatgaacagatacctcaaatataatctgccccctaaaagtcaaattttctctacatcccatgtcccaaatctactacttcttttttctgagtgtgttttctgtgcagttaatagcactgccatacacagagttaccccagcctgaaaccagggtcaccaccatccctgcctatccatcctactacctttacctcctccactctcatccctgcctctacatctccatgaccacatcttggttcctgccctcatcacctctcagtcaagaccatactcagatatgtggccaccacaggcagatgagatgtttggggaccctactaactgttattttacatttattttcacttgttttagatgatggggttgtgtgggagaggagtggggaagaagagctgttgacatgcatcgtttctgtaagatctggagccattgcatgctgcttcacctttccataccccacttagcacaacaaaatccagcaaaatccaaaaactcagaccacccccatacatacctaagaaggcagttcatggttcaagcatggccttcagggatctcactacacagccgctctcgaaatgcttcttccaacttcacttaattctttcattgggaagagcttaagtaaatattttgttttttccatcttataaaacttctagtggatgtgttaacacctggagcaaactactaacctgcccactagtatacattctccttttttattcttctgccgtgtttttaaaaatcagagacaccattactgtgagatgcaccatgttttattttaccagtaagaaagaaaacaaaaaacccaaacaaaggtggtacatcaaaggctgcacctcattgaaggggaaacaagaagtatgcctgccatccaccaaaagaaaaaaaaaggcaagaaaataacatgtcttacacgggtggagataggaaaaaggaaaatttcccttgagaacttaaaccaagagctgttagtcatttagatttgtggtctgaattcatactaactgtggttttaaaaaaaccccagagaatttttttgctaatttatttgagtacttttattatttaccaatgaattcacttacctatccacaaagatattcattttaaaatcaccatcaagaacaaggtatcttgagttactatatcgatttcaatatgcaggacacttttatacatcattcatggttgattgtaagaaaaagtactggttaaaaaaatgagggtaattatttccatttcttagagatgttgaaagataaaatttataccatttgattcagtcttgattttaagactgaattttaagacttgatttataccatttgattttaagtcttgattatgaatgcataggccatataaataaattctcttggcaatttcacccctgttttccaaatcatcatatacagataacacaaaacagaatgtactaccaagaaccctgatccaattcttctttcttttaacttttgaaaatattttagtttactttcatttgttaaaagtattttagctaaatatctaattctagatttaacaccatgctccctcaatagaacttttttgactaacaattatgtcaatttagatttacatttaatctacaagttattttaaatggtttcaaataaaatgtacacacagatattagtttggttacacttaatctttaccacctttattgaggtatgattgacaaaaattatttatatttaaggtacataaccttacttatatgttttgatgtatttatacactgtgaaattattaccacaatgaagctaattaaactgttgcccaaaccacctgctgctcatcaattacctcactgagttactctttttcttttggtgtggtggtgacatgatgtggctgtgtccccacccaaatcccatcttgaattgtaactcctacaattcccacatgtcatgggaggaacccggtggttgggggttgaattacaggggcaggtctttcctgggctattctcatgatagtgaatgaatctcacgagtgaatggttttgaaaatgggagtttctctgcacaagctctctctttgtctgctgatgtgacttgctcctccttgccttccgccatgattgtgaggttttcctagccaggtggaactgtgagttctcaattaaacctctttcctttgtaaattgcccagtctcaggtatgtctttattagcagtgtgaaaatggacaggtgggtttatttgagatctattttattaacaaagtgtaagtatacatgacataattcactagagtcattatgctatacattgagcctccagttcttacatatcttttaacaacaggtttgtatcatttgattagtaatcccaatttccccagcccatgggggtgtcaccattctactttctgtaactatgagttctatctactcttttgcagattccacataaaagtgagttcatgcaattttgtatttctatgactaccttattttacttagtgtaatttcctcaagatttatccatgtttgcaaatggcagattttttcttttttaaggctgagtaatatttcattagctagagagataggtagatagatatagatatacacacctcactttttaaattcattcatctcttaattgacagctaggttgttttcatatcttgtctattgtgaataatgctgtgatgaacatgggagtgcagacatctcctcaagatagtaattctatgtcctttaggtattgctatgatttgaatgtttgtccccttcaaaactcagctgaaatttatttggttgctcttgtggcaatgttaggaggggagagctttgggaagtgacaggaccgtgagagctctgtcctcatgggcgggttgaatgccattataaaagggctagtttttcccctgttcctttagtttttttgtcaggcagagaatttaatttaaagtagtctcatgttgggaatgtgcctagattactggaagaaacagatgcaaatcaactctggaaaaacacaacttcagtccgagctgagagtgattgcaaaatgaatgctggtttcagagatgtcaaaatgtgagtatgtatgtcttagagtagatagcggcggtgacgtttcagctggacctatggccaagtcactagagtctgcatttcccagtcttctctgcagctgcctagggctgggtgacttactaggctgagagcaacctggggttccctggctgggaatggtgaccattgtggtaacctccctggacccagggtggaaggtccgggttggagataattgagctcaccaccccagcctggattcctggatgatgtgaaactcagagacaactatttgtcccagaccaggggtttactggagagctgagggtcagacagcaaatattttaggcctttttcaccataaggtcacggtcgtactactcaagtatctatgtagaaggaaagcaggtatagccaacagggaaatgagtgggcatggttgggtttctatgaaactttatttgtaaaacaggcagcagttttgatttggcccccaggctgtcattggtgtcccctgccctagcccacccacacatgtttggagtactatgagacatttaagctactatattttgggtttccttgttatagcatcttagcctacatcctaattaatgcagccttcattatggattaattccccgagaaattttttaactggcccaacttttcatctgcttctactctcacctgagctagcagtggtcttcacttgttgtccctgcttctggtctcgaaatcctgtgtgtcactcttcaacctgcaaccaagatgggtctttcaagaaatattctcattttctcctccttaaaatgctctgaatttactcattgcaaagagtaaaatataatctcctagagaagcagaagagaccttgatccaactaccgcctgcctatcttttcagtttatgctacaggcaacgttaatcttcagaaagatttttgcttgtgtcaccccttcttgctggaatggtcttcccaacaagagcctttcattgcacttcaattacctatcacaactcacttccagggtttccttttctaacaggcccttctagattcccccctgctaagaaatgaactacctgcaagtagaggctgtatcttattggtttttattcctctaggatctgtcacagaacaacctctgttcatgcctaaatgagtgagcacctctttcctcttctgtcactactagtaattaaaatgatctctttacttaggaaatatataatatttataaaatcagcagaataggccattctatttggaaaggataaaaggaggcccacagactaagtatactgcacaaagtttatttatctaagatttgttcattttcatatttcacttgtgaaaggctaccctcctcctttcaagcatctgttccttctcccatctgtacaataaaaatcctctcctatgtatttactcacttttgccttcatgtctgcaatgctcttctttgaaacactgttgcccaaaccacctcctgcttagaggaaatctcactctgtcatttcttttcttaaattgtatgtccagttgctctgcacaaagatgcagtcaccttgctctttactgggtggaataggatgttaaatgaaatgtttgtatgagatcctttttgaagttagttgtgtgagagaccatccccttttgtaagatttgtcaaaagtgagtgggtcagagctggactgataacttctaaaccttgttcatacaccaaaggtgtgagatattgggtgataagagagttggggaggctgtgtacaaagagctgcaagtgtgctgtgagtcagcccttgcctcagcaacccccaccagggaggaggagtgaggggtgcctgtcccatcttcaagccctgcagaagcttcaacagaccacccccagagagctagatatgtgcctcttcgagttatagggtcagcatggcctgaagactgatgctgtcctgagtgaaggtccagatagtggctgggcagagctgtgaagcagagcggcttcagggttgggatggaccagaccttccagaggttgtcaggagttttcccctggatgacatccaggtgcaaatgaaagatgcagcatggggtcacttcaagtcctaagggggctacttggagaggctaatacagctcagcagagagaagccgaagatggaactggatatctaagaacctcaaacaaccagctgggatagagatgcacaagcctgggtcaagagaactgcagggaaagatccacattgatgccaaaaacttccacaaaagctccagcaagagaaacagctctacttcactgccaggctcagaatgcatgaagccagcttacaatagtgccaattgggagaactttccttccccccttgtctcccctccctctctcttcaacaacagaggggcagtccaacaccaggcaagaaatctggcagaagcagaggagaaatgctggctggtgaaaggggagagatgctgacactgccctttctgcaggactggagtcctgcccagggccaggcctcactggaggaaggggagaaggcacaattgtacatcctgtgcctgcttggattccgataaagtcccgtagtttcagatttctgcattgaggatgtttgcattagctatgagtgaccagaaaaatcataagaacagcctgcattctcaccaagggcctgggggaagcacagaacataaacataaaactgttttatgattacatttccccacatcaggcttgttcaataagtcaattaaattttttcacttatatttttaacttgtgaagacagtggcatgtttattattcccagtaatttttgccaaaattaaaggaaagaaaattggaaggcaaaatgacgtgcttttggaactgaggttgtgctgggaacaaaggcattatttgctaagagtaaaaaaatacgacgcaaggaaattaagaactgagcctattttcttgttagctactttctcatgcactttaatagtatttcataaaagtatctttcatgcttcagacatctcaagattaggaatatgtgttatttttcgctccttctctgcagctttttggagaggaaagcaaacagaatcacggggaatctattcaggtagtgagaatctcatgaagtacagaagacactctgattaagaccaaaacctcctgaggagtttggctttaaaccccatgttctccctggcaaagtgtcttgatctgaaatccatgttaagctaaaatgccaagaggataaaatatcttcagacgtagctttagctgggctgctaaaaggagccaagtggaagaaaactggcaacctggaatattacagccgaggtttgctagtggctgcacaggtatgggagtgatagtgatgtcagcggctagaacatcgccttcattttcctacaaatcaattgcaaaatggcttcctttcaccacaaggtatatgtggaataaatactcctgttgctatgaaattaaatatgggcaagcttggcttcagggactgaggtcttgattttagagggcaggctcagtgggagtgagtcagaaagaaacagctttgtgaaagggctacttatttgaactgggagtggggccacaacccccaccatcctctgggaatgcgataggaggcctctgctctctctagcatgttgcttctggagcctgccaacaacgaacctttctaaggcatatgccttacctctaaacttatgtttatatcaagaaatatgtgagggtggctgggcacggtggctcacgcctgtaatcccaacaatttgggaggtggaggcgggtggattgcctgaggtcaggagttcgagaccagtctggccaatatggtgaaaccctgcctctactaaaaatacaaaaaattagccaggcatggtggtgtgtacctgtaatcccagctactccagaggctgaggcaggggaattgcttgaacctgggagacggaggttgcagtgagccgagatcgtgccactgcactccagcctgggtgacagagcaagactccatctcaaaaaagaaaaaaaaaaaaaaagaaatacgtgagggtactgggcaagatggctgactatgcagacaggtggaacagctgccactgagggacccagatgactggcacactcctaacagatcttcagagggatggcactgagagttaacagagggaagactcagaagctgggctgaaagtggaggaagctgggaaccctgcatggggttaccatgtaccaggactcattcctggcctgcaatgactccacgggagtgactgaattgaactggtaaggagcaacccactctcgccataggcctctggaatcctggcaggaggaatccccttgaccactacagacacttgccacacagagttggcaaacagactgcttagagaagtggtaggggcggcacaccagctgatgtggagcccaaaggtttagtgcagcagcgtctgtagcagagcacggccagtgacactcatccccctagacttgacttgctcccagaagagactctggccctagaggaactgtcaaacctgaactctgcagggcagtcttgcccatcagatggagccagtccaacctgagcacccgtggtctgttggcctctccctgggccccaggttggccatgcctgcttgccaggcagcttcaggtgccctgggggcctatatcctaactcctgtgctggcagacagtgcctgagaagcagagagctccagcagggtggcccccatggccatgcaccagcccgcccactccctccctccactgcagcttcccccaggcccatggacaacccccaacattgctttgctggggtgtgtatgcagtggggtgagggggtcgcctttcctgccctgccagtgtgtatgtgtgcatgtaccctgtcctgccactgttgtggtgggagtgcactccgcaccaccacccccacagaggaactgccattgcagttggagactgggtgggcacacagctagccagccccacccccaccagcagtctactgcctcaggcagcaccaatactgcctcaggagtgaaactaggaacagagaacagcagattctttcacctctgagtgaccacccctgaatgtggttcacagagagtgcacacatacctgtgcccaccagtgccctgaccccatgccatcactcccagtgcatctgtgggcagccaccaacaggggccccctgccccctgagccatgctgcctccaccaccgttgtgagtgcccacatggaggcaggcaccctgggacccactagtaccctgctgcagacagcgagtgtgtaccctgctgtgttgtcactcccactgctgctggcacatggaaacgaggatggatctcactgccaccacactacaaaaccctttagctgacaccacacatcaaggtgtagtgaccagtggtctaggagcaccttggcttccatagtgcagataattcctaaccttaaggagtcagagaacaaagtcaggcttgatacaagtcccccagagttagaacacacagtccaggagtttggaagtgagtgttggcaccctaaaatcttccagaaatgaagccagttgactgactaacttatggcacaatcaaacccacaaggtcatcaaataaagataaaagaaaaaaaaaacatctaaaggtcaccaactgcaaagattgaaggaacttcagcccacaaagatgagaaagaaccagcacaagaattctaacaactcaaaaagccagagtgccttctttcctccaaacaaccacgttatctcaaggatagtaaggattctgaacaaggctgagatggctgaaatgacagaaatataattcagaatatggacagaaacaacgatcattgtttttagaaatacattgaaaaccagtccaaggaagttaagaatcacaataaaaaaatacaggagctgacaaacaaaagagctactatagaaaataatgtaactgacctgatagagttgaaaaacacattacaagaacttcataatgcaatcacaattattaatagcagaatagaccaagctgaggaaagaatctcaaacttgaagactggttttctgaaataagaaagtcagacaagcatagggaaaaaagaataaaaaggaacaaacaaaacctctgagaaaatacaggattatgtaaagagatcaaatctatgactaattggtgtccctgaaagagatggggagaatataagtaacttggaaaacatatttcaggatatcatatatgagaacttccccaacctagctagagaggccaatattcaaattcaggaaatgccaagaacccgagtaagatacttcacaagaagattatccccaagatatgtaatcatcagattctccaaggttaaaataaaattaaaaatgttaaaggtggctggagagaaaggtcagatcacctagaaagggaagcccatcagactaacagcagacttcgcagcagaaaccctacaagccagaagagattggaggccaatattcaacattcttaaagaaaagaatttccaacccagaatttcatatccagcccaactaagcttcataggcaaaggagaaataagatccttttagacaagcaaatactgagagaatttgtcaactccaggcctgccttgcaagagctcctgaaggaagccctatatggaaagaaaaaaccattaccagccactacaaaaacacatttaaatacatagaccagtgactctctagagcaaccacagaaacaaggctgcacaataagcagctaatatcatgatgataggctcaaatccacacatataaatactaatcttgaatgtaaatgggctaaatgccccaattgaaaggcacagagtggcgagctagataaagaaccaagaccaattggtatgctgccttcaacagacccatctcacatgcaatgacatatataggctcaaaataaaggaatggagaaaaatctaccaaacaaatggaaaatagaaaaaagcaggggttgcaaccctaatttcagacaaaacagactttaaatcaacaaagtttagaaagggcaaagaaaggcattacataatgttaaaggctccattcagcaagaagagctaactatccttaatatgtacacacctaacacaggagcacccagattcataaagcaagttcttagagaccttcaaagagacagactcccataaaataatagtgggagacttcaacaccccactgacagtattagacagatcatcaaggcagaaaattgacaaagatattcaggacctgaattcagccctggatcaaatggacctgatagacatctactctccatccgaaaacaacagaatatacattctcatctgtacatggcacatattctaaaattgaccacataattggacacaaaacaatcctcagcaaatgcaaaagaactgaaattataacaaatcactgtctcggaccacagcagaataaaatttgagattaaaacaaagaaaatagctcaaaaccatacaattacatgaaaatcaaataatctactcctgaatgacttttgggtaaataatgaaattaagatagaaatcaagaagttttttgaaactaatgagaataaagatacaacataccagaatgttgggacatggctaaggcagtgctaagagggaaatttatggtgctaaatgcccatatcaaacagaaaaatcccaatttaacaaactaacatcaaaactaaaacagctaggaaaccaagagccaaccaaccccaaagctagcagaagacaagaaataaccaaaatcagagctgaacataaggagattgagacaagaaaaactattcaaaagtccgcaaatccaatagttgcttttttaaaaaaaattaataaaatagatcactagctagactaataagaaaaaagagaggatccaaataaacacaattagaaatgactaaggggatattaccactgactccacagaaatacaaataaccatcagagaatattatgaacacctctattcacacaaattagaaaaatctagaagaaatggataaatttctagacacatacaccctcccaaaactgtaccaggaaaaaattgaatctctgaacagaccaataacgagctctgaaattgaatcactaataaatagcctaccaaccaaataaaagctcaggaccagatggattcacagccaaatcttaccagatgtacaaataagagctggtactattcctattgaaactattacaaaaaattgaggagaagagactcctccctaactcattctatgaggccagcatcattctgataccaaaacctggcagagacacaacaaaaaaaggaaactttggccaatatccatgatgaacattgatgcaaaaatcctcaacaaaatactagcaaatgaatccagcagcacatcaaaaagcttatccaccaccatcaagtaggttttatccctgggatgcaaggttggttcaacacacgtaaatcaataaatgtgattcatcacatggacagaactaaggacaaaaaccacatgttaatagatacagtaaaggcttttgataaaattcagcacgccttcatgttaaaaactctgaacaaactaggcattgaaggaacatacttcaaaataataggagccacctatggaaaaacccacagccaaaatcacactgaatgggaaaaagctagacagaaaatcagaaatagacagagattccctctctcaccactcatattcaacatagtactggaaatcttagcctgagcaatcagacaagagaaagaaagaaaacacatccaaatagaaaaaaaagaagtcaaactatctctgtttgcagacaatatgattctacacctagaaaaccccatagtctgtgcaccaaagctccttgatctgaccaacaacttcagcaaaatctcaagataccaaatcaggtacaaaaattagcattcctatacaccaacaaccatcaagtcaagagccaaatcaggaatgcaattccatttacaattaccacaaaaagaataaaatacctaggaaaacagctaatagggagatgacagatctgtataagaaccataaaacactgctgaaagaaatcagagatgacacaaagaaatggaaaaacattccatgcttatggatgaaaagaatcaatatcattaaaatggccatattgccaaaagcaatttatggattcaaagtattcaaagctatatccgtataaaactacaaatgacattcttcgcagaattataaaaaataattttaaaatttatatgaaatcaaaagagagcccaaatagccaaggcaatcctaaacaaaaagaacaaagctggaggcatcatgctacgcaacttcaaactatactacggagctacagtaaccaaaacagcgtgatgctggtacaaaaacagacacataaatcagtggaacagaatagaaaacccaaaaaataatgcctcacacataaaactatctgatctttgacaaacctgaaaaaaacgagcaatggacaaaggactctctattcaataagaggtgctgggataactggctagccatatgaagaagattaaaactggacccccttccttacaccatatgcgaaaatcaactcaagatggattaaagatttaaatgtaaaacccaaaactataaaaaccctggacgacaacccaggcgataccattctggacataggagcaggcaaaaatttcataacgaagatgccaaaagcaactgaaacaaaggcaaaaattaacaaataggatctaattaaacaaaaaagcttctacacagcaaaagaaactatcaatagagtgaatagacaacctacagaatgggagaaaatttttgcaaatatgcatctgacaaaggcctaatatccagcatctataaggaacttgaacaaatttgcaagaaaaaaacaaataacctcattaaaactgggcaaaggacatgaacagacagtttgccaaagtagacacacatgcagccaacaagcatatgaaaaaaagctcaacatgactgatcattagaaaaatgcaaatcaaaaccacaatgagataccatctcacaccagtcagaaaggctattattaaaaagtgaaaaaaaatagatgctggtgaggttgcaaagaaaaggagacactatacattgttggtgggagtgtaaattagttcaaccatcatgggaagtggtgtggtaattcctcaaagacttataaacagaactaccactccacccagccatcccaatactggatatataagcaaaggaatacacattgtttaatcataaagacaagtgcatgcgtgtgttcttgcaacactattcacgatagcaaagacatagaatcaacctaaatgcccttcaatggtagactggataaagagaatgtggtacatacacaccatggaatactatgcagccataaaaaagaacgagattatgtcctttgcagggacatggctggaactggaggccattatccttagcaaactaatataagaacagaaatccaaatatcacatattctcacttataagggggagataaatgatgagaacagatggacacatagagggcaacaacagacattgggacctattggagggtggagggtttgaggaagaagaggatcaggaaaaacaactaatgggtactaggcttaatacctcggtgatgaaataatctgtacaacaaacccccatgacacaagtttacctatataacaatcctgcacatgtagtcctgaacttaaaagttattaaaaaatgtaatgcacacatagctaatttttatttaaaagaataataatagaaatctaataagcacccacatacatcccatccatctcaagaaacagaacattgtcaatgtttccgaattcctctgtctgccttaactgatcatgtacccttctctgcccacactccagacagggcaagtctccagaatttttatccgtctcttgcttctctttttagttttaactcacatacatattccactaattgacacattagttctgcctgtttttgatgtttatataatgtatagtctgtgctcttttgtatcttgtgcttacacatatatttttgagattcatcatgttaatattggtagttggccttttgttcaccactgtataatgttctgtagcatgaatgtatcaaaactaatatattagttctactcatgattgacatcaagatattttttctattatgaatgctgcttctatgattattctttttcttattttttatttttttgtagagatgggagtctcactttgttgctcaagctagtttcaaactcctggcttcaagcaatcctcccacctcagcctctcaaagtgctgggattacagttgtgaaccaccacagacagcctatgatcattattctttttttttttttttttgagatggagtctcactccgttgcccaggctggagtgcagtggtgtgtgatcccggctcacctcaacttccgcctcctgggttcaagcgattcttctgcctcagcctaccgagtagctgggaatacaggcatgtgccaccatgcccagctaattttgtatatttagtagagacggggtttcaccatgttagccaggctgacctcaaactcccgacctcaggtgatccgcccacgtcggtctcccagactgctgggattacaggcgtgagccaccgcgcccggccatgatcattcttaaacacggcttctgaagtgcttctgcaagagtttctctttggttacaatccttgaaataggaatactgagtggaagaataaatgcatgcccaatttactaagggacaccaaaatatttttcaatgtattttcctattaataatcacttcagcagtgtttaagaattcctatcgctacatatcctttcttactgtcagtactatcttttatctttttttcaatctggtggtcatgcatatatgcatatttcacaatatatttgtgaaatgatgtctgatctctcacaataaatatatgaaattatacctgatatttaatttgcatttcctgactaatccaattcctgacttcataaggttgagtctctttttaggaattataggtactcttctcctcttttgtgaaattcctattcctgtcttgcctgcttttatggagtttattgttctcattatgtaataggcatttcttatttgaagtactttgtcaagtgtattgcaaatgttgtctcctggtttgtggcctgtcttttaacttggtgacgtctttgatgagtaggatatacagaagttgttaaaaatttaatgtagtcaaatataccaatgctttcctttatggtttgcattaagaaatccttcccttctctgaagtcataaatccattctcctagatgctctactaaatatttaaaaaattacatttaacattttaatttcttaatccatgtggaatgtctgtgtgtgcatgtttgtgtgtataatacccaaaatgcttgatcaggtaagcatttcatatctgaagaggctgtcctggcaccaggattcgggacaggaagcatggcatgccagaagagtacatctctgtatctctttagttggagtccacccaggattctatggtcctaattaatatagtgttataagcctggatacctggggagtcaagtctacctattttggtagataggccttgtctgtttgtgatggcgcttttgatctgtcaacctggtcaggctacaggccagttatacaaacataatccaggtactgctgtgaaagaattcggcctatggaattacagctcttaagtcagttgacttcaagtaaggaagattattctggattatctgggtaggcctgattgaattgttagaaggccttaaatgcaggactgaggtttccccaggagagagaagaaattccacctgtggatgagagctgtggcttgttcctgtgaagtctcattgtgctcatgacgactttctgcatgcatttgggacttgtttaaccagcccctgcaatcatgtatgccaattccttgcaataaatttctgtgtctctcgctgtttctctttgtccctgtctgcctctctgtttctgtatttctctctgtatgtatgtgtgtatacatacacacacacatatatattcatatatatatatatatatttcttcctctgcttctctgtttgaaccttgacttaagcattcttctctctttcatatatattacaaaatcaacttgtcaggttgattttgtaatttatacatgtttgggtttcaatgtatattacattaaatctatatgataatttggatggaattgatatcttcacagaattgaatctttctatccatgtttttccacttaggtctttttaatacctttccatagagttataattttctgcaaaagctttatttttgtagctgttacaagtgtcaatttctaaaccttgttcttataaaagacatacataaaaattgcatggcttaatgaattattataaacacgcatataatcactgctcaggttaagaaacagaacattgcctgaagcttgctgagtgcctctgcctgttcacaacccacttcctctacctgaaacacaatcattattcggaccttagaaaactgcctcacttccttttctccctcttgtccttccacaattttgtcacttctgtaagaatttctaaataatatgatttagcactttatagaaatggaatcaggcagcagtgtgagtccatattattatttaaactttactctttctcattaaatacgtgtttatcattatgaaatgaccctcattgcctcttaaagtcttttttttactttaatgtctactttgtgtgatattaatagagcacactaagattttccccatccttttatgttttgcctttctgaatccctattcctggtgaccactgtggtttgccacatcttaaaaatatttttgcagagaaccctttactatgttattgccctctgagctacaagacattatatatttggtacagattttctagtttttttaagaggatggcgagtgcaaattaaattcatctgatttgcttttattagaagcagagtccccagttgtatcttcttttaaattgctttttatttgtggatggctttataaaataagtttttgtgcattgatcctacaccctgcagacttgctaaactcgttaatttttagctttttatatataaattctttcaaatttccatgtagataatcatattattagcaaatgatgagagatttcattctttttgatccttacaccttatatttcttttccttgtcttgcactggcaagtatctccaatacaataaatataaaatagcaattaggctttggtttctgattttaaagggaatccatttaatgttttgcactaagcaaaatatttgcatgttttttaaaattggtatgctttatcagatcaagcaaattcctttttattcctagtttgctaagagattttttaaaaacatcataaagtgttattgagttttattagagcttattctgaatctattaagatgatcatacggtttctctgaatctgttattgtggtgagttacattcttaggtttttctaatgttgaaccaattttgcaccttgaataaattctacctgattatgtgcattatcacttttatacatttattgatttggtttatttagagcttttgcatctacgttcttaaatggcctggaatttaacttttgtataatgtccatgtctgatttgacagcatgtttacacaaacctcattaaatgagttggggagtgtctcctgttgttctttctttgaaagaactagtataagcttggaattatgtgttccttgaatactcaggagagctcacttgtaagccctctgggttctgtgttctctgtgggaagactgtaactactgatttaatttataggctggatctaccatcattaaagattctcaccatgggaatgcctgctgtaccagcagagcccaggctgtgtgacagctgggaagtccctattaccttgctgtcctcctgtccctttccaactttcctggaggcaaaatccacaggggctgcagctccccccagtggctacagaagagcagctctgaaggagagcttgttagcggtgggcagctgcagcctggggaaccacataggctctgggcacttgcctgcaccgtccaaaggctgccatcttctccatctttgagtaggcttgctcgagtcaggaggaaataaggaccgagagggacaagtgagaaccaagaaaggagggctagtgagagtgtaatggttctgtaggctccccattgtacggctcactgacatttagttgctagataggggatagcccagggagggggcagtggtggcagccatgtggtgggtgcctggtcagagggcgggctcagtttggcagctctttaccagccagtaaggacagagatctcaacattttaatgtctgttgtagctgttctactgtgcaccagctctgaacactggatttagatttctggattgacattattttctttcagctctttgaagatattatatcacaggcatctggcttcattattctgtgagaatttagctattaatcaaactgtaaattctttgtagataatttatcttttctctccaacagcttttggtgtctttttcctcttctagtgtcttacagtttcatgataacatatctaagtgtcatttctctgtattcagcctgcttggcttcctgatgggaggactggactcttgcatcagtattaggaagttgtcaggtgctgtcttttgattgttgccctcctcattctctcaattacctccttctgaattgcctattgtgccttctcactttttcctcatatctttccatcacttcatttctctctgatgacttctagataaattcttcagatctaactctcacttttttgattttctatgataattccagcatttgaagtgtttgtgagtctactcttgggatatatcactttgctgattctcactcaagtgacttgtttcctttgtgttttctggtttttaattgtaaggtctgaatttttttttctttaaacctttatctgtgagagatatttgaggttctgaatttgaagtacttgggtcagggatctctttaagctaaattttcatattgggggtttgcagtaaccatgaaagtagtgtgaattccagacccaaacccagtttgttatgatattgtagttactaattttgcagaaaagatagccccactcctgccagtttaccagagacaaggcaaaaataaccaagtgaatattactacttgctttctctatgagggatggaggttagagaggctctattttactcactgtagatgtcagccttgagaatctcagcgttgaaagtcatggttctcttacccagtctcctatgtgtccttcttgacttgggcccagacattctccaggctctggtgcttggccaattaattttctccaggtttttctgtaagctctgtaaggtaaggtttcacttcatgtctagcagtcatattgccgggagtgagtgtacactgtacttgaaaagaaacccattttacaattaggaaactgaggcacagagagattaagtaacttgcccaggatcatagaactagtaagtggtcaagttgggactgagatctaggcagctgactctgctgaccaagtacttaaaccaaacacaggctgccctatggtaattcttcattcttcttaatctacctccacaaatgttctgttgggctttttttttttttgatgaagtctcgccctgtcaccaggctggagtgcggtggcacgatctcagctcactgcaatctctgcctcccaggttcaagcaattcccctgcctcagcctcctgagtagctgggactacagtcacgcaccaccatgcctggttaattttttgtattttagtagagacagagtttcaccatgtttgccaggatggtcttgatctcctgacctcatgatcctcccgccttggcctcccaaagtgcttgttctgttgggctttctaaacatttttttcctaggcattacatttttttttggaagtaactccaggaagctcactattttgcaaacactctggatgtattaccctggtttaaggtacctcataagaaacgggaaaggagtaaagctgggaaggtgggaaatggagttctgttgattcatttgaaaaggcattaatactgtgagaaggtgaccaggaaacagcctctccaagcaccttgagaagttttctgaatgaatgtagatagctaatgggaatctcaatggaaacagagggacagtccctgatgctttatacaggtcacctctctctctaacaactcttggggcttcaatgctcgctcctggtgaacaactcttggggctagatgctcatagttctgtagggtgggaagtccaagatcaaggcatgagatcaagatcagactaaaaaacaagagagctctctgaggcctattttttaaaggcaatggttccattcatgaaggccccactttcatgacctaatcagcaacccaaaatcctacctcctaataccatcacgttagtgactcagatttcaacataggaatttcggagggcacatttggtctgtagcatgagtatatggtgtctattgtatacgtctttcaacattttaatatgtttgaacattttcacaattaaatatagacgagaaggggaaaaaagtagcctggggtcgatccctacctcattgcaggttcctttcaagtgacttctcacttttgtcagcaaatatacttaatatagtactctgtacacacagctgctcatgaaacagaaaactaacatctaaattatcatctaaaagtatatggtgctccccatccccatctgccacatatgattcaaaataaaataatacaaacctgaaaaaatatgcatgaaaaagtctatccaagtttagacttttcccattttagaaacgtgataacatttctaaatattttctatatgtgttcttgctttgctggttctctaagcatggacttactatgcaacttgggcagtctagcactggtaggctcttgcatttgttaattacggaaaaagtagctttttttaaaaaaaaatatttatttatttatttatttatttatttatttatttatttttgagatggcgtcttgctctgtcgcccaggctggagtgcagcggcacaattttggctcactgcaagctccacctgccaagttcatgccattctcctgcctcagcctcccgagtagctgggactacaggtgccggccaccacacccagctaatttttttcatattttaagtagggacggggtttcaccgtgttagccaggatggtctcgatctcctgacctcatgatccgcccacctcggcctcccaaagtgctaggattacaggtgtgagccactgcacccggccggaaaaagtagctttataagggactgaagcttgtccatgcctgcaggtaatatccacctaatttcatggcaagctaaactctcttttatcactatctagataaattcggcattatattctcattaaaacccatctttgcttaaaatactggctaccttgtgtgtgttcaattcttttagtaactggtacttttattgccttgtcatgtttaccttagtcacttactaaaattccttttgcaaaacctcaactgtctggttactttccaggataagaagatttgctttagagagagaagatttgcttcagagacagatttgcttcagagagagaaggtcctctctaatttctttctctgccttatatctggttttgctgctgcgtcaagctgttagccatattcttaaaaacatttactttgggcattttacttttcttattaatttttagtatttctattttatcagcatgttgttacaatattgattaatattgcttactaaatgtgattttgggatatatggggtccagtgtaaggggtctgccttctcctcatccctctcctttccttggaactgcctcccacctcttaatccagcagaggagtcacattcctacatagttccaggcttctagttgaaactaagctaggccagtcgaagatggaaccaaaagacgcagggatcagttgacctgttttttcaaatgaccaagacatcaattcagggtgttggtcatagctgctttcctcccagatggctgggatggagtttccattttcactaaaaacttttctgttagaagcttatgtggatcccttcagtgactcatatttcaaaaccacagtaggatgataggttgcccataattggtttaatttgggaggtatccgcgggaatgcagctgcatgaggaatccctggttatcatctatcaaggttgcctttgataggaaaatcacacttcccccagaaactagaatatactatcctcattatgcaacatgtgaggcttctgggctaagcaatagctaggaaaagatttttttaaacttgactagagtatgcaattatttaaaacaattcttggccgggcgcggtggctcaagcctgtaatcccagcattttgggaggcagaggtgggcggatcacgagatcaggagatcgagaccatcctggctaacacggtgaaaccccgtctctaataaaaaatacaaaaaattagctgggcgtggtggctggcgcctgcagtcccagctactcaggaggctgaggcaggggaatggcgtgaaccaggaggtggagcttgcagtgagccgagatcacgccactgcactccagcctgggcaacagagcaagacaaacaattcttattcacctatgttgactacacagtattttgatttaaatataattaatatatacaaacataaaaaactcattatatactccttgtatgagttatatactcacaagtgttatatgactataaaactaaaccgaatgtacaaataagacagacaatactgtgtgaaatggataatagtcacatttgtaaagtttttcctgtgttcacagtatagtctaagtgctttacattttgctaatttaattatcacagaggcaggtcatctgatttacagttgagaaactgaggcatacagtccacacaactgttaagtattagagctttgctttgaacccaggaaatctggcttcagaaagtgtgcacttaataattatgttaagctgcctttctaaaagctagtgaattgcattaaagtgacagatagtgtgactcagttaacacttatttgcaggtagctcgtttaactgggttgaaatatatttgtgtatcaacctgaatcttttgatttagaaaatgatggcccatcatctgagtcattactatgactcctgtcattattttctctttttcacaatgaatgttttaatcacacatctgttatttgaatgagccaatttagcagtgcactacaaaacacatttttattctgtaaaataaaacaaaataaattggcatgaaaaagatgtgattagaggaatacatttatacattgtaggccaaatgctgtgggttcttttgatgaggcttaaaagaacttgttgctcaattttcttatcattttttcccctcatttaactggaaggaaaacctccatttatggtggtgtttgccttccctgggcttcaacgtgatcataaacataagagcaaaggggggacagcctgggacattttgcgaggagattgttatgcagattctttggaatttaagcaaatttaagcaatttcagcatggcaatctttgagatgaaagcacaaccttaaaattttttaaaagttatgttttctcaaaaatatcttcataggcgtctatggtcttcagctgaaaaaccactgggctggaggaatgtcttagagattggaatttaatctgatgctgaaaggaatgtggatgagcagagcaggcgccactgtagggcttggctgtggaattctcaagcgtgaacgactcagtgctttgagtgccatccacaatctgttgcagtaattatgaccttggctctgtttatttgggattgtgcttgttgtgttgtcacagatctccggtgttgttgctgaagcccaggcttaatttgtattactttaataaatctgtaggtgggactcagcctgaacttttactatttgagccccaacttacatgttccacataaaaagaagagtatctactgataagagtgccccgatgtgggattgttggaagatactggcccatacaaatttcctggcttccttgccactgctgggtcaccaatacctggtggggatctgcacgcagttagtgttcaaggagtccatgttgagtgaagaaatgccattcactcttctaaggtccagagagatgttttcagtgcctctgaggcacaatatagtttcaggtattttataaatatgatccaatgatttaatggcattgaagaaaaaatgacaagatgaacttttttaaaatcaatgaattcttttctttttttccccttctctgagtaagggcactgaacatctgcacttctattttaataggcacttctccgtaagtgttctaaactctgctcagcctcaccctcagctggatctggtgtcagtagcactccatgtaggatgatattagtgaggaggccaatcacctggtcgtgtctgtcctctcaggacatgcctaagaggcttctgaaatctccttagagctaacttgcaaggttcctgctggaactcattacagggaaagaaaaattttcatgatgctttttttggacaaactcagatcagctaatgaaaaatgaaagagtcagtcaagaggaagtagctgaggagagagagcacccacgtgagaacaggagagaatatttcctttaacatagaacacactaggtttaaaaaaatagttctagacctttctctttgcagctatacaattaaataataatgaaagaaatgtatgttccaaaaaagtatggtgtggagatggtagtattgcctagctagcattttgagtatttttcctctagttagtggtgggttgcattgattctctccattctctcaggactggtctcctttgggtttgacagcatgttgccatggtatcatcaagatctgctttcctgcagatggacctgtaaataggctcagtatcagcaagggagtggagagggggaagaatataatttaactactctaattcatgtaatgagactcatgaatgttagtgaagtaatggtgaaaatattggctagttgtatgcagaggaattaaaaataatcccctgatcaaacactattcatgcacactgtactcactgttgtgcttctgaaatattttaaatttatattttaagtgtggtttgaactttccaacacctgatctaatactgaagtttatcttagaggacttagacatttatcttcttcttagattgcatgtagtcagttggtgtagtattgttttttacaggacctcacttttaagatgaagcaagcccttttggaaagaaaggtgctttctttatagtggttttctatgtatcccaaagaagtttattgttatcattattcattattctcagcattacctagcttttaaaactgtttattgattattgtaatagattgcatgccattttggtaactctaggtttaaaaattctacagataaaggcagcaaaattcccccaaataattacctctttaaatagtttaatggaataattaaatctaattctaagcagtactcttctttttgggaccctgtattctaaatttttaaagtactcagtacaaactttaaacttgaatgtatcaaaaaaaaaaaatagctgcacctaagcatctctcttccagacaggatgaagctgtggaaagaaggacccttcatgaggggcagagtgctggcaacttcagaatgcttgaaggggaggaatgaaatatggcagagagtgaaaatatcagattaaagatactctctatgccttagaatagtgtttaccaatatggtcggcaaatatggttcaatgaatgtcatcactctgcataggttcagaagtggtatgtcacttacctttccttttaaaatccaaagcaggagccagtacctggcagctggaatcaacaccagagaccaaacaaatctctggaaagtttttcatgggaaatccaagaagctacatctgaagaaaatactttgtctgtgaccaacaagagaaggacagtttctctggtttctatttctaccaacattccattagggtctagcgacatctctggagaaacttaaggttacttggatcccacaagtgacagaacaaatgtagccatccttaaaggtaaagcaattcactcagaaatatgtggccatcttgtcactgagaagcatccatgtagatggcaagtggcctcactggtgtatgtatatgggtattaagtatgtgtgcatgtatgcacacatgtgtgctatggtgtgtgtgtgtatgcacacatacatgcacatatacttactatccataagcattagggtacttatgggtattaagtattaattgtgtgtttaaactcagaatttaaacacacaatttggccaggtgcgatggctcacacctataatcccagcacattgggaggctaaggagggcggatcacgaggtcaggactttgagatcagcctgaccaacatggtgaaaccccacctctactaaaaatgcaaaaattagccaggcatggtggcacacgcctgtaatcccagctactcaggaggctgaggcaggagaatcacttgaactggggaggcagaggttgcaatgagccgagattgcaccactgcactccagcgtgggtgacagagccagactccttctcaaaaacaaacaaaaatacaatttaactaatattactgttgttttctctggaaccacatacttagaaactactagtgatatggtttggttgtgtcctctggaaccacatacttagaaactactagtgatatggtttggttgtgtcctcacccagatctcaccttgaattgtaaaaatacccatgtgtcaagaacagcgccaggcagaggtaattgaatcacgtgggtgtttcccccaatactgtccttgtggtagtgaataagtctcatgagatctgacaattttataagtgggagtttccctgcacaagctctcttgcctgccaccatgtaagacgtgactttgctctttggtcacgttctgccatgattgttaggccctcccagccatgtggaactgtgagtcaattaaacctctttcttttataaactacccagtctcaagtatgtctttattagcaacatgagaacagactaatacaactagttattttcagtgttcaaaaatgaaattttcttagtatgatagtatgatatagaaaatttatcttgtattgtaacatctgatgtgaggttattgatgttttcaccacttatacccagaaacatcttcattgtctaccaatttgcatacatctgcctatcatgaggacgacaagagcagaactggctcaggagacagtgactcagtctttgtctgaaattagttactgattggctgtgtttcctgaaccaggtacttaactgctctggattttagtttctaattctttaagagatttagaggctgggcgcggtggctcacgcctgtaatcccagcactttgggaggccgaggcaggcagattacctgaggtcaggagttcaagaccagcctggccaacatggtgaaaccttgtctctactaaaaatacaaaaaataagccgggtgcagtggcgcgcgcctgtaatcccagctacttgggaggctgaggcaggagaattgcttgaacatgagaggcagaggttcgcggtgagccaagatcacaccacagaactacagcctgggtaacagagtgagactttgtccccctcaccacacaaaaaaagaaatttagagccatatgatatcttattcctcttatcatccttaggttccataggtcatgatagaatctccagggaataacggtctttctcttaagttatgcaaagccctagaaatggtaatcatttattggaaaaacatatgaatatagaagatatcatcgtaccgagttttataaaaactctttagcaatctatgcatgggctgactgacatgtttgccttgccactatcctggttgttttctcctttcacttaggaataagctctgaacataaggatctatgtaaaagcttttaggtctgttaggaaaatgctgactcaaattagctacaagggagagaagagtgagagtcacttgtagttgtttctttcttaaattcttagtgaccaaaaatatgagagagatggggaggtgagagagagagagagggagaaagaggcagaaagagagaagggagcgtgggagaagagggagaatatttgctgctgcaataaaaccagtttttttgttcatataataatttttaaaaactttttgctcaacttttccttgaataaagtacctacagctactttaaggattttgagttgaagcagaattactcaatgtggaaagggttattttataacggaaactgaaaaagatcaagaaagagggatgcatgggtaggaggagagtaaaggaaacgtaggagctaatttacttggtttcagagatgataaaattttaatgtcaatcaaaccttgtatattattcttcttatattatgtatatttagctttcttgaagttgactagtttggagacaggcaatgttatgctttgttgaccagtttaagatgccgtgaacttttttgaaagcaatttggcagcatgtatcaataatttaaaaaaaattataccatttgatctaatgattctacttttagaaatctatcctaagggaaaaaacataaaaaatgaagaaaaaataataaacaaaagatggttcttgctaggctatttttaatatcaatctgtccaaagtaaaaatatgtttttactttgttcctttccaggccagattccataatctattattataattactctcttgtaaatactttcattcctctgtctacctttcttttgtgtctctcgcctggctaaccctaacactgaataagcccaactctttactctctgtcaattcctaatcttggcagagagaaccacaatccagtggaataatagcactatcaattcatgattatcaacctcaaccactatttatgtgcttgatatatatgccaaattcagtgacaacttctactccttctcttagtgaatctaagcaccaacactccctttttcatgaaacaccctgaggacattcctttggcttctgtagcatcatggtttccttgtttccttcctgcatttctggagtctcccttatcttttacctgtcctttaagttttgcatttctttagacctcagtctttgagcttttctttcttcactgtgttctcttgctttcagtgaccgtaggaatccccttggctttaaatgcaacttctataacacagatgtcccaaatgtatctcttcagcccagccctttctccacgtctcagactccaacatccaaatacctgtttgtcagagccacttggacctccactgtcatcgccggctcttgctattccctccaggtctgctcttcttttagaaaatgcagattccacataaagaaattaacaatgtcccctaatattttggtgaatttcctattaggtaaatcatagctatttgtgaagagaaatacaaatattagaaaataaaatgaaccaacttagaatcaaaatcttcagaactttcttatccaaattcatgacttgggtgtttgcagtttaagcttctggcttaataaatgcaaatgttagaaaatacaaaacatggaatactattaggagctcatagtgtacctaatgtaatttgaatattattttttaaaaaaccacaacacaaatccttgccggtttcctaggcttttacatctataatttagacaaacagaacacacagcagatataaaaatgcttatttctcagaggaatggattcacagaaatccccatttgcagaaatgcacctgggattagtagcattagtgcagatattccacttatgtatatatactttaaaaacatcctgaggcctacaggaaaaataactgcctctatttcatgtggttgtcctttgggagaagcagagttgatatgtgaacattaacaagatgcattcacttttgaaaactagatcagctcaaaattgtgagtcataaacaattttctagctcagtggttctcagcttttggaaatatgagaacaactttttaacattaaaaaaattatagagatctccttctcataaaaacaaagcaacgctaaacaaacacctcacacaaaatcacagtagcttttatgtgttcacttctttcagttgaggagagagacaaaagtgttactattaatttggaattctttaagaaacttgtattctttctcctttctcttgatttccttctatatttgtgcttacttttttgtttatgaactatatttttgatattaactttaaattatttgtggtaagagtaagaagaaaattaattcagtaatttttttattggataaattatttttaaaaagaataagtactttatatttaaactatttaaaactacatatgcacataggttaagaaatgagaaatccctctacagggattttaacaaaaaacagcaactcactggtatccctaaccattctcccaaatttctactcctctgcagcattttcaactaatagagctattcttaaaaatacattttctccatatctctatatagcagatttatattgttacttcttttgctacaactttattgttactacacttttgtagttttagtcgtaatgtattgcttgatatcctttgcttcatagcttctcttttgacctatcatacatgtttacttctattcctctcctgctctcctagtgaagcggagcacaattttggttagatcaatattcaatgttattttgactataaaaatgctatttacagataagccaactggtatactatgattactctttcttgtaaaatactttattttccttggagttaatactcattatttacttagttgttttctatgtttattcctaattcaatcctaaattctgtcagttgtccaaatttaatcagccacattaaattttgtctagtcatcttcttgaaaaaattcctgttggggccttccaacttgtcctaaactctcctagttactctcaagacttggtccagagttatgttcttgggaattccccccatctccctacagattttttaaacttctctattatgttggattgcctgtttttggttcccttgttttcctgtttcttagtttactcctttgttttggttgaacatgttctttggtagttttctgagaaagatgtattcaaaaaaagatttttttcagatcttacattatcagaaaatatttttggccaggcacggtggctcacgcctgtaatcccagcactttgggaggctgaggtgggcagatcataaagtcaggagatcgagaccatcctggctaacacggtgaaaccccgtctctactaaatatacaaaaaattagctgggcgtggtggtgggcacctgtagtcccagctatttgggaggctgaggcaggagaatggcgtgaactggggagatggagcttgcagtgagccaagattgcaccactgcactccagcctgggtgccagagtgagactctgtctcaaaaaaaaaaaaaaaaaagaaaaatatatatttattttatttggatattttttcaatagtttagatacagaattctaggttgaaaatcttttccccttataattttgggttctagcttctagtgttgttgaatgatgcaatactgttctgactcttaatcaaaaagaacaaaacattggtgtttttaggctcttctctgctttactcttgttctgaaatttcacaatgacatgccttcattgaggtctatattcgttcattatattagaactttgtatccctttcaatgtgaaaactaatttccttcaattacgggaaaattattttgtattactttcttaactatttactctctttttttctctgtgctctgtttctggattttctgttatttggatctttgacctactggactttcctaattttctattttttattaaataaatttccattttctatccttttgtcttttactttctggaatatattactttctggaatatttcttcttccttctactgagttttacatttatgctatcatatttttgatttctcagaactcttttttagcctctgcatatatttttgtgtcttattcttacttcatggatgtaatacattctcttatttctttcagaatattagggatattttttgaagactttttttctttctgtattgcatctatctcctgtaagttgcttttttttttttttctgttagttgctttgatttctgtatttcatatgaggtgctttccttacacgcctggtgatcatcacctgtctagtcatttttaaatgggacattaaaaagctgattggggaaggttcatgcctgtgaatgggactggctgtcatggccatctttttatatcagtataaggccatctttttatatcagtatccttaggactttcctggtatgtttgtactcaattttcagtaatggggaggggaagtgtcctcaaatttgatatgtaaacttttacttaattctacccatgtaattgcataggatgagttttcttaggttctttcaatgtaaagagaagggaggggggacctctgagctctgggagaattgttatgatcaccctgtaaaagaaggagggattccaatctaaagtttggttcagatgttgagactgatgatgccacacacgcaagaaaaagctatggaaaggtttattacttacagaattgaggtctctaggaagagtagggcagacctctcaagcagatcctaaatggcttgaaagagctaggaaaggagactgaaatgggtgtttattgctgttaggggatgatagcccaggtgaaggttcacttgcaaagaggattgcatggtttgaatctcccaccaatgccaaagcagggagcccccgagcttatcagcttgtgtagatgtgggacacaagaggaagaaggaaggtgaaggttaatgaaattaatcctcattacaggaatgctctggacagagggcagaacatttaagaacagtttccactttcagaaaatgttacaaggggggattgtcttacccaggtctgagatagagaaagactttcatttgaaagctccaattttccttttgtatggctaatgatgaggccaggagtatgtaggtgattctactgctaggacaacttgttaaatgacctttcatatgcagtggctctcagagtgtgagagatcaccagcagcatcagcagctccagagaattcattacaaatgcaaattctctggggatgaggccttacaatattggttttaacaacccttcccgtgatgctaatactgtgctcaaatgtgaggactttagatgtagagtatgcaagttaatccgagtctgggaaggagctggagaactaaatggcacagtatcatgggcataatgaaagaaaaggacttttgaatttttttattggcaggtagaagagacagaaagacaggtcatgtccctgggaagagcaggtacaggggaagattcctggagagaggagaggagccccgcaacatagcaggaggctagggtctgaggaggaagagagctggtgagaatttccaagaggtagggatggttaaagaggtcttaagatggtgatgtgtgacactctgctttatgctttctatgttgtaatattcctccctcagtcatgagtggtcagtggaagtcaattatactggccaggcgtggtggcttacgcctataatctcagcactttgggaggctgaggtgggcaggtcacttgaggccaagagttcaagaccagcttggccaacatggcaaaaccccatctctactaaaaatacaaaattatccaggcatggtggcacatgtctgtagtcccagctacttgggaggctgaggcatgagaattgcttgaacccaggaggtgggggttgcagagagctgagatcgtgccactgcactccagcctaggcaacagagtgagactctttcaaaaaaaaaaaaaaagaagaagtcaattatacacaactaagctgtatgtattagacagggaggaatgaaggagaagaggtcaagaaggaaaaaaaattaccattactctgtgcagagagaggatgtctttttaattttttcttatcaatgcattcagtattcactgactgactgactaaataaatgaaatgtctgagtacttttagatttatggaaaggacttaggccttttccaaaaaaaaaaaagaagtaatttgttgccttaagcatatcatgtattaaaaatagaaataaataatgattattatgtattttattttttaaaatgcagatagcaaaatatgtgaatccctttatatagactagctgtataaattatgtatgtaaattccttatagagtgtacctatttctataaatgtttatataaactatagtgtctacattttctttgaaagttgttaaactcttattcctataaacagatgtcttataagcttttagaatactttttctcattattttaaaaagttaaacattcttattagggattattggaaaagaaaaataatccaaatggaataattaaagttattcataacaatacacctagaaatgacaggaatcatgtagagttgtatagttggaagggcccctctgtgttaattacatacctgttattttacagaactccttgccatcctaacttccagttcagggtctttccttccacacatttgtttattgatttagaccaaaacatcagcattaattgttatccctcatcactgtattagtctattctcacattgctataaggaaatactcgagactgggtaattaataaaggaaaaaggtttaattgactcacagttctgcacggctgggaaggcctcaggaaacttacaatcatggcggacggggaagaggcacgtcttacatgatgactggtgagagagaatgcacatgtaggagaaactgtgaaacacttataaaaccatcagatcttgtgagagctcactatcacaagaacagtatgggggaaactgcccccatgatcccaggtcctgccctcgacacgtgggaattatggggattacagttcaagatgagatttgggtggggagacagaacctaaccatatcgatcactttgcatagttctccatcattaccattgtggtaggaaaaaaggcccaaaccccttcattgaggaagtgatgctcttgcacgtgtgactttttttttttttttttactatgtctttcttggtacagatggcccccaacatttggtggtttgactcatgatttttcaacttcatgatggtgtgaaagtgatatacattcaatagaaatgacacttaaaattttgaattttgatttttttcctgggcttgtgataggcggaaggatacttttacacaatgctgggcagcagaagggagctaccattcccagtcaaccagctgatgatgagggtaaacagtaattccatctttcactttcagtaaagtattcaaaaaattacatgagatattcacactttagtataaaataggctttgtgttagatgattttgcccaactgtaggccaatgtaagtgctctgagcatgtttaaggtaggtcaggctaagctatgatgttagataggttaggtgcattcaatgcatttttgacttacgatattttccacttaggatagacttatcaggacataaccgcactgtaagttgaggagcatctgtatctgtggatctcactctgtgaattcatccactcttctggcttccatgagctgaggatcctcaacctatttttgaagcccaaatttctcttctgcaataatttatttccatctgtccttttgagatttctttttggatgtttttctgtttccccatagtctttatttcaagaatggaattctggtttcctccagcatgctccaaaagagttcaggtctcctgacttaactatttgtgtttgtgtcactgccattgtggtaggaaaagagaccaaaatctctgatgagatttattctcatcactcatgtggtcttccaactatgtctctcatctctgatctgatctactgaggccccttgattgttctttcatactagcatctgtgctgattcttttctgttttttattgatcccctcacacctggatcattgtgattgtctcatgaatggcctccctaccttgagtctctcttcccctccacactgcacttccaagtgctgcggaattaaccttgtaaaaatattactcttactctgtaattaacctgtccaggaacccctgggggcttcctattgcccaaagggtaaaatccacagtctttgtcccggtgaccagctcttctgcaatggactggccatccatccttcaacctcatcttcttctatttttcaatgaaaaaaatctctgtaactaggatggcctgcttctggtttttgaattctcctggcttattctctccttcatgggagattatattgaataaggctctcttcttcaattcctattctagatgctaacattgtatttcttctgaataaccttttctgatcaactaacccacagatatttgtttctcatttgagcttataaagcacttgttgttccatgaattggctcttaatcatagaataataacactattctctgagtaactactatgtgccaggcattgttctaagtctctcttagttcatttaatctcagtcaatcagatgaagtaagtataattattatatccattttgcagttgagaacagaggtacagacaggttaagtaactgactcaaggtcataggatggtagaactaggatttgaatcaaaacaatctggttcagaatctgccctcttttccacccatactgcctctcagtctacactgccttcgattgttatttcactctctgtttgtgcgtgcccatttttatgtgtgttgccttcctaaagaaaatgaatgccccttgaaggcaggaactatatcttatatgcattctctaaaaggctaagcaaagagctatgtgcttaaataagcactgaatgtgtgtttgatttgaatggattatggaacctttttttttctttcctgagatgatatagctaactttttttttttttttgagatggagtctcactttgccacccaggctggagtgcagtggcacgatctcagctcactgcaagctccacctcccaggttcacacccttctcctgcctcagcctcctcagtagctgggactacaggtgcccgccaccaagcctggctatttttttgtatttttagtagagacggggtttcactgagttaaccagcatgggcttgatctcctgaccttgtgatctgcccgccttggcctcccaaagttctgggattacaggcatgagccaccgcgcctggccaatatagctaatttttatgatttgaaaagatagtctcagaatcagatttgactaagtcatgatgaagagaaaggtaaaaatcaagtggtgagccaatgtcctggcctcacctcttgggttcagtgaagttagatcatttcacaaattacactgtgtcatgtctgaaaagtaatgagggcttaatgagcccacacagttcttgcctttttttttttttttttgtagtgggtgaaatgtgaacttggttaagacctgtatgtcggcaaataagaattaactagccttgactctagaagttgcagctgaataaccatgattgaaaatgcaattactctttccccctgtgtttttttttttttgttgtgtttttttttctttccttctgaagccaagtatgagttggaggaaatgtttgataaaattttcctgtattctcagtgggttctcactgacaggctgttcaaggaaaattcaacaaaaatgcctgccataccacgaagaggcaaacagccagaggtatggtggacaagatatgtcttttaacactctgaattgtatgtattacatggttacttaaagctgtgtcataacttgtaacttttgttttttttctctctttagaaggaactttcctcagaagcgtttcagattactttaaattacttatcagaccatgcatactgggtaaaactgtctttcttaagagccattcacgtttaaaatgtggacatggagctccaaccccatgccagctgggtgttttaatagcagttttctggtatttttctagtactttataagtgaaaggggattcttgtatttattttgtgattattattagcccaaataaaatttgcctcttgcaaagcaccagtagagaaaataaatcattgaacattgattgcaggtcatgaactgcagagcctattgggcaaaatataggggatcaaaagaatgtgagcctggtcttgcttggtaaaaaaggcatttaccttctagtcatgaaggcaggattggagctgaggcccatctccttcagccacacattcttctttcagacatctcagcactcttgataatattcagcctttgtttatactcggtagagcctagatttgatttccagggtttgtcttccttccctgacctgagagaaaatcactcccaaggctgccagttgtggtctgtaggttgtgcacctgactgggactgtgtaaggttgcccagtgcccagcctgcacatcgacacatgtgggccctgaccattgtgtccagatgatttctgccaatcaccaatcttacttattctgtgttgatgtcatagatttaatactcagagttctaaaggaggatggccttacttttaaccccatgtactaaccataaaagatacaaagtaaacgccaggcacggtggctcacacctgtaatcccagcactttgggaggccgaggcgggcggatcacgaggtcaggtcaccagcctggcaacatggcgaaaccctgtctttactaaaaatacaaaaattagctgggcatggtggcgcgtgcctgtaatcccagctagtagcggggctgaggcaggaggatcacttgaacctgggaggtggaggttgcactgagctgagattgtgccattacactccagcctgggcaacagggtgactccgtctcaattaaaaaaaaaaaaaaaaagatacaaagtaaaaaaaaaaagcagaagttaattataaatagacaataatatactaaagattaactgacctggaaaatgtatcctcaaactttgggcataaaaccacaatagtgaaaatatgctctaagaatcagaagttttttcttctcttactggtttagttatttattaagatgctgaccctgagttatttaacctgttgaagtctataagaaggggaaaaacacctggcctacctgcttccctgggtgtggtagacagaaatgctggcagcatatgtaaggcccagttttcttcatggacacaggatgtaggggtggtctgggaagagcttctcggcgaaggagagtcttgagctagtattaaactttgaatcttgtgtattagactggggctgttggaacccaggagccacatttcataaccctctctgcctcaaatactcagcatgtagttctgaactccatgtttttggaatgagtggaaaaaatacataaaattgagcatatattgatctgagccctcaaattgttcaaatgaacaaatatattcttagaatccttactatgcattacttactaaatgccagccatggagataggcgcaaaatgtgaacaatgagcaaaacagaatagtctttgctcactgtgctggtagggcaggatgtttaaaaagtgattcaaaaggtgtcaagtattacaaggagatgtccagttgcataattaagagtctgacaattgctgattttaagactattatttaaatacattgaaatacatgagcataaaacttacctctaaaaggaattgttgaaacaaaactaggtaatttatatgatttaccatagattcttattttcctcttaaggagagacttgacttgattgtagattcttcttcttttcttttatttttttttgatacagagtcttgctctgtcacccaggctggagagcagtggggccatcttggttcactgcaacctctgcctccaggttcaaacgattctcatgcctcagcctcctgagtatctgggattacaggtgtgagccaccatgcctggctgcttgtagcttctttatggtatttatttgtagagacctaatgcatgatagagagaggatagattttcccaggaacaactagtggaattgtgaacttaaagttattttttaagcatttattgaacattcactaagtgcaagaagatactagccttgcctttagaactgcactgtccaattcagcgaccactagacacacatagccattgtgcactggaaatacggcaagtcccagttaagatgtgctatagatatagaacccactttgaattgtgaagtcctcatacaaaaaagtaaactatttcattattaatgttttatacattatatattaaaatgatgttttagatatattagattatatacaatatattaagataagtcttacatatgtatgtatgtatactatatacaatatattaagataatatacaatataaaattaagattatatacaatatattaagataaatcttatctgtttctttaagtgtggctactagaaaattgaaagttatgtgtgtgacttgcatttgtgggtcaattatcttcttactagacagtgcttctttagaatttaatagaaagaatgacatgtcacatcattgtaagtcaatgggacaagtggtttaaggggggtacctatgaagtatggagaagggtgcagctaatgagctggtgtgctcaggaaaggaggcaaagaggtggactatgagataagttttaaaggcagaataagattttcctagataaattgtataggaaggcaagtcaggaggagagagaagttggcctaagaacctagaagcagtagtaggaaacaatagaaatactattttcacagttgcccatgatttagttaaaatggtgtattactaatttagaatggttattattgatttgtcttgttatctgaatgacaacaatatttttcttataaaaactactcaaatatcatgcatgcattatctcaggataccaccagatggtgctgtgttctaggattgaaaaaggctggcaagaaaaagtggctctctgtcttgactatcagtggttcctaaacttttcaaaagggcactgtgatcatttttaggcttgcaaacccaatatgtatatgtccaattaaaaataaattatatacctaatattgcactaatatattgtggcaattataagacacacctatagaaaaattgaaatataaaaggctatgatagactgaagttttaatatttctttcctgcactacagtgaatcttttttgggggttgcatatccctgaggtgtgtgcatctgccctttgagaacactggtttattttacaattgttatataatttaattttttttcatctttataaagataaaggtaacaacaaaaaatataaaacaaaactttttttactacatgtacgtattcaaatatggatcacagttacatatcaaaccatttaaagcactgaaactagaaaaagttaagactttttttgcttggggatatttatatttttcagttttaaaccagatttggtgtaatatatcagaatcataaatggaataaaatagcagaccaagtctaaatttttttctgttatatatttttttgtttaaaaatcaaaaatgttaactttaaaaagcattaacaaccaaggcaaacaaacaaaagaatgggtatgaatgccaatggtgcccatatcaaataaatatgtagaattgaatttttctttgactgctaattttccttttgttttattaatttatttatgtatttatttggaattgaattttttaaaaccataaaaatctccaaacaaagaggaaaacgttctgactttatcagaggaatacaattgcagttttccctgattttacagaactatctctgtataaagtttttttcttgatttattttttttggttttttatttgcatacattttaagaagtacaaatgcagttttattacatggatgtattgcatagtggtgaagtttgggcttttagtataaatatcacctgaataacatgcattatatccactaagtaatttctcattccttaccccctcccaccaacccacccttttgagtctttaacgtctattactccacactctatgttcctgtgtacacattatttagcttccacttataagtgagaacacgctgtatttgactttctgtttctgagttgttttacttaagataatagcctccagtttctccatgtttttgcaaaagacatgatttcattcttttttatggctgcctagtattccatgctgtatatataccatgttttctttatccattcatccattgatggatacttaggttgattccataactttgctattgtgaatagtgctgtgattaaactatgagtgcaggtgtcttttttatatgatttctttattttgggtagatatcagtaaatcccagtagtgggattgctgggttgaatggtagttctatttttagcgctttgagaaagctccatactgttttccatagaggttgtactaatttacattcctgccaacagtgtataaacattcttttttatccctatcctcatcaacatccatttactttttagtactggctattctgactggtgtaaggtaatatgtcattgtggttttaatttgcatttatctgatgattagggttgttaggcattttttcatatgcttgtaacttttggatttcagagaacaggtgatccttgttagttaggtgatcttcactggccagatgattcccccgggtcaggccatcccctggtcaggtgatccctgcttgtccagtcagctgtggtggaggcagagtctggatgacaagagtataaacatgaaacccagatttcagggaataaggattatgggataggtagagactccagcaggcatcatctagagcaggggtccccagcccctgggccttggactggtactggtctgtggcctattaggaaccaggctgcacagcaggaggtgagcggcaggtgagcaagcgttaccacctgagctccgccttctgtcaaatcagctgtggcattagactctcacagaagcccaaaccctattgtgaaatgcgcatgcgagggatctagtttgcatggtccttatgagaatctaatgtcctaatgcctgatggtctgaggtggaagtttattcctgaaaccaactcccaaccgccacccctggtcaatggaaaaatggtcttccatgaaactggttcctggtggcaaaaaggttggggaccactgatctatagtaactcctggtaattacatctgtatgatattttaaatccgttttgtaagacatgtacagtgtggtatcgataaggatgctggattgcaagctattgaccttggtaatcattatgatactcatgtgaccaccttactcattagtctgaattcatctagatacaagcataacactaagtctccccattaaaatcaacaaatcaatcaattcatccataaaaaaaagaacattaaggaaagccagataaacaaaaactggttacatgagtatcataatgattaccaaagcaatgagtagacatggtttatcaaagtgaggggcagaatgtagggaagaaagcaagctgaggactcactgaggccaataaaggatctacttttctgccaaccacaaaccagggtaagtaagagtgttaggccattaggttgataagtagcaataacttattgtccatgtccttgatcaatcagttgtgtattaataaaggaacaattttgaaaacctcttgcaattgacctctggagtgcatttgctgtttgctttggtccttggcagtagctgaggagtggaatttaccgccctctttagcagcacttacagagaaagtcatgcccaagggattctgtcatcccaattttattcattgaatcaggaggaagtcaacatctccatagctttgggggttggattctgtcagaatgaggtgaatggaagaccatgtagatcatttctatttatttaaaattcaaggccagacataataaaataagaggagcttgataaattaatttttgcttcctaggaaagcactgtcttagaacctggctcacctgattttgccgatgagtcaactttgaagtgtgcctcattctggaaagtgaatcacgtaatcacagtaagttacacatatacaggcatagatggctccttgatgctatatttaagccagtgttgtaccatcttttctgtctgcaattcctgacatttgtcagatgaggtcaatataaaggtatgcactttttgacaaggacgtggttgtcatgttagcttcttatgcccttaactgccattttgaagatcaagtttaatttcccagtctttggattgaagaaaagctcaattcccagttagctttacatggctacaatgttatgacacacttctattgagaaatataaagataatacctatgattgacattagtactttcatggctttgtgtgtaggttacatgggtgttatacaatgatatctgtaatgccactagaccagtctccgttacttctgctttagttgttttattagtctgttttgccttgctatacagaaatacctgaggctgggtaatttaaaaagaaaagaggcttgtttggctcacagttctgcaggctgtataagcatggcaccagcaactgcttggcttctgtggaggcccctggaagcttccagtcatggtggaaggtgaagggaaggcaggtatgtcacatgttgaaaaaggaagcaagagagaggggagggaggcaccagactctttaaacaaccagctctcacatgaactaatagatcaagaactcagtttcacagggaattcctgagggctccaccctcgtgacccaaacacttcccaccaggcccaccctccaacactgggggtcacatttcaatgaaatttggagggactaacatccaaactatatcagttgtaattgattacattaatggattttcactattttactggttgcacttaggataaaagttaaaggattttaatattagcctatgacacatgttagcttgggacagaaccgagcctttagtatcaaccaaactaccaggcaacatgtgacttttttttacatggcagaatatacttcattgtatttccacgttctgcaaagttttttggggatagggcactgatattaatgaaaatttttatttatgtatcatgtaaatatttaaattgtttaagtgcattttggcattatgcacttcataaatatacacaatgttataattgttaaaaatattaggtaaaaaataaatataaattgtagttatgatcatttctttttgcctactctgggggtatgtgcgctctatttggacttctctatcaaggtcacaaaatcatgattagatccacctttcatataactagggaaataaaaacaaaccaatattaccattctggaaggaacttttctgagtctttttgtccaactacttgctttttaggcacaattaggaggttgtttctagataacattaataattgattctatgtggttttcaaagttctaaattttaaagaactcactcaatcatgcgtcagagtataattatcccaaataactggaaaagcatataagtgatgacatgactgtgattcatttcctctgtgtggtcattgtctgactctgtggaatcaaatgttcatttgagagccaggggtgcctgggacctgggaaaaatgcacccctgcccaggatcctcattctgtgagtcacacacacaaaaccaagggttggtgagtgacagctaagaccaaggttggaacctactcataggagaagcttcattttgttcttctccagcagcgcctatatagccacttctaatctgcaattcgagggatggaagggtgtattcagtttttcttccctagtaatttgaaaccaacttgataacagcttgttcaaatgaagaatggatagaacatctgtttaaatcaactctgagaggcagaaacggaacttttgtgtgcctaatattcccattggctaaccctgtccctaagcctccgtaccatggcttctgagagtttttggccaaatgcctagtgggagggcatggtcctgttgggaatggtttttctgcttggagatggctttggcttagcatctttctgttctccaaggctgtttactctgccacctatccagaaagaatttttttttatgagtccacaatttttcagtcctggaaaattttacagtgttttcacagacattatttcatttgatgttcataatccttcagggtaaatagggtaggttgctggtgtccgcgcattatggataatgaatcagagattcagagaggataaatctgacttctactccaaacaaaaagcagaaaaattatagcagaagaagcatatatcattctagttttcagcatatctagattaattctgattcatttttaatttcagctgaatatgttgtgctttctctattgctatcctggggttcatttagggtggagccacctagacatcatatacatgccttggctgcatttacatctcacccctcctgcttccccaagtataatcaccccagtgctatgaaaccgattagaagaaaatgaagtgttcagtgctaactccaaaattccaggtgctatgatactgctgcatacatccaaagggacttcttactttaagaagcccccttttaaatgaaactcttgacttcttagtgttgcctcagaaatgtgctcttcattgcagagaatattacagagaatgttctgctgctttgtggaggaaccataggaactgtgcacgatctttcttaccacagagtcacaaggagaaaattggcagcttaggagaccagccagctaaatgaaatgtcagccaacaaacaacttaaatgctcttggatcatttttcctctactttatcaagtagttttagtttgggggaagtcaacaatcttctatgttgcttccttactcaagatttctctgtctctgtcttctgaggcatttgtttctttatgcctggatctgccacttcacgttttgcctctttttccatatctacctctgactctatcttcatctttttctctctccctttattttctttatttttggtttctctctttcattttctcttatattgtctgtcaccttgatttctataaacacgtaattatcactaacagattaaagagctttataaatgatggtgaaaatttgaaacaaatttcttaaagaatctttgaatcattgtgtgtgtgtgtgtgtgtgtgagagagagagagagagagagagagatttaagagagagagagaaagagaaaggtatttattgttgacctgtgattttctcaatcctaatcctcaaatgagagttgtagaactgggattggaacctgcagccagctagggaccacatcacactgccttcctcctagtctccaaacatataactgaaatattattgtatcttgctcttagtacctctcctgtataaatgcgctcatgcatttcttttcaaataactgtaattctagatacatttgcataaataggattagaatcttgcaaaagtgtattctatccaaagggtgtctgcacaggagaaggaggccagcaggtgtcagtctcacctcagaagaagagctgagaatagtttcattgtggtttttcttcatcggagtttgcttttttgaatgaactttcaaataacctaagttaagttcttgtttgttttaagcaaactctgggttgatttaaaaagaaagtaggctatctcaacctcataccaccccacaacctgagttgtatacggattattctcttgttaaaaacccagctattggattgggatataattttattattgctgggcatctgggcatcatttaataggtactttgaaatttttttaattgcatggtaattgagtcatgatagagaagtgtccctttggatgagtgcagcagtatcatagcacctggaattaattttggagttagtcatcatctgtaccaaccacacattctcccaccccattttcagctgaggaaacaggttcagaaaagatttgttcaaagactcatggctgtgaggaagagggtcagcattaggactaaaatcaagagccaagtggctgagtctttaatgagcatattcagattgacggggcaaagcaacatcaggccctagtgggctgtctggatctgcaaatgttcacaagtgattatcttcagtgtaatccccatggcaacatagcaaagtgcctgccgtagctggatgagaactatgattatgctagagaaagaaagaaactcctagggacagcttgattgaggaggggttgttatgcatgtcgcctcgcagtgttgtttctccttaggcagcagtggcagcgatgtttgagaggggcctatggagcttgtttacataatcaaccggaaagcacttgtccatgttggtctgtgcccaggggctgacaagcaagccagaaatcactctggtttgtgtttctgtagttcttgaagatgtttaaagatggtcactcctccagatgatttctgccatttgctatggggatcaccacacccgagcaagctgcagagctttagggtaaggaacagatgtgatggtagtttttccagagtaaatgcttgccaaccttggctgacgaaactaggcttaacaaacatgcggacaagctcaaggcaggcctccccacgaattactttccctgggttttaaaaattggtttacaaatgttaaatgttttttgttaaaagacatgtctctataaatcagagcctgcaagtgcctttaagagaggcaactaagtagcaccctagtctagtcggttaataccactgctgtagacaagaaggtgtgttgctggattctgcttcaaggatgggcttgctggccagctgtggggggtgcaggcatcaggcaacccatagtcttcatagccttctgtgtctgcctcagctgcagagagacgcctgtcctttcgccctcagcctgagcagcccacctccattaactgagatggagagagggatagcggcccagccacttctgcctaaaggggccatctctgttggatcctacacttctgagctcccagttgggttggttcaggcttgttgggcctgcatggcaatccttctttttcctttgccaaatccatctttgtttgctgccattcacaggtgttgatccaaaatctatcttagtatctgcttttaggaaactctgcaacaatcaatctatcttttctgcttggaaaagagtagaaaaaaagaaataattggacccttaaagtaaatgcctaaaagccttttcagataacttaccttttcaataatttttatataagagaggaaaagattacaagttttttagtctcaggaaagaaaaattatctagtattaatactataaaagtagttagttatgtagtaagttgactcttaacatagcccacttaaccactttttacaatgggaagaaaagtttcctgatttcttgatttatgaggctccaaaaactcttgttttgaaggttttcacactcagttcctgtttaattaataattgccctgaatgttttcccatgtatctaattatgttttgcagttccatcaaccttcctagctagtctcaaaataccaaaacgttgccttgcccttgttgtgggtgtggtcaaggtttcctctcttgggatttcttgcatggggtatgaggggtggtgttgtgggggagaaggagagggatgcatagagtggagaagagagtgtagggcgctcatccctagggcaccagcctctactctgttgccccagaaatgtttccagacgtgtatctggacttcaccctttaattacctaattgggtaggttgtaggtagtatggaatctaatgaactggatcagggaaaaaaaaatctgaaggaataagtgatctctccttgaaggtgctgcagaggtaatgagcagagttaatgagtgactgatccatggtggtggtcaatttaatttgagtactgaggttgaacacatgctagatgtaatagaaagcaatattcatatgcaacacgttgggttacataaaatctggaaagcttataatttaaaagatacagacacacaaagcaacgattcaggccaagccagatttagaactgttttttaatatgagactgagggatgatatcctggatctcacaggggctggattttgcctgagtgttagagctaagataacatcttattcttgtctatatttcaagaagcattcttattaggaccatcttctagaagaaagaaagttacatttaagaagattgaaacgtgagtcagttttccgtattggagaacgatgaaaaaccaaatatatgaattctgaaaattttgtgaaagtagacaccttaaaaaaataagaaaacattatgaaacagagttggtcttcatttttaggtttaaccaatcctattaataatatatagatatacttttgtcataaaaatattgtttaggttttactcagtaagttgtgaaagctattttgcttgcttctaatatagttcttagatttcatctcatagtaaaaaaaattacaaacttcttacaaaatgaaaatatcctttccctcggtgatgattcaaaacagtcaataatattttctcacaatgctactgatggggtattctcagaactctccatttttaattcagatacatttctagtcaatttctttaacctcacagtgggaggtttaaactaagtgatgtcactttaggtatactcaaattggcaatgcaaatatttcctttgttggacattgggttctcacagcatctcctaaacaaaatacatttgctttaaaattagtggcttccatcatgcattggctggactgttttgtaagtctgtagtataaaaatccaaaaacatttgcttccagctggcctgtcttgaactaacactgtttttttttccttttctcacttcactctctgaccttttagagggttttcttttttatgctgctgttagctttcatctctgctggtcattctttcatcctgtttcttctgggtttcattaacctgtttgtgtgaatgttccttttttttgtttgtttttgttttttaatatgtaccagaaaaagaaagacttcttatagtcgtggtcactcaaaagtgttggtggttttttaagaggtcttaattggacttaatccatatttaactcccagcattttatataagatacatcttattgttcagactcatcttttctaaaagatagtagggtagggagaaaaaggatacaatttttgagcaattaccaaatctcagaaaaaaatgttcttaccaggtcacctggggataacgaaggcagtttggagattttcttctgattgtttttcgtttatttatgctttgagtatcagtgttcagttttaaattcccactgagaatgttctcattttgtcattaaacttgaatttagtctctgaatttttctcttgatgtatcacactaatgtccagaagagtcattaagaaattgtaaagagaccccagtgctatctatatttatggtcttctttagaatgtgtttatcagatatttgtgactctcttcatagaagtaaaatactaacattaaaaaagagattacccgagggctcaaaggtgcaacattatcttgggttttatttgtcaacaatttgaaatgtaagaaaaaaactgaatgtatgaatgtaatcctttgaaaaggtgactcttactggtggacttggtcctctggagttgaatgaatgcttctgagacataagtactttttcttttcctccctacaggttggtaggacaacgctttccattaactttgattttactactcctgatagtctgacctttatcttctaatccaattacatattcaaatttcttccttctgtttattctatctacctttagatgagccaactgagagatgaacatttaaaatgcataaatacgtattttgccatacactgtttttttttactttatgctttatacatcatgaaatttactggtaagacatcaaacacttattgaaggctgatatggtctggctctgtgtcctcaccccaaatctcatctcgaattgtaatccccatgtgtcaagggagggaccaggttggggggtgattggatcgtgggggcagtttcccctatgctgttctcatgatagtgagtgagttctcatgagatctgatggttttgtaagtggtggtttcccctgctcttttctctctcctgtcaccttgtgaagaagttgcttgcttcccctttgccttctgccatgactgtaagtttcctgaggcctcctcagccatgcggaactgtgagtcagtttataaattacacagtctcaggtattctttatagcagtgtgaaaacggactaatacaaaggcctgtgtatatttttgactttttatttggaaataattgcaaacgtatagaagttacttgaataggaatagtagaaagaacatcagttaaccctttacccagcttctattgtcaacattgtagtcaatttgcctaatcatttgtgcactctctgttctgtttctttctctctccacatagcatatatatgtgcataatgtatatctgcacacagatatataaatacatgtataataatgtgtatatcccataaaatattttgtttttactaaagaatttgagaacaagttttacatagcatggtcttttatgcctaaatagtttagtattttttatatatagttatattctcataaataaccacagagaagccctcaatatcagtaaatatgacattaatactttaatttgtatttcaattatctcattggcccaatgtttgttatagcttctttttccaccagtactggatccagtttagggacagatactgcacttagttgtcatgtttctttaatctctaaaacattgccatagcctttaaaaaattttttttttttgccctttgtgacagtgacagatttgaagacagagtccccatactttttataaacaggagtctttgtattttgaatttgtctgatgtttcctcatgattagatttaagttctgcattcctggccaggatattgcatatgtgatattgtgtgcttctcagacagccacatctggaggcacacgatgtctatctgcccctccctggtgacaccagttttcctcacacagtaggagtgttgtcctatttctccaactgtaaatagttactattttctcctttgcaaaataatgagtttgaagagagacactttaagaccacccaaatatcctgctcctcattacaatttcccctcagatttagcatctattgggattcttacctgaaccaatctttgctgtgatggcaacaaaatgacaaggatcacttcagcactccctccatgtttaccagtcagcatgtgaccttctactttaaccaaggaccctgccttttcctcgtgtatggatgaatgtgtcttagtctgtctataacaaaataccttataacaaaataccttacactgggtagtctatatatagtagaaatttattactcacagttctggagactgggaagttcaagttcaaggcaccagcatatttggtgtcttgtaagggccctttccttatacatggtgctttctctctgtcctcacgtggtggaaagagtgaacaaactccctcaggccccttttataagaacattaattcctaatcacctcccaaagatcccacctcttaataccattactctagaggttaagtttcaacacatgcattttggggggatacatatattcacaccatagcagtgtgtattatctgtatgaacccacggatttctgtttccccaccccaccttcccccaagtggtatataattattatccttatttagcttggtgcttggattatcccaaatttggccagttggggtcctttcgagctggctaggtatgcctgtgccatatgtccattaatctttggagcacatccttacctctgatataacaaaatgttccaggctcatcacacttccccagccctgctttcagcgacttctctaagaaccacttctctaaaagccccttttggtggggaatggtgttagagataaaaatccatgcactagctgtgctgtttgctcctggaatatctctgcttctacacctttttaagtgaacagagctaggagatatatgcatgcatatacacactcttacatacatacatataaatgcacatacatacacattatatgcacacatacatgtttatacacatacatgtgcatattttaggtatcataagtgtacaccaatacctccattttcaattcatcttttttgccttcctccattccatatttgcatgtaccttctttcacagtgagagtcttggcttctaaaatcgatagatttacacatttgctcaatctcataatacacctaaagtagtttcagaatgacttcacccatgtctacaaaaatgcaaagctactcaaaagagttcaggatctctagtttccagtttttccatctccctaccctgcccaaggctgagggctgtaggatgtgcagtcaaaactgttgtaagttatgaaaattagttattttttgccctgcattgtaattatagtattcatttgaaatacaattgggttcattgtttcagtttctccctttcctatccttgttgatttaattgttttggatatgtcaagcattaacatgctttcaaaagtcaaaacttacagaaagatatactcagaaaagtgttcctcctttttacagccctggcactctcatcaccttcaccctttgtgggtaaccaacatattaataattgtttctggcttttcattctggtgaatttttggtaaatataagatatatgtatgttttcttatttttccatctttcctaaacaaagatagtggtattacatacagtctctggtgctttgatttttcactttacaagatcttttgaccatcattccatatcagtccatagagagctttctcattcttgtttaccatgacagagtatccattgtgtgtttgtactagagtttattcaacagtgtcctatgattagacatataggcagtttctaatatttgcaattacaaacactgccacaatgaataaacttctggatatgtatttttgcagttgtaagactatctttagaataaattcctagaagtgagattgttgggtttatggacaaatgcatatgtaattttggttgctattgtccaatcctcttctgtggagtttgtatcattttggatcctcaacagcaacgtatgaaagtgcctgtttcctcacagccccagcaatgaactgtattgtgacacttttgaatttttcccaatgggatgggtgagaagttgtatctcattgtagtttaatttgtgtctactattatcagtgaagttgaacatcttttcaaatgcttaaggaccatttaaaatatctttctgtgagttgtctacttatattttttgcccatatgtctataggatgtttttctcctttaatttgtaaaagtttgtttttatattaagaatatccatccgttatctatgagatattcaatattgcttatattgcaaatattttatcctggcttgtactttgttatttgactttgcttgtattttttctttgtaaaattttaattttcatttagttaagtttatcactcatttcttcaattacatctgaatttttagtcacagttagaaaggcttttcttatagaggaattcacacatctttttcccctagtacttgcatagttttattttttacactttgattcattttgaatttatttttgtgtatggtgtgaagaattgatctaattttatctttttccaaatggctaatcagttgtccagcatgacttataaaaagccaatctttgctttaatgatttgcaataccaactttatcatatactgaatttttttttttttttttttttttttagatggagtctccctcttgttgcccaggctggagtgcaatggtgtgatcttggctcactgcaacctccacctcccaggttcaagcagttctcatgcctcaccctcccaagtagctgggattacaggtgcccaccaccatgcctggctaattttgttttttttttttgtatttttagtagatacggggtttcatcatgttggccaggctgatttcgaactcctgacctcaagagagctgcccgcctcgacttcccaaagtgctaggattacaggcatgagccatcacacccagcctcatatattgtattctgtatataattaagacctttccttttcaaggcaatatatataacaataaaaagatgaattaagtaagccctctgaattaatatattaagtggtccctcagaagggagaaattttgaaattaaatattatctaaagattttgatattcacttaatgggagtatctgaattaagtgtcacaactaaaatagtagagtggtcacattccctagcaccagttctcaaactttgttaaaaatgcagattcctgagctctatcattaaacatttttatttagaagtggggagtgtggccttcgtatttcagctgcttaactagtagcacagcgaagacggtataagggtctttggatcactttttgaaaagcatggtcttagagagaaggaacagcccacactcgttcacagtgtagcaacacgcgggaaagagaacagtcaaattgttttgatgatgacgaaaggaaatgcaggctttctagtatatacaaaacatattcaaaaatctagaagtttatcactaaggtttttggaagtaaatctacatttagcaactcaattttttagattttattctcaattatctggacatgagatttaggtctgtgattctcaggtcttcttagttatacatatcactcaaggagctatggactccaaatgacttatgtttgtgataaagcctcatttaccccacaataataggaaagctgctctgattttctgaagttagaaatgaaagattaagtaagtacatttgttatagtttaatattacacattgtatgatgaaaacattgtctcctacactgcctcctattatctggaaaattagtaatactaaagtgttctttcaaaaccagagacctaaatggctggaagcaataattgctagagctctccaccaagctttgactataaatatttggccatattgtgtgttagaaaatataagacacacttgctttcattttctgagcctgactcactgaattttcttgtccagattggttttcatctgtttattcctttagagcatagattagagtccattgtggttctcatctctgttatgcatgtttttttatgaataaaatgccaggcacacagagcatacatatgcacattttactacgagatagtaaaagctcaatgtgctgggactgcattcccaatgtgaccttattttcccactctttgcagttttaaaatgttacgttaatctggcgttctggacggggattttctcttctttacagtgagtcccagcagtatatagcggccatagaatagctaaacttgaagaggctttttggcaaagatttgaatatatgtcctttggccttttctggttcttgtctgtatttcataatacaaaactaatgaggatttcactttggtgaaatctgccttactaaatgatgcttgcaaataacacattcatttgttagcatttgggattctgattaaatcattttgctttagtagctgttaaagattatagtttgaaagaaaaaagtgttttggcattgagtactttgagacccctgtacagtgtaccaaaatctatgcaaattgttacgaggccttttaattacaggtgaaccccagcacttattatcatctgatgcacagattatgcacatgtcatatattggtaataaaatatcaaagttagactgacactcttaaagtgcttaacactgttttattggcttactagccctaactggattcattgcatccatttttttcattctgccacttaaaacatttgccacgttgttttattcatgcttttatcacagctttgtctgtaactacattgacttgattactcatattctatggcaattcctgacatttggcttatttttccactagcctccttacttttaaaaaccactccatctcatttttcaacaacctctgattatctcaaagttacctcggattatcctgacacgtccttcggcttctgaggatattgactcagtatttcaagactgaggtgactctgagacagaagacggagccagtggtgatgtgctcccttattcagactctttgaataatgctttttactcagctatggactctgctagaaagacactttaatatttttgccatttatatttttctgttgttgaaaaataatagaaaccagtgccttagttggtttaacaattcaacaaagttgttttcaaaagaagaaagaaaatgtaactccatttaggttgtctttcatttgcaaacactaactgaaacttgagttagggattgtataacttggaaacagtattaataaaatgaagtcattgtcatattaaaaatgtcctaatgttcactttaagtgtatttttaaaaacctcacaggcaatggtgtgaaagaaaccaaggagatgtttacattcattagttccactggaaaaaactggttaatgtaattgtatagatttttcccttcttgttttgtgtgctgtataacccagtctttgctttatgtacaaataccctggtttctaaatgctacttattttcttcagaaataaagtatgctttcaatttagtgagtaactttatatgtatgtgcatttgtttggaagagatagtaagtaataataatttaattcatgtagggcagccttttcttctaagaagcttcattaattcacatatggtataattattttttatttccctttaccagaataaatctttccttctagaatgatgctttttccttgagtggatactgcctctctttaaagtatcttagcttagaattaaaaaaaaaaaagttaatttttcttgaaaacgaatcccagacattattggatggtggagttggctcaatgacttaactatgtcaggtctgacatctctgttaattctttaagccttttccttgtgattagaacatggctgtcatcaatccagccatcatatctacttttaagtcaggaagaaatggaaaggacctgccttttgcttataattttaaatataaaggattctcaggaagttctgtaaactgaaaatagaaatgctgctcattttctacttgaaataatatttttacctttcaaattgattatctgaaaggttataaaaatatatctttattacattatttcacatatattcatttaagaaatatttttcactaactatgttccatacaatgttttagaagttgagactacaaatgctaataaaacagggattttgcctttaagtcgcttctggattcatcaggaagaaatacaagaaaacagacaagaatagtactgtgtgaatcacaaagcatagagcttagcactacagaagcatcagatagggtgtggagctgctctctattagctggaacagatgagacttgacctgtgatctggagcatgaagataaggtgattgataaaagcaagaggaagctatggaagttatctagacacgaggacctgcatgtgcaaaggcctggaagtgacagagtgtatggtttactcaagaacaagtgattgcatatggctggatcataggcacaaagggtggaaatttaggcaaatactttactcaggactttggtcttcatcctatccatgataattgtgctatagccttctacttttacctgatgctaattccttagaacttagttttggtttcacttttctgcaacttgtaaaccaataagtcaaatatttttcttgtattaacactagtatttagtaggaactgtatattggtgatctgctggcctactctgacctacgggcatggatagtgggatatttttgttttgttttttttctttttttaacctgtacagaataaaaaattgaattagtttccaacatttcacaatcaagagatttcacagatgaaactagtttttctggaaaaatgagaagatctggaaatcctgggcctgcattcccatatggcaacagtaagctggagctgagtaagggtaggtagtatctggttcactacagtcttcattttctgttgttttacaacatactcacctaactaattaaaagtgcttggttggctgatgaagacgcttatatttgctatctctagtgctgatagagacaggaggcagccaaatgcctaggcagataggagcgggtacacagtgaaaccccaccttcaagtggaaggtttaaagcctgcgacccagccacatgggggactttcctgcctttggattaggtaatcacccactgcttcaccattccactgagagctgttccattgctcaataaaaatattctctgccctcctcacccttcaatgtccagtgtatcctcatccttcttgggtgcagtagaagagctcaggaatcaccaaacaggggtacaagctatgacacaggcaagctggggcatgccagtgtggcagagcgaggcctggaaaggagttgccagctgggggcccccggcttgcaaagtgacctagaagaaaagtcccgcatctgtgcaggacatagaactacataaatttagttaacttgcacaataacagttctggacaaggtgcagtgacataattctgttttcgtttatgcaagctgaccctgtggtcagtgggttcacaatggccaatagcttgcttcagcgaacagaaatgaaacacctctgtgttatgaatcttgtttctaattatcttatacaatgtttgtaactctcaaaatggttgctcccgatagacattataatctaaaaatcccttcagcaaattataagaaaaggaacataagattatgagtctggaggcatgatgacttcacagtaacaaacatcccaaatggcattggttgaccatttaatttccttggccctcagaaacttccattagaaaatgtctgtaatgtcacccccaatatctatctgagaggttattactggcattcaagtgaaacagggtgtgtttcagaaagaaaagcaggtaactactgaggacccacagatgaaaggaaatgttgctcatggttaggggtcttgggatcttgataaaatgtctgaccagaaagtactattggctaaaggaaactgtccaactttaaaccaaaatatgattccatatggagactttaagggatgtggctggtagacagactagcagtagacaaagatttcaagaactttctgcattatgttttgctcagagagtggatggaatttattgagcctattactgtatggtcactattagatttagtggcaaaaccccgtctttactaaaaatacaaaaataattagctgggtgtggtagtgggtgcctgtaatcccagctactagggaggttgaggtaggagaattgcttgaacccgggaggcggaggttgcagtgagctgagagtacgccactgcactccagcctgggtgacaaagtgagactctgtctcaaaaaaaaaaaaaaaaaaaaaaaaagatttacataacaaaaaaaaaaaagacaaagattatatggcctagttcactcattttaatgacaaaaagtagattctcagtgagacaaagtaactaattagtatcagagacaaaacaagaaacattggatatctaaactctcaatccaatgatccttacattatgcctgtggtgtcacttagaagagagagattttgatgctcacacggggtttacctgaaaagctgttggtttttctgtttcctaagaaagctagagaagacccttttcttttgtatcctttaaggcttatttactttgtgggtcagttaggggagcctcaatatgttgtgatggatggatttgggggtcaacagggattcttacgatatttgatttttcagtagttagaggaaataagagcaaattgcttaattgcttcaaatattctggaaggcaagcattccaagcacatcttactcttttggctgttggagtcataggtcttcaatcctcctaacacaggaagaatcttcaccgctaaaaatctggcataatttttttacactcacaagaaaacctgtcgtaggtgagtaaaatcatgtatcacctctaataaattttatttttataaagttttgatagcatttcgtatgaaaaatattttcatacatgaaattttaaaatagtttattgatggctttttctgctcaatgtgctgcaagaggcaaaagtttcccaatgtaggtttaaaatcctttgataatgctagaattggactattagtgtgcttgtgtaaatcattgttgccaattacaatttatctatcaattgtgatagttctaattttagctagtgttaaccttaaaaataaattctttatatttgtttagtgcattgccaagtccacttgcatttttttcctgtttcttaaatcattttttttctctctactggtcacatcgtgcatggacttctataacatagcttcctaactgattttcctgcatcactctttgtcttaaattgtgcctattgacagcttgattaagcttggaagtacattaggagaatccccttcctgtggagtttcctgtagcattagtcaggagaggaactttagtggaaatacactattggaagcacaccagatacaaagatgaatagatgcagaggtacctggtgggtcccagtttatcctcactgtcctccacatggtggtcctctcatcatccagagtacaggacctgctgaccactgtggccccaggcccaccaccagatgcttgattccagacccacagaggcagtagctgccaaaggcaaaagctctcctgaggtctccctgagcgcctgctcacagccctgcttcatagattggctgtgcttggcttctcaagtctctctgaaagcattgtcttgccaacctgagtcagtgcttcctgacttttccatcctccaactccctctcccagaactttcctttccttgctcttcccacaattctgtaaactctaattcctatggtaaatgctttatggatttaccataatgctcatagtgactctgcttccactaccaaagcccagctgatacacccttgaactcatccattgcctttcccagagcaaaacttttacagtgaaagtgatcatgaactgacttaattcccctctcccctttccttgatcaatccttgatcctcttcatctctttcaaaactctcacttcctaggtttcagagctccgtctccctggattctgccctcctgggccacacacccacatacttttgagttcagggcttttgctctgactcacttgctaatatagcaggctaggattttatgtggagcagatctcagttcaaactcttgtgctgccctttctagctggggacttagataagttatttgacatttgttaggtataacttactcacatgtaagagggggataatgtcatagttatcttatgagggtggtaggagatgtagatacaaaattgaaaagcatctagcagtgccaaatacctgtgagtgcctccacagatgttgacttgcttcctctttttctttatgctgtgaacaatcctccattgccttccaaggagaagaagtgacctcatggtccagatgttttactgcctctagtattgcaaatcccagtggagaaggttcctggttgaaccatgaattgaaacacctagcattgaagtaagaacatcttggttcaagggcaaggggctttatcttttaatgtgggtgattgttcctgtgagtgattatagtgaagctgtactttgaaaaattgctgatgttgatgctgattacagatatggagaatggacaaaatgagaaaagaaaaatgaaaaattgaactttcctgtaaaagcaacactaattatagacatttatatctatggcttattatttataactaattagtatgcagcacaatggcagtgatgcaagtcattacatatatcacaccaccaacttgtttcactcaattgcaacaataatttctctccatggacacttgactattggtttgttgttcaggtttgttcatctactgataacatagagtaattagaggaatagcagtttccacaaagagaatactgatgtatagtgataattttttgcacttcatcccttaaacagtactgtggcaaagttgctattcttatctgcatttttctgataggaaactgaggcccaaagaatgtaagtaaatgccaaaagccttaaatatagacgttggactcaaacacttttctcttccaagctcttacttggacctatgcggcaaagctgatctgttgaaagacgtttagtgacacataaatgtctttaattaatggaatgaaaatgacatgagatggatttgtaaaatcaagatttgtaggtttaggcttgagttctacatcctagggcaaaggatgtgactgcttatctgcccctagggtcagaattcctgacattcttgttttttaatgcttgtgtctgcttgcactttgtaatctgtaggcttcctgaaagctccaaaaatctaaaaacaataaatcattcaacatcttttagcttgtttttcttttttagagacagagtctcactgtgtcacataggctggattgcagtggtgcagtcatagctcattgcagccctgacaccttgggctcaagggatattcctacttccacctcccaggtagccaggactatagatgcacaccatcatgcctggttagttttttttttttaattttttaattttttttttttttgtagagacagggtcttgctatgttgcccaggctcatcttgaactcctgagctcaagagatcctcctgcctcagcctcccaaagtactgagattaagggtgtgagccactgtgcccagccattattgcatttttgagctacccaaatggcctagcactatcttcaatatttcagaagtaccatactgtgttccaaacaaaacatagcattccctatggacagtgtggtttctaaccgaagtggacagtgggtcctcatgcctgatggctctagagaagagaaggctgcaattggacccaagttcttcagttaggccaataaatactccctgttactctgatctgatgattttgagatttatctgcaaggtgtaggggagaaggaaagtcaatttgccatgcttaaaggaaaagataatgggttaaagaagactttgatgaagctttgaagtcttaagaaagctagattatatcattctctccaaaggtgtttcagtcgccctttttaccttggggtttggcggttattttatgccccctaaaaacaatgtaccaattatccagtgactagtgttccaattaatttatggacatgaagattaacatgcaatctgctaatgcattaatgagtttgtaatatttagaaataggaggaccaaaactggtagaccaattctgagttttatcaacttcagtggttgaaattaaaatgaaaatagcaacatttgtttttattctccctacaaagaaactaattattttcctctgggtaatgataattaacaaaattcctattgtgttcctgatcagttcacagctggcacttcgataattacaaagacttggttttatgaggtgacattaaactcctgcctaacttgggaagtacattaattgtatactattgcctgagcttattaattctaaattatgcctcaatgaacttctcaaattgggagcaacatttatattaataaactagtcagtgagagggagggaaggagggtgcgagagagagagagagaaaaagagagatcataagaatctactactgagtgtagattttgtctgctccagatgttatagctgggtttaaaaaactttgatatgtttgaataaattccaaaggaacgtctcatccattcttttttttttttttttttttgtgacagagtctcactctgtcacccaggctggagtgcagtggcatgatcttggttcactgcaacctctgcctcctgggttcaagcgagtctcctgcctcagcctcccaagtagctgggattacaggtgcccaccacacacacctggctgttattttgtatttttagtagaggcggggtttcaccatgttggccagtggtcttgaactcctgacctcaattgatccgcccacctctgtctccatctcccaaagtgctgggattacaagcatgagccactgcgcccagcctcatccattcttataacacatttttagccattcttttttcatttaagcaggaaaagcgaagtgctaggtaagcctgggatttgtggttgaaatgtgttcagagtgctaccctccctcattccttggaactttctgaaggaccagaactgacctgaggacctgtcgggtgtgtatcactgagggagttccagggctatgcagggaagccctgagtgggatgcagtgattcctctctattgtgtctatttccatgagggctgccatccttcatgtaacagtacctttaggaacagggaccatatatctatatatttctatttctaagtttcaaacagtgcttggcagctaacaggtggtcaactaatgtttgtcggatgaatgaagggtggtaccaaggaagaatggtgcgtttagtcctggctgctaaaggaggtttaatgataattggccaatgtgtggtgattaagcctcaacagttacatagaagaaaccatgtttatactcatgttgctttaacaatgccattgaagtctggcaccgtgtctcatacctgtaatcctagcactttaggaggctgaggcgggtggatcactgaggccagaagtttgagaccagcctggcaaacatggcgaaaccccatctctactaaaagtacaaaaattagccaggtgtgggggcacacacttgtaatcccagctactctggaggctgaggcatgagaatttcttaagcccaggaggcagaacttgcagtgagccaagattgcaccattgcactccagcctggtgacagagtgagactctgtctcaaaaaaaaaaagccagtaaatgttacttctatcttaaatttccagtatagcaatttaaaagatgatctttaatttttatggatacataatagttgcacatatttactatttatggggtacatgtgatattttgatacaaacatacactgtgtaatgatcaaatcagggtaattgcaatatccaacaccttaaacgtttattatttctttgtgttaagaacattccaattctactctttcagttatttcaacaataaattattgttaactatgggaaatttttaaatacaataatgtcttatgctgatgaggatatgtgaaagacacattcatgcaaccctttcggaaagaaatttagcagtatctatcaagaacttggacaattttcgttatctttactctggtaaaattcagcatctggaagtcagttttaatgaagtaattcaaaatagaaaaatagctttctgtacacaaaggtggtgatctcagatttatttgaaatcatgggaaataatttgagtttccaatgaaatgggaatggttacaaaatattgcacattgactaattggtgctttgctgatttaaaatatttttcaagactttacagtaatatgaagaattcttatattaaggtataaagtttatacatcattatcacaactaaaatatactatatatagaaaagcctagaaggaaatattattaaatgtaagaatagaaaacagattgggataaaatccaggaaaatattaacatttttagttgtatttttggtttgtttttgttttcccagtttttagtagacccttttaatgatgcctcctcaactcccttgtgttgagaatatgtgactctgcccggtctcctcctcccttcctcacctaccaccacttctaacctcccactacccgttgcagattggatcatgatggacacctgactcatggtgggcaaactggatcttttcttctgggaattagacttggaaattcagagaaaacaagtcagtttgtatgcatgccttggattgagagacatgaacattttggactggaggtgcgggcatcttctcccacttgcacaaagaaagcagattttcaggaaaataagacaaaagcagatatacaaagaaagaaaaagacaagagttcatgagatctaacagaggaactggttaatgatgactttccagtttctggttgtagccttcatgaagcctggcttataatatacagtgttatta

SEQ ID NO: 399 - DNA, 22035 bp, Homo sapiens
accccacatctttcaaggttgagaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacaccttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagagacactcctaggctgggaaataggaatttgagacaacgtctgaactggcttagaccagttgttcctgctttacatagctagaaaaaatgctggaagcagaagtacctggcaaatttaaatcactgctgtcatccacattcctgagattaccttaattgatgcagaataggaaaacatcagggctgaaggggaccttagagattcatttgtccaaaattaccacttgcagttgaggaaatgcagaaaatggaaagctgaagtcagcggatcactacctgttagagaaaggcttagcctggctcccaggttgtcttgcttcccaaaaggtcacagcagcatgttggccctgacaagggctataacgggggcccatgggtgacaaatcaatggctgtcaccctgagaatcaaaaaaggaaatcacatggtaaaaacaccagaaaatctaaactagtcaggacattgatggttagactgagatggggtaaaaaaggggcaccatgggctcaggtcttgggcaattaggtaccttatttcaatgagatgcctttcctagtcttgtcttcttagtgatccaattttttatggtgttttttttttttttttttttgagatggagtcgcactctgttgcccaggctggagtgcagtggcacgatctcagctcactgcaagctccgcctccccggttcaagccatcctcatgccttagcctcctgagtaactgagactacaggcgcacgccaccacgcccggctaattttttgtatttttagtagagacgggatttcaccgtgttcgccaggatggtctcgatctcctgaccttgtgatctgcccacctcggtcttccaaagtgctgggattacaggtgtaagccaccgcgcccggccttttttgtgtattttaaagcctcgtatcttaaactaaagccagggatcctgttcaacctggattttctcttgaatggagggtagtttgaaaggatgctgctatgagtgatagacagaacttccagccagactttcacaaagtctccagatttatcaaagagcaagattagttaataacccaggtaaccttggcaacaaagaggccagacaaaaaccgtctgtgctggaattacacatattgctgctgtcatggtcaggcctgacctttccacatagcaggtggggaatgggcaggaacattgtcctgccaggtgtccttggatattttttagttgtggacgaagtctcaaactaaagaccatgagctaatataaagcaggaagcagagctgtaacatgtttctccttctggcagaaaggtctgagctaagggtagatggaggagaaggtgtttctggcccccagcattggacaagtaaaccagttcaatgaaatggccccactaaaaatgatcttccctgtagctgcctgaacttcctctcttgagccaatcattagggttagcatgcatgcgctggagaaagaagggagaattgaggttgacatgctggggtacctagctgaaaatccatttaattaccttgattttttaaatgcttttaatggtccattcattcacttgatgaattttttcaaatgctagtgtgtgccaaccctctaaccctgtatcaggggctgggaataccgaggtgagccaatactgatactgttcctgccttcatggaacttgtagtctggtgagaaacagggagtgttgatctgttgggtggggcggggctaagtgggtcccttgttgcatggaggtaactgggtagccagatggcatcagcaactgggagagggaaagggggcagaggatggagtgccaagtttatcagccccgctcaaaatcccgcttcccccctgcccgcaacccttctgcgataacaaagggaggcgagcaggcttttctagtccaggacactcctttcgtcattcctgccttctgtatcctcttctggacccggttcccagctcccctccctcccacctgaaaggtttgttttgcattccacaccttggctggctcatctgcatgtgtggacaggtgaggctgggaaatgagagcactttagaagtgagaagagctctaataagttagagagaagttggttgttaccctgaagtcagctggtgactccctggtcattaagacctggtcagaattgtcttacaccacatcaagcctgtggcctatggtgggaccccccattcctcccccatcacatacatgcagtttctacagtgttccaggggcttgttcttatgtaccccttcgcctcctgggctcctgttcccccgtgtgcagactctgatacatcctaaatcaagtcctcttttgagtgctcttggaaaccgcactcccaggcacattgttgggtatagatttactgatactgtgaagggattggaacccaggcttctatcaaaacacaaataacttccatcagaactggaggcttcaccactgttgttaactggaggcttcaccactttgggccccctcaccaccatgacgtcattgactcgcctgactcctcccagcctctcccctgcctccagctcccctgctcgctttcagaagcacagacaacaaattcggccaacaaccattgcacacctgccctagcttgctcacccaggtattcttcaaagagcagcctcctccctcctacccagaagaattctggtaacatctattttgaaaatcgtttttttaccctgttgcatattgttatgaaatgtataaaaagctgggggtgctttatttaagatgatagtactagtttgtggatggcagataggaggtatctacacagtttctatcccacactttctgtatttgtgcagggcaaatgcctgttgagggtaatgggcagttttgggggtggaccgctgaccttagactttccttgcagctttggccccaacccatgtgacctccttcaatgccaactgccccttggaattctgaggggtgcaagcactggcctgacccatttattctgggtggcatgtaactgcaggtagtagcattgctaggactgagggatttgctgttgcaaattgttgaaaaaggggagttgcaaaattcaccaggtgccaccatcagtgaattgggaagatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcagaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtttttcctcattttttctactgcacataatgctgcagtgaacagtttatgcttgtgtgtacatgcacatgtatggagattgctacaggacaaaatcctggaagtggagtgctagatgaatagtatatccatttaaatagttgatagatattgccaaattgccttctaaaatttttgtaccaactcatacccaaaaaagcatatgagtgcccttgaaggaaaagggttcttaaaatgttgagcagggagagtaaagaaagttgaaatgtaatttaagggtgaggtgagccacctgctttcatccagcctctgatctctgcttcactgagcacgcctctgctgggcaaagagtaggagcctgttgggacagatcggtgggtccttgctccaagaaggaagtgtggctcatgggccacactctcagacatgcagaaactgtaaaggaaggagacacaagctaagaaacccgggctggcacctctgcacaatcctggagcctgcccgtgccctggctggcactgggctttgctgaaatctaatatcttgtttctttttcccttctgtaactaatgagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttctttcatgtatttttattaacagttggctagcaatggtattctgttcccacctcggtagcaaagagaccatttgtagagattattacctagataataaaatgataatactatataattagtaataaattaacatttattgggtagttatgtgccagacactgtgctaaacacttagatggaatattttattccatattagctctatgaggtagggacaattattatccccatttacagaagacaaaatggaaagttaggagagtcacgtagcttacctaatgttacagaggtaaaagtggctgagatgaattctgatccctggagtgggcattatttagaggggtggttcccaaaagccagtccacagactgtcttgttctctaatatataaagaataattcagcaacatctaggagtataaatccagagattctgaatcagtagttcttggatggggcccagaaatctgaatttttaaactgatcccagccaacttccatctgcagccaagtaattggtgtcaaggatttatagacttggctcttaattcaagttcatgacccttgggggatccacgcagaggcttcagagatgccataattatctgaaattgtatgcaactttttatgtataaacatttattttgctgtagagaagacttgtagctttttttttttttttttttttttttacttccctaaaggaacctgtgatgcaaggcggaataaaacccctgattcatgtaagaaggctgatgtagagcagtggttctcagcccagggagcccagtagattcacctggggagctcaaaaccggctgtgtggggctgcagcccaggccaagaaactcagcatctccggcatagtgagaagggggctctgtgttgaggagtacaattctggattcaaatctgtcacctagtgggtatgtgaccttgagcagcttctaaaccgttttgaacataatctcatctgtgacatgaaggtatactcacttctgagggttgtggggggaactaatgacaacaaatgaattgtctctggcacatccgaggccttcaacagataactacatggggcccacgagagtagaatggatgccttgagcatttttccaattcaatatttcagactattcgttccttcagagaggacggaaaagaattcccctgctcatatgccagagcaggatggctgatggtatgggaatgggtggtagagacgttgtttcatagtgtgacttcaccaacagttcatagactagcgccagctttgtgcacaaggtcgatgggcatctcttacttggtgacaacctctagttaaaattgagtggttacaagttagggttcagctctattttcatccatcaaacacctttcacctttttgttgttgttgttgttgaggtggagtctcactctgttaccaggctggagcgcagtggtgcgatctcagctcactgcaacctcagcctcctgggttcaagcgactcctgcctcagcctcccaagtagctgggactacaggcacgtgccaccatgcccagctaagttttgtatttttagtagaggcagggtttcaccgtgttggccaggatggtctcgatctcttgacctcgtgatccacccacctcgacctcctaaagtgctgggattacaggcgtgagccactgcacccaacccacctttcacctttctcagaggaataagaatagtgaccttagcttaagaatagtgaccttagcctaagattcttctggggcatcttcaaatctcttggaggaaatgacttcatgcctggagagcatttggatccgagatggcaagaactgatatgaagccaagctgcgtagactcccagtcatacacaagtcctcagtccctgggggcccatcacatgctgcatgtaggatggctcttccatgcacacttaagcataagatgccacccaatcaagcccctctcttcaaagcatacaacttcaatttccttgttgaaaatcattggcttagaagtctctttggacatctttagctaggaactgggtgagaactttgaaatcttgtctttgtggtcagaagatggcttcttgctaataaatcaaaaggaccctttggaggagataggactagtcaaaggtggcaagcatcctctgcctctctgggttttgagtcagggaggacttggatccaaagtccctgtctctaacttctttttatcctgcaaagcctggcacaatgcctggaaatggtatagagagataacagttactgagtcctaaacctgtgccttccacatctcatttaatcctcacactacaaaacaggtactattattatccctgttttgcagataaagaaacaggcttatggaaattaggtaatcagcatttttaacccagaccaaagcctgaccccagagtttgacaggggtgggaaacatcaggagtttaccaaacctatttatttaccttctggacattcaagtagaccactttttccagactcccttacctctagtatgaccattcaactgaattctgtccaaaggaacataagcagaagtaaccccaggtgtcacttccatgaaaggcccataaacagtgccacctgatgctctctctctcctttttttctggctcctggagaagatggagactaagaaggaagggacccaggtccctgagtatatggcaaacgcacctgacagcaataacttcagcatactctgagaatgaccctgtatggcagacacagctgaatgtgtgttcagagttccaagctcaggaatctgggagtggccagcctggaggttcattctttatctgtgacgaacatctgaaccctcagcctgtcccaaggaccacgagccatacaggggatcatagtcctctgttttgggttaaatgaaggttgtcaggtggaggttgttaaggggagggtgcgaagtggaaatgctattttataaactacatactatttgcaagtggttgtagttctgtctggcccactgccactggaccatccctacatgtaaatttcctctaataataatttatatctcatttgctagctctgggtttcttcttcagcctctcaaacatggttccttccctgttgagattaataggggtctggcatgacactaagtcatcaaactgttacacgaggaaggaaaaagcctcgctgtattaaaccattgagatactggggtttcttgttgcatggcctaactgctgattagcctaaccctaatatgaggaccttcttctgaagcccagtgtccttaatttgaggtcttgacatctttgccaggttcccaactgtaatctaggctcatcacccctcacatacctgactttgaggtttgtccaccttctggacagacctcccaccctggttaggctaagcctactgggttggaccttcagaacatcactgcctacctcttccctccatttatcctgcgtttgaacactgtccagaattgttcaattgctctcagggtgtattagtccatttttgtgctgctgtgaagaaatacctgagactgggtaatgcataaagaaaaagaggtttgatggacttacagttccacatggctgaggaggcctcacaatcctagcagaaggtgaaggaggagcaaaggcacatcttacatggcagcaggtgagagagtatgtgcaggggaactgccccttataaaaccatcagatcttgtgatacttattcactatcacaagaacagcacgggaaaaacctgcccccataattcaattacctcccaccaggtccctcccatgacacaggattgtgggagctacaattcaagacaagatttgggtggggacacagccaaaccatatcacaggggaagcagcctctacttccagatcagcttttctactcattatcctctcccgaatccaaattctctccctggccactcagtgcccccttcatccccagccccagttattcaggtactcacttcaagatgaggcctaccatttcttagagcactggtctttcagtttttttgctcacatgctcccaaaaattctttttaaaccatgaatccacattgcacattataaagttgacaactaaaatttttttaatcacaagtttaaatagttgcaaaggatgtaatagctgctctaagtactggcatttaaaaataagctactacatgactctttttaatatatctgatgaactattaaaaccctagtgatttactaccaaccaacatccatttgaaaaatagagttggaatttgtacaccacttttttttaatcaaaataattatttacattgtgtttcctcactgagtttgtctcttatgtaatatatttttatgcctcaaagtcttatattgtccctccatcgtatttctcagtcataaaacaacagctatagactgagattcttatttttattttcaaaaaaaataaaacaaggctcataaattttttatctttaggtatgagttatggttaccttcattactagcacatgcatgatcaaaaccatgtctatagtaaaattttaaataattattatccatgaaaaataaaattttaacaggactacaaatctaggaagatggataggagtggttgtggataactgataaagaaaaagacttcacagacaacaaacttccttgttgtccctttgtctggtgccacaaacatttttatgcctggaactggagcccagagctagagtaagatttagcctgggtaggaagtatacctatgttttgtaaaacgagagaaatgtgattgtaaaaggagaggaaaggaaaaaaaaaaaaaaaaaccaaccagcgtgaggcctcatcaacaaccactttctcaggcaggtcaattttaagaaaaaatacgtatagaatttgagggcctagaaattcccttaagacttacctatgcaaatatatcccttggatatactttatgcagcactagatgtgtgtcctgctgacttaaaaagcagggcattagagtggggctgatggaggtaaaagagcagaagggttatttggccagttctaacatttttgaaggggctcaaattagaatgtttgatttgtttccaagtgaatatacatattcctaaagatagaatgacaactttttttgtaactttcttctggcatttctatatcttttgaaatgtcccttatagcccctaaaatagaattggcctcatgcctcccataagctctgatggggcacaggatgggtctggggagtccccagaaagaaggtgatggttgaagtgagtgaagataagcaggagcttgtcaggaagagatggagagggatatcccaggtggcaacacagaggtaagagaagagaacagaacactcccacaggcgacagcatggtaggtgcaaagggtatacggtgagcggtaaaaaatgaggtatgaccagaccatgaaattccttgcatgctgctctaaggcctttggactttagcctgaccaggagaatgacatgagcaggtttctatgttaaaaatattatactggcagttaagaggaagatggattgcaaagaattaggaagagtgagggagatttctactttagtctctgagtaagtctctagggatgaggtgggtgcatagattcagagctatctaggaaggtttagcctgcagggtttagtagaaggggtcaaggacagctctaagttccatgatctcggtcgatctatggttcacggtcagggatgcacataagaatcctctcaggagtctgcaaaaacacccatgcctggcaccaccctgtgactcgttgaatttgcagcctctggtgtggaacgccagcccattttccttagaaagctctcttggtttattctactctgcactctctgggtgagaggaatatgggccaggaattgtaggcttcatctttccgttaaagaaatcaaagctcaaagagttctgaaatcagaattcctggagcaaagcatataactagggaaatggtaatgccaggatttgaacccaagttacttggacttcaagccccttcctgttccagacgtgctgatccttgcctacctgcccacttctgcttcctgtttgaccacctgtcctatatattcctgagtgtggctgatgtgttcataatttcagccctgcctccatccacagctgcctgactaggagggacacctggccccagaggagccactccattgaatcagctgatatctaagatagtggctctcaaactttgctgctcattagaatcacctggtaaactttaaaaaaatcctgataccaggtcatatttccattcaactgaatcaaaatgggaggggtggaaatggggaagggggtggaacccaggcatagtttacaattttttctccaggtgattacaattggagcttatgaactatgatcaaagttctccaaatgttgtccacaaattagcagcatcaatatcagctggaagctttgcaggagcgtagactctttggtcctatcttagactcctgaatcacaatctctattttaacaagatctccagatgattcctatgcacattgcagattgcaaagttctcccctaaacaacacagagtgcagtggctcactcctgtaatcccagcacttcgggaggccaaggcaggcggaccacctgaggtcagaagttcaagaccagcctggtcaacacggtgaaagcccgtctctactaaatatacaaaaattaactgggcgtgatgttgggtacctgtaatccgagttacttgggaggctgaggcaggagaatcgcttgaatgtaggaggcagaggttgcagtgagccgagattgcatcattgcactccagcctgggaaacaagagtgaaacctcatctcaaaaaataataataataatacaaaaaattagctgggcgtggtggtgggcacctgtaatcccagctatttgggaggctgaggcaggagaatcccttgaacttgggaggcggaggttgcagtgagctgagactgctccattgcactccagcctgggcaacaagagcaaaattttgtctcaaaaaacaaaaaacataaaacaacaacaacaacaacaaaccgcagaggagcaaaatgagtcagtggaggaatgaatggcagattagtacatgtccttgcaatccttcaaagtccttggatttccttgattcttgcccttcctgatgtctaactgttgcgcttcccttgaattctgaacaatatctagcattataattaccctttcccgccccacctttttttaggctactttgagtaggcttctatctcttgcaactgttagcactaggaaacatatccgagtcacgcagcaccaaagtatgttagcagcagcgaatccttatgggtctgcagcaacctcaattcttgcctcctcaaaagaaagaattcgaccaagggtcataaggcagagggagagacggaagcaagttttacagcaggagtgaaaggttattaaaaagtttagatcagacgggaggctgaggcaggagaatcgcttgaacccaggaggcagaggttgcggtgagccgagattgcaccattgcactccagccctgggggacaagagcaagactttgtctcaaaaaaaaaaaaaaaaggggggggtttagagtagggacaaaaggaagtaagatacacttggaagagggccaagcaggccacttgagagattcaagtgtgtggtttgacctttaccttggggttttatacatcagcatgcttcccaggcgggtggagtgcacctttctcccctgattcttcccttggggtgggctgtccacatgcacagtggcctgccagcacttgggaggagccgcacgatcagtgttttctgaagttgtatgcatgctcactcgaggccttcttcccttatcagtcaagtgttcctagaagaaggtcatatgccagttaaatgccaccattttgcctcttagcgcacatgcttgagcccactcgcccaactcctgagaccgcatagggaagctgctgatcaccagtttcaggtgtttttatctgttgggaggctggccttttccttgtgctggctgaggccaattattattttagagagacagtttaacaactgcctgaccaacacctgatggttgcctgacagtcccggtggtgggggtgggggaggcgggtcctcttctgccctgctcatgtctcactaattacctactgtaacacaaccacaggtgccacaacatacttgctttttaaatttccttttgtttgaatcaaccaatgtgccttgcagaatgcttcgtcagtggagtggggaactgaagtcatcactgattatttggtgcaaggtctcaaaagcgtttctcctgaatgacattttggacaaagcttgccaaagacgggcagcctttgaagaagttcaatcaccatcttcctttccaagttgggcttgaggatgcagtgtgaatagcacaggctttggagttgaattaaaactgggttcgaaccctgtctctggcatccatttatttcagaaacagatatttatggagcgtccactatggagaaggcctttttagctggtaacattatacttaatctttctgaactcagagtcattagtgccatcttaatattgtttgtacttggcaagataagaaatatgaagcatctggaggcctggaatagtagacattcagcaaggatgagtttcttcctttgtactgcccaatcccctctcttctccctggaccttgcaggagatggataaggagcctcttgaaggaagtggctcaggattagtgttctctctctgacctttgaaaattaaatgaataacacaagggacatgacaaaacacaatgacaccatttggggcttttgtcccttaggctagatttacttgtaaggtttctatcctgacctactagaggcagaagatggattaagaaaggagtcttagataatctctcatctactatccttatttcaagatgagaagtcaaatagttgctgttggagactggattctatcctaggtttgcaaacttcccatctgatctcgtgccgtgacatcaatcttgcccccaaacaatcctcatcacatctttatcttccgtccccaaggtaaattgatagtgcaagcatcatgaacttttgtactgcatgatcaccactcgtttccaaaagccatcccaaatttgcacatactcaagtaaaaccaggatccttgctttgctaacatggcttccaattcctgtggcggcaccttctatcccttaaatagactgcagctcttgagtcacttctatgtagaaattctgaagccactactgaaaatgagtcccagggtataaaagactggaaggcagtgcccgttagttgaccccacatccacagccaattgagcactgtgtgattttccttggaagtagatacaatggactccagcatgagtcacaaggcccagctctaatccaggtttcttccccagtcgtcatttctgtccctcctctgtgcagcatcctgtggcctgggaagggggtgagaggaaggaaagaaaaaggagggtccctcatgaactttgcctgtgaagacgatgcactcagggaaggaaacatgattcctgcccatgggatcaggatcccgccacgtctgaacaccgttgtacagcttaacagtccctcatctgtttttcattttggccctttcagcaaccctgtgagggactcagggtacaataaacaaggagacagatttggtgatggcaaaccttacccagggtcagaggggagctgggaggtctgtgctgctgagtgttttgacatcccaaatccccaagggagtatgggctgggaagacctcatgtgtgccatctcaaccccctgcaaatataccccaatgtcctcagctataattaattaattttgaatacattgaaagaagtaaatgcctctgacagttcgctgactccccagcctgcctcctggtgctcctccacccactccctgtgatttgggagggagaagccagggctcagttgattccatctgagatagggctgcctttcctaaaatgagcctcccccacctgtaaccttattctcctcttgctaacttttctgttcatagctttgaagccaaaaaatgagtgtgctttgacgagctttctgtgcctgtcctgcgatgcccctccctgtctccagcccatccgcctcttccctgggcagcattgcagaaactccttcacccttctctcaggccccatcccccctgcagcctccccagaactacagagggaagctgacacaagaaaggcttcatgaaaaggagcccttaaaagaccaaagtgcctttctttcttttgaatgaagatgaatctcagaaatagaggaaacgtcatttaaaagaggagacacaggggagacgtcccccagcctcagggttctcagtgggaaccttggatttgagctatttgtgtaccaagctggtcattctctctctctcaatctttcattctttttctctctcgctcgctctctccctctttttcccctccccctctccttctctccctccccactctctctcattctcccactctctctcccttcctctcatctctcattctgtctccatctctgtcattgtttctctcactctctctctaccttactcctccactccctccctctttttttctctctccccctccctctcccctcacccctctctatctccctccttctctgtttctccctcttccctctgctccctcccttcttacttttctcccctgtgtgcagcagtggtggaggagggggtaggagtgggtgcatttggatgggaggtggaaatgactataggtgaagtgaggatgaagatttgagggcccaggcagatagatgaaaatagaaaaagcccagacaggaccccagacatcctggccccctgaccatgaccctgtaaccacgccacagttttgacacccgttcattaaagtgtctatgcgagcaggaagcccattacccattctcagaaaccttccccaaggcactgtaaggatcacaggataatgtttgggtcagaggatgcttttgatatattccatctggtgaatctcttcattttctagatgagagccttggggtctagagaaggaaagtgacctgccaagtgttacacacagctaaatacaatcccagccaccccctgctccccaggccaggctgttcaatatagcaccctgtctcctctttggctattttctgtggaggatcctaagggcaaagatgatctgattcttgttttgcaggtggaaatatggaggcacaaaaagcctcattgcttcagtctgctgtcttctaggcctaagcagtctttaagtatctaaatcctacccattttcatgttgaatttcatcacttttcctatgaaatgctccttagtttcccagttggaagcagtcactccttcctctgaacccaccccacttccaacccaagcgctccacatgtccctctcttgccatggctaactttctgcagcgcaatttcaatacatttgtccacagctgagtcacttctgcaaagatgccagcatttttgaggacagagatgatgttatggattgcaaacaaacctaatcctaactaattcaatgtgtgatatttattccttaatgtgtttctgtattttcatattctttttgcaaagttgaaaaaacataaaaaagaaaaaaatctaatcttggaatatcgtgatacaataaagcctgccttaccacatagatccttcccctaaaccatgaagcattcctcctccaggaagcatccaagggctgagcagcagggtgggttagcccatagtgtaggcagttcagggtacctcgtctggagcgattttaaaagggatgatatcaatgttctatattattcagcatttttctcttttgcagaagaaaagtttttcaagtttttatcaactacaatagaaattatgaaatttctgctgaaggtattttagtggaattttcaactgcaaagactctggaaagctgctaggagaaatcctgaaatgaaacaaagacatgggcagtattgcaatttctgaaacctattgggaataggatttttatgaatctcttctaaacttgccctcaagtcagtattaaaattactatatgcaaatctgttcctcagtgtgaaagaacatttcaaaattaaaattaattaaaagttctctgatcaactgtgagtgaaaatagcttgataaatctggttgcccagtcaaatatgcctagaagaccaattttgacaaaattattaacaaatttacagaagttcgggcacaaacacaaaatctgtaatatgattatacattattgccacagcctgatatgttggtataagttttttcttttaaaagaagatacactaatgtaattaaaaagtatgagttgtctactgctcttttcctgttttgctatatttacttatttattttactgatatcattgctatttaataatttcaattttttttagattcaggggacatatatgcatggatattgtattagtctgctttcacactgctgataaagacataccaagactaggtaatttataaagaaaaagaggtttgatggactcacagtttcacgtggctggggaggcctcacaatcatggcagaaggcacgtcttacatggtggcagacaaga

SEQ ID NO: 400 - DNA, 56921 bp, Homo sapiens
catgctcctagaaagagggaccataagtcagttagcattttccgtggatctaccatgtgccttttgcctcagaagtcagaaagtccaggagcctgctttatcctactcccccagtgggctaatacctgaatggcccccagcaccatgcctggcacacaattggcattacgaaatgtcacttgtgattatcaggttgtgggaggagattgagacaggcttttcagaaagaagcatatgagctaggcttggaagggttattagtatattctagaacctttatagttgaaaactgtgatatctagaggaagccagagggaacagtaggctgtgagttcgctgagagcatggtctctgtgtctcttgttagcctccatctgcagggcctgacacaacatctatatgtttgttgaatgaatacatgacagaaggaaggaacaaatgaataaatgtgtctggggcagagccagacgcagaccttccttttcttttttcttttttttttgagacaaagtcttgcttcatcacccaggctggagtgcagtggtgtgatcttggctcaccccaacctccgcctcccgggttcaaggctcactgcaatctccgcctcccgggttcaagcgattctcatgcctcagcctcccaagtagctgggattacaggcatgtgccaccatgcccagctaatttttgtatttttattagagacggggtttcaccatgttggcccggctggtctcgaactcctgaccttgagtgattcacctgcctcagcctcccaaagtgctgggattacaggcgtgagccacggcgcccggccagaccttccttttctatccaggagctgcctggatccctgcaagacttcagctcctagaatcagagaaaccaggttccaaatcccagccccacccttttcctgtgagactgtggggaggttacttgactgcttgaaatctcagtgttgtcctcagcaaaatggggacaataataacatctacttcacaaggtgatcatgaagataaactatgacagtctggagtgccctacgtggtgctggacacatagcaagtacccaacgggtattaaacccggcttttattgggtagtgcctggtagcaggcactgtgctaggggcttttcatggattaaatctaaatttaagagttacaacagccttttgaagtaggtaccattattatcaacccgtctaacaaatgagaacccagaagctcagaggggttcacagagttgcctgaagccacacagctcagaagcgtggaagctgggatttgaaccagagtctgtgcttgtcgccgctgttctgttctgttaggtctctctaactctatctctttctctcccagactaggggttggggctttgttcatgaggcagcagagagctgtgcacagctcttgaggaggaaattggggagccaaccctttccacccctcttctgtggaaggctggagtcccatatggaaactgaagaggtgaggggtgttttgtgtacgagaactcacccatgaccctccctcctccacaccctctcagctgagcttgctgtgcccttgtgggaactggggggaacatgccccccacagccacgctatccctgtgctgggcaagagtagctgggtgtgctttttgagttgctaggtggccggcccgttgggttcattggcctgctctcctagagggactcttgctggctgtgacctgcctgggcagggagaagaccaaagaggtgcctcaggctggtcatctgggcggggtgtacggaggccgtaattgctgggcaccaaagtccaggctgggcccttctatgaagacatttatagccagccggcctgggggaccattcaagtggttttctctcttttgtgtccctttaataaacgagaagaagagacatcaaattaaagctgattctggacaaacttggctttgctgagaggctctggggaggtcaggggaaggttattctgcttgctgaccctgaggcctgggtgttttaccacatgctttgaaaatgtagactcggacgtcagggccagttgggcctttgaagtcacccaagccaactctcagccctgtgcagggatcccctgagcagtctctggttgcagccttccagggatggggaactcactactacctttcttttctttctttttttctttctttctttctttttttttttttttgagacagagtctcactttgttgcccaggctggagtgcagtggtgccatctcggctcactgcaacctccacctcccgggttcaagcaattttcttgcctcagcctcccaggagctaggactacaggtgcctgccaccacgtctggctaatttttgtatttttagtagagatggggtttcaccatattggccaggctggtctcgaactcctggcctcaggtgatccacccacctcaggctcccaaagtgctgggattacgagccaccgtgcccggctggggaactcactacctttcagagcaatcatgccattaataggcagctctccatagtctctctgcttagggggctttggaaacaggtggattgaggtaaaatcccagctcggataccctgagcaatggctgtcatctctgtgaatttcagcttcctcctctgccaggaatcattcattcctgcattcatgtattccgcagatattttgtctttggctgggcctccccggaagcagactggagacaaggattgaagtgaagtagtttggaagggaagctcaggaaggaccttggggaagaggagattgagacagggaaggtattgtgaatcgaatcgtgtgtcccccacaaaaagagtcctaacttctgacacctgggaatgtgaccctgtacttggaaatagggtcttgcagatgcgatcaagttgaggtcagtcatattgggttagcataggaatggggtcatgccggtgtgatcaagttgaggtcggtcatattgggttagtgtaggccctgatccagtgaccggtgtccttattgaatgaagggaactggggctcattgccacacagagagggtagggggacacgtgaaggcatagagacacacatgggggacgccatgtgacgatggagggagacggcatgacgctgacacgagccaaggagcacccaggattgccagcaaacaccagacgttgagaggcacggaacagattctccctctgagtccccaagaaggaaccaatgctgccaacatcttgatttcagacttctaccctcctcagctatgagagagtccatttctgttgctttaagccacctcgttggtggaagtttgctacggcagccctaggacactagaagaaaaggggagagagtcaacatagggcagtgtgcatgtacaacaggttccaatgtgggaaactgaggcccagtcccttgggggtgctcggggagacgggggaacgtgcctcggagttaccccatcttaggggaaggagctgggatctttttcaccagcttccatctgtccctgcccgaagggtgctcctggggaacacccacccctgacacttatggtctgaccaatgtgtggacagggcaggctcaggctgccaaaaagtccctaggtgagaattgcaggtgctgccagttgggagtgttgggagtcagggtgcgcaggaaggggaggctgcgggggtgtgggtggaccagcaacagtgtccgtcaggtctttactgagggcctactgtgtggcgcaggcgccattgtaaacacatggagtgcagctccacaactgacactcagagagggaggcagatggtgacgagcaagccccgaggcagcggataatgcccaacagagcaggcagtgaacacacagcggtaggtggttggccaaggtccctgggggacacgtggatggcgttcattctgcccggatggtcagaacaggcttctctgaggaagtagcctctgggactgagacctgcatgttgagaaaataaaaaattcagacatctggtgaaacagcgttccaggccagggaacagccagtgcggaggccctgagggcatggagggccatggtgaagatgaaatgagcaagaggacccggcgtcggcctgctgcggaggaggctggcagaactggcttcactccccccatgtcaggcttctgacgctggtgctgctctccagccacccagagcagtcactccacttcctggtctgagggaagccctgcgaggccctgggcacaggagtcagagggggaaggacttggactcccccgtccccgcccctcacaagcctttgaccttggacgaggcgttagcgctgaacctcactttctcactctgtaagatggccgtcataactgcatgcacttcttcagactggtgtgacgcttaaagactgccttttccccaggggtccctaaagggagtgggggtccctaaatggaggtgcaagtccctctgtgcttggatttccactgttcactcctgcaggatgctggacagtggtcaacaaatgctttctggggtgaaggagagtcattggtgtccaattaattggaataacactaatacatctttatacatctttaattcaccagtttataaaacacaaactgggaatgaacaagacccctggagagaaaaaatgaatgagaaggtgggggctgggctgtctcccaccccccgccaccaccagccttctgtatgcatttaccctttaggtcctcacagcaggaatggggctggggttggattgtttttaatttcaattttttggttacaaaattagtacatgcttattggtttaaaatttttcaggctgggagctgcggctcacgcctgtaatcccagcactttgggaggctgaggcgggctgatcatgaggtcaggagatcgagacagcctggccaagatggtgaaaccctgtctctactaaagatacaaaaattagccaggtgtggtggtgtgtgcctgtaatcccagctactcgggaggctgaggcagaagaattgcttgaactcgggaggcagaggttgcgtgagccaagatgccgagatcacgccactgcacaccagcctgaatgacggagcaagactccgtctcaaaaaaaaaaaaaaaaaaaattcaaagagtgtatagagtaggaaatgaaaatcatccacctctccctctccatgacccttctaccacctgtttggggcatttccttccaagcttttgcatgcatagcgaacatataaataaaggggtttgcttttgtttttgtttttaacaaacatgggaacagatttgcccttttaacttaatataccctggatgtcttcccttatcaatgatcacaaggtagatatgatggcctcatgttattgactaaaatggctgggagaggtcaaggcttttgctcaagatcacacacaggtgagtggcagagctgggcctgggatccgggtctgtctgaatctggagcagcaggcctctgtgctgtgcggaaacacagtcatcagccgttcttagcatctcggcacctcctggtaagaggaacttgtttctggaggtagacagctgagagaggcaggagatagggcagaaacagtgattgtggggctgggaacattgttccaggactaggggcccagccagggaaggcacagccccctgcaggtctgggcgggtaatgcaaaggggccaggaggaagggggctgggtgctgggacctcttaagtggcccctgttgtctctgccaggctcccaccaggcatactcaccttctttttttgagacagggtctcatctgtcacccaggctggagtgcagtggtgcaatcatagctcactgcagccttgaactcctgggctcaaacgatcctctggcctcggcctcccaaagtactgaggtagactgcaggtgtgagccaccatccttggacactcaccttcttgatgctatctttgccccttgtctatctgagccagcctgaagctctgagccccctccagtgggcctggctggcctgcagcctctctcccatcctgtccatggctcagccgctatgtgggcaaagtagtcagcgttgcctgcttcccaccccgtataggctcagaggcattagtctggcctctctctaagggatgccgggattccctggagcacccggcaggtggtcattcaacttttgtttggatgacttcagagatgggtagctcattaccttccaaggaagctggttccatcttgaatgactacaatgggtggtggggaacaagcttgggccctgaggcagagccaggtgtgtggggagactggaggagctgattgatgcatataagtctgctccagttgtgtgtgagaggagggagtcggtgagcctcagtttccccctctggcttcctttggatcagtgttgacctaactgcaggtcacaaactatgaatgagtcatgacattaatttagtgagttgtgaccagcatttttaaaaaggaatagaacagaataagatagaaaatatcagcatgcatttcaagaatttagaggtatctctttcttgagacttttgctgttggcgtgggggccgcatgctggtacagtgggcacagaggtgtcttatgggatgggtgggggcaggggcctccagcagctctgagggtggcctggaggggcctcttcctgcccaccctgcacacgcatccgagtccaagcaggggccccaggggcggtgggaacagggagaccctctcagctctcccctgtgcatctcgtgggcttggagtagtcccataaatcgtctgcccggagtcaggggcatagaactccctgatttatgccccgccaggtccgccccctctgcctccctctcgggctttgtggggccaaggcctggcaggctgctggctccagacggcccctgcggttgccgtggcgacaggttcaggctgggccattatcccggctccctcaccgcttcccgccctcaggcaaccctccctccctcgctcgcatcagggctggcatttgaacagcaccgcgggcttcttctccataagcctggcccctcctgcaggatgccccccaagtccagtgggacccatgcatccctgtcacagtgaagtgcagacttggaactcactaaggcaaggaaggggtgctgagcaagtgcctggccagcatgcggatcccgcttctccacttcaaggctggccgtcgcagtaccagcctcatgggctcactgtaaagaactcgtgagggtctacagggaaagggctggtccctgagacccctgcaagtctccattgcctcatctgtaaagtgagtgtaatgacattcacattcattgctctctcccaggacctgcagcagtgtcgggcacacggtaggtgctcaatggatgtgagtggataaatgaatcccatagatcattgtaaaagttcttaaatgagaacataagcatggcgagttgaaggtggccatcagtgctttgacaagcttcttactgagatggggggattcacttcccgtgcccctgggatctggacccacgttatgttcgtctgtagccaacagaatgcagcaggagtgacgctgctgccctccaaggccagggcagaaggaccttgctgcttctgtgttagtctctaggagacgccagccaccatgtaagaaacggataaaccctcacacctgtaatcccagcactttgggggctgaggcgggcggatcacctgaggtcgggagtttgaaaccagcctgaccaacatggagaaaccccatctctactaaaaatgcaaaattagctaggcatggtggtgcacacctgtaatcccagctactcgggaggctgaggcacttgagcctgggaggcagaggttgcggtgagccaagatcatgccattgcactccagcctgggcaacaagagtgaaactctgtctcaaaaaaaaaagaaaaaacaaaagaaactgatgaccctgggaactccatgctggcgaggccacgtggaggccctgacctgcaggaagagagagagggaggtacccagccaggccccagctcttccaggcatttggaatcatcccagctgaggcagagatgagtagtctccactgagccctgtccaaattaccgatgcatgaacacaaaagtataacttattgttctaatcaactttggattgatttgttctgcagcatggatttgctagaacagaattaaaaccctgagctccatgcctagcacacaataagtgctcagtgaagtagtagtgggtaatagtaatagtagtagttgttgttgctgatgctgctgggaagcaaaatagcctaataattcagaatcgaggctctggagtcaggatgcttgggtctgaatcccagtcgctaattctgcaatcctggacaagttactttccctctgtaggcctcaatttcttcatctgtgtaaaagtagtaacgggatgcggatgtggcagctcatgcctgtaatctcagcactttgggagctgaagtgggtggatcctctgagttcaggagtttgggaccagcctggacaagaaacagagaccccctctccacaaaaaactaaagagttacccagctgtgatggtgcatgcctgcagtttcagctcctcgggaggatcacttgagcctgggaggatgaggctgcagtgagccatgatcatgccactgcactccagcctgagtgacagagcaagaccctgtctccaaagaaaaaaagaaaagaaaaaagtaatgatagttgactacattgtagggttattgagaagatcacatgagaccatgctatacaccctgttgacacaaagcccgtgctggcacatgacagccaccaccctcagcatgggcatcatcctcattatcttcaattagatgttgaaagtgcgtgctctcattttataagaccctgaaggagtcagagttgggaggaacaaagcgattgtttgcaaccctccatcaccagatgggattgggttgctggtggaggctttgaattatgctatttttatctttataaagagctccgggtggcccatttgaaaggcaaataaataataatgatgacaatggggaatgagggagaggagggggagaagaatttgcctggaggagctcacctacatcactgcctctagaacagcctaagggactgattgattcctcactgactgctaaattctgcaagctcttggggctgcagggtagagaagcttctcagtttcttcgggtttgtccatcctgcctgttggacactgtcaggatcttccagatcagccagcccatcctctcattgtacatataaggaccaaagagggacggtgacttgcccaaggtcacacagtaggtcaagatcagagctgggaccagaatcagagcccctgcctccctccccggttggatctttcatgctgcttctggcctcagaagcaacacagtttggcaggggctttgcttacaaagctttcaggaacgggctttgccctctccctcttgcctaccacggactttcttgcattaaaaattctcattgtgggagtctccgctattactcacttctttcaaaatggaatgctagcagctgacaaggggcccgctcatctccagcaccggctagatcaggacaagggtggttttcccatccccctttcacaaaaggggaaacagaggccttcaacacacaaacgagcctgtgtttgctcatctcaaaaggtctccgtggcctctccttacaaaacaacgagcagactcccatctacctggtacactcgggaggactctaagactgctgtaagctcccctgctcagccactgtctccccaagccacctcgccatgcccaagaatccccctttggagtttcctgcttttgagtgagaatggcattaatggaaacctccgggtcgccatgctgttgcgctgacagtaaaggggtagtgtggaaaaaacacagaagttgacgtcatttaatcttgccttgccactcgttacccgtctgaccttgagcccgtcattttacctctctgaaccttagtttcttcgtctataaaatggggctcataattgggtctatgctaccccacgagggtaaaaggtggcactctagttgtccattgctacataataaaccactctgcaactgaatggcttcaaaacaacaatcctttgttttgctcatgaatttgcaatttgggcagggctgggcagagccagctgatctcgctcccctccccatagtgtaggtggcggcagctgggggtggctgacagggcctgggggttcccctctgcagtggtgactggcttgactgctttctccccacctggttctctccacggggcggcttgggcttccttataccatggctgctgggtttcagaagtgagcatcccaggagaagggaaagtagctttgggcctggaaagcattacagcaaacacttccattgaaatctgtcagtcaagcccagattcagagagaagggacataagaaatagcatttataattgcaacaaaatacagccgtgcctcgtgtaatgatggggatacgttctaagaaatgcatatccccaggcaattttgtcattgtgcaaacaccatagagtgcatttacacaaacctagatggtacaccataccacactcctggtctctatggcttagcctagtgctcccaggctacaaacctttattgcatgttattgtatagaatactgtaggcaattgtaacacaatggcaagtatttgtgtatctaaatatggaaaaggtcatgagttgcattgctagggcgtcactaggtgataggaattttttagcaccattataatctttttttgttatttagttttaatttcataaccataaacttaactctgcaatccagctaagtatagaagggaagaaggaaaacatggaactcaaagggaactgagccagagcacaaagattctagaatatggagagcaaaaggggtggtggggtgctctcctgagctacagaaggaatggtctggtgtttaagataaaacacaagtcaaatttgttggagttgtccacagtcagcaatggtgatcttcttgctggtcttgccattcctgaacccaaagggctccatggcctccacaacattcatgccttctttcatattgccaaagaccacgtgctggccatccaaactctcagtcttcgcaatggagatgaaaaaccaggaacaatttgtgttgggtccagcatttgccgtggacaagatgccaggacctgtatgttttaggatgaagttctcatcatcaaatttctcctggtggacggacttgccaccagtgccattatggtgcgtgaagtcaccaccccgacacataaaccctggaataattctgtgaaagcaggaacccttataaccaaatcctttctctccagtgctcatagcacgaaagttttctgctgtctttggaaacttgtctgcagacagcttgaaggagacgtggcccaaggactcaccatcaatgaacacagtggggttgaccatggctgatagtacggggctcccggcggtggcagtgtctgcaaagcgaatgcaccattatcatcttatgggaccatggtcatatatgcggtgcagtgttgaccaaaacgtcattatgtaacgtgtgactatgattatctacgtaattatttactgatgtctgctttccccaaccgtttagattgtcttgttcattgctgtatccccagagcctagaacagtgcctagaaagcagaagaccttcaataaacatgattcaatatatagctggatgaatgaacggagacctctcccctgaaatgacaaccctgggtccctgtagctcaggttagggtgggggcagggaggttatgaaaggcgcgccggctccagcagctgaggcctggttttggaccccaactctggccccagggtgctgggtgaccttgggtaagtcacagacttctctgtgggtgtcagcaaaagctaataaaaccagaccccgcttttcaacttgtgtcatccaaaactctgagtatgacttgctttaattaagataagagcacagtgaaatgtttggacttgctgttcattctttgatgttcagccttttgcattgttgttttgatgtccggggtcttggagaactggatttcagttcttggctctggctggcgggctgctggccttctgctgtttgccttgttaaaagcacttatgatctaataaagtgagattgatgtggcctccccggggatgaaacactttccattccccatactcactgtgcttcccagttgcactcaagtttgccatgtattatgtagcaattgagaactaggccctgggctgagtttcatttcatcctatgaggtgggtactgttactgtccccattctacacatgtggaaactgaggcacttagaggctacgggacttttctgaggtcatggtaagtaattgggtaagtaaaggtatcaggatccgggtccggagagctgcatggtctcttgtgggttgctggtggccctggcttggatgggaagcccacagggtacttgggtgggagctcgcaggataagaagcaagtgaatctccatatcttttttttttttttctttgagaccgagtcttgctctgttacccaggctggagtgcagtgacacgatcttggctcactgcaacctccgcctcccgggttcatgccattctcctgcttcagcctcctgagtagctgcgactacaggtgcccaccaccacacccagctaattttttgtatttttagtagagatggggtcttgccatgttggccaggctggtcttgaactcctgacctcaaatgatccacttgcctcagcctcccaaagtgctgggattataagtgtgagccaccgcacccagctgaacctctgtctctgagtttgttcagtgacaaagtcaggccttggagaaagataacaggcctatgaggtgttgtctctatgaatccccattttacagcagggaaaactgaggctcagagaggttgcccaaaggggattagaaagaataatggcctggaagaggaaagtgcctggttcactgtccggggttaagtcaggtcagaatgtcacggttgtaccagtcttgtgtgcgagatgttgactgaactgactttggcatcttactgcccaagaatagcggggatgggaagtgactgggcctccctgggggcagcccattctgtgtagaatggtcctcaggaagatgaaatcatgtaggaaaacaccccacatccgtggttcccacagtcactgatgggggtagaatggggggctgcaaaggaagctggtactctttactggtgctcagctgaagctgtgggtgcccccaggagcccaaatagcccagcaacgtcctctgctgttagtctgttgcaacattagaaattccaccatgaacagcttctagagaaagcacaaccttgttgagaagaaaggaaagtcacacgtgaggtcacttgcacagtagcctaggagattcagtttccttatctcaaaaatggaaccaacaccaaccccctcaggttgtgaaaactcccaacacagttccagggggcaaaggaggtgtgttcttcctgagtggaggggccccccagcagacctggagcttctggccctgctgctgaatgcaggaggatggcaactcactggaattctgctgtgcccaggcctcaccagcctgtaggtacccaggtcacacttatgttaatatccagatgaagaagtttcttagacctcatcccctccaaacacccctccccagccccagccagaaggccagttactcccggcgcctccccaagtggtgtccaaaccccagccgggagttttctccacttcttggtgagatgcctggtgactgcattggccacaggcgcgcctgcaaaaacgctgcaccaggtgtggccaccctccaccctggtcaccctgagcttccaggtgccacgtttgtcatggccatggaggtgccatgtttgccacatcaccatggaggtggtcaagcagtgggcttaggccaactccagtttgcaaactgtcacctgggccctaaggcagcccttccagggccctgggtcttgcatggtctccatgacaatgacttgggccgcatctttccctgtccttttctcaacaagactcaaaaccaaggtggaggacataccttttcccccttttccccctgtcacgctcatctccctcattcttgacctcaagtgcccagctcctccctccctctgtgaatcttcaccagagaggacccagcagggccaccatcagccagactctgaatcccagcatgggttcaactggcccagcctgctacagagagaaagggagtcccaccgcagcccctccagctggagtgtggggcatgagccacagcagactcaggccctccatgctggctgggcaagccccttccctgtctgggcctctactttcacatctgtggctagacacttcccaaggccccctccagctcagacattctgaggcctgatgtcttctctccacctaaggcagccagcagtgaccagtccctctttcccctccaggccacactggagcagcccagccccttatcacacgcagccgtcttcgttgtttgcatggtgctcatttcccctggctaagaaaacatgctcgcaaaatcagatttccctggaaagccggcaggttaaaaggaaaggaaacgttgaattctgtggagtggggatctgaaggcagggactgacctctgggactgccctcacacttctgggtccccttgattagaggaagcagggcctgatcccaaattcctgcccctaagtagtcccctctgcctccctcgggtctattccagcacccacaggcagctgaggcctggggaggcttcgagccttctcagggtcacacagagtgttattatttgttatcatccagaactttctgtggctccccactgctggcagggcaaacccacatgcatcctggtgttcaaggtactctcccttttcccttatgtggccctttggctctagacatcctaactcctcaccagcccaaacagccttgtctttgccacgagtgcctctcccccaacccacttctgtctgttcagctctctcttactcttcaagaccccactcagaccctgcctcctccaggaagccttctgtgactagccctgcccacatgatcctctctgaggggttctggccacaccgggaggagcctggtcgcttctcatctgtacccaacctctccctggggacaaaccctctttgggcccagctgtcttcttgttcagggcctggttcccacttcctggagctggcttggccggctcagggccgccatgggccaccgaggagagaaccaaaggatttccttgggactaaatgataccaagagtggcagaaggctgcttaagggccccaccttgggtcctttcttaaaagtgacttttcctgatcttaacgtggataaagcatgagtgtggtcacagaacagctctacagctgttggcaagatgagataggcctacctgagctcccacggagagctgtccatgatgaacatgtaatctacagaatgaaatgtacgtgtggtgccattcgtttttaattaaacaaacaaagcaaaacgcctataatggctcatgtgcgcccagcactggtctgagcactttgcgtgcatggactcactcgatcctcctaatgaccctgtgcggcaggtaccctaatgaccccattttacagatgagcagactgaggttcaggggagggattcaagccctggccacaggcaggctccagcacctgtgctctcaacctctcccctgtgctgcctgctgcattctcagtgctaatctgtgcttccaaacaatacataaccaaagggagagagaagccgggaggaaggtgccactgggccttgcatggagccaggtttggagagagaaaaatagggagactttcacttcctcttcttgcattctgtattgattggttatcacaaataatataatctatttgaaaaatagaaaaagcagcacatgctcattgtagaaaactcaagagagatgagaaaggcttcagaaactagagtcagcctgggttctgggagctggcagggaagcatactcaaggccagaggattctagaaggatcaccatgaaaatgggtgagtaaccaggcttattgtaggtctagtggcgtcaggagcaagagctgactgcaccttggtgtagaaggcgctttataacccattagtgctatttcaccatggaaaacggcagccttgtttggtagtaagctgcccatctgtggaggcataggaggagatatcagatgcaggattaatgctgaactgtttgctctatgtttcatgtgagttagtctgtttcccagtcctccacctttaactcaggctggacagaaatgggatgtacttacaaggatgaagccccatgcctaactggttaaaaaaataacaaatgatttaaaaacaggattcagaggcttgcacagatacagcagctccaagagcccctcaacataggtggcttcatgtgattttagaacctcccaacatcactggcagaaacattttgcagagaagaaagacgaaaagctcagggaggtttcgacttgcccaaggtcacccaactggcccagagttcctggctctgctcagtcaggtggccatcccacatcggggcatttctcacagtgattgttcatttccttccagggcccagcatccagtaggtgctcaggtccttcatgggacggcgtcagagaccctggttctgttctggctctggccgaatgtgctgagcgagtcccccacccgtcttgtgctgggtttgatatttctgggctcccttccaggtctcatctgtctgccacccacccctgttccttagttttcttagcttgtcccctgacatcagaccccaaggagtcctcagatggacgggggaagggggagggcccgtggggcgtcaggcgccctgatgcttggacctttctttcattccatgcagatttataggcgtgtgttcctgagctctcattcactgtccacagcccaacacatggcctaaaaacaacagatacgatgaaagagatcttgcctgcagatgaaagcaagagggaaaccggcctcccccagccctggcctggccctgggcccactgcacattgtggtcaaggcaaagtcagggctgggacgtctggagaaggccagaaggctcctgcccacccatgggcctggggcttccaggggccctggtgcaaagcctcggatgaagtactgggggaggcaaaaggaaatggaggccctgtttctgggggcaatcggctggcatgccaggaagggggccttggcagagcctagagtcagacagggtgatgacaaatgaccccggggcccctccagcaccgcccctggggactctgccttgcccactctactccagccactcaggcttccttctgttccttgaaactcagcaagctcatctccctccaccccagggcctctgcacacagtgcccacaccgccggaatgctctcctccgcaccctcccgagacctcctcggccttcaggtttcagattgaatgatgcctcctccaagagcctccgactggtgacccaatccattctccaatccagccctctgttttcttaatgtacttggcacactttataatcatttgttgtagtgattataggtgatttaataaattaacattttcatatcaattagattgttgataaattataattattatcatttatagattattgaatgatttaatgattatctgaaggccccatgaggatgtgttccttgtgccctctgggtaaatggggccagctctgccaccaactcactgctctgggcccaggtatcaggtcttctgacgataacagcaaatgatgtttagcttttcctaggagcaaagcattttccacatgactttatttaatcctcacagccacccaataaggcaaggcaagggttatttccattttgcagacgaggagactgagggtgagtgtatctcagctgcagcccggacacagtctgcttgtccaccatgcctacccaactgcctgagtccccaggagccttgctcacctttgggactctcccatatgtcacatgtgagtgctacgggggaggacatagaactggtcatcaggcagtgacccttaagggtgaattcatctgttcactccctgagcagatttccttccaggtggagaagagagggattcatcccagagggaagaaagccagagctccccacagggtgagccactgtggggacctgggatgccaccaggggagacgcattgggagggagggggctttctctgcacagccgccacccacagacccctctggccctctcttggtctgtagagcgacatcagtgttcccagggggagggacctggaccctctcctgtgttgcaggcggaaggtgggtgggtggatggtgaactgtaaacgctggtctgtgaggcggccacatggcaccaggagcagggtctttcgtagcctctgtgccccttgctctaggtcattctccttcgaaggatgccttctgaagaagcaatcagggacaaggaaggcgacttctgacaggcagtgcccccagactaaccaccccaaaccctgtgccagccccttcctgtgctcaggaggccagaaatgagtgtttataaccagctgttggagtctgggggggctgggatggaaagggaagaaacagctgcgcagcttttgtgcccttaaaaagacaaatcacaaaccgatgcctcaggactcccactgtctacacagctgatggtcagggcttcatacgtgggcaaaagtcacggcatgagtcttcatttgctcacatgaatgaagagaagagagaaggttttaaaatgtctgttgggggatatttatgctattctttaaacttttgtatatgctgagcttttctataataaaaagtaaaaaagaaaaataggaatgagggagggaaagagggatggaaggaaggaaggagaaagggaaagaaggaagagagaaaggagggagggagaaaggaaggaaggagtgaggagggagggagggagagagggagggagggaagaaaagaaggattccatatatgattccattttttgagtaaatgagtcgtgtgtgtatttgtatgcatgaagaaagtctgggagcatatgtacaaaaatatttacaactgctatctctagtagggttatgggtgatttttattttcttctttgtacttttaatttttctaattgggaagaaataacacaactattaagaaaaagaaaggggcctgggcgcagtggctcacccctataatcccagcactttgggaggccaagacaggcatattgcttgagtcaaggagttcgagaccagtgtgggcagcatggcgaaaccccatctctacaaaaaatacaaagttagccgggcatggtggctcatgcctgtaatcccagctacttgggaggctgaggtgggaggaccacttgaacccgggaggcagatgttgcagtgagccgagatcatgccactgcactccagcctgggtattagtggaagtctgtctcaaaaaaaaaaaaagaaaagaaaagaaaggaatgtcttgtgttctagactctcctccatccactcagcatctctctgactctgcttcagtgacctcatcacaatgagcctcatctctctccccagcaaaatgggggcatcactaatggggatgcagtgaggacagaaaggggcggtactgagggtacacctggtaggagcccaacacctgtgtgctgccccccacacacactcaggcacccacacgagtgagagcccgcacacaccacagaccccggaaggacagcaagacttcctggccccacacatgtgccctggttcaccctcgtgcccgtatgcacaaacacacacgcacggtgcactcatgagtacacgctgtaacctgcgtggggtggctctgtcagccgaccgggtgggtgagaggagaaagccccatcccttttcaagataaacacaggaagtgaggatcccacagtgtcaggacaaggttgggagtcatccataaactccaggcaggggtgggggatggagaggggcccagagaggggaggtggggtgtgggagtctgggcagggcctgagtttgacatctgttgtcttgggttcagatgtgaaaagttgaaatggtgactaagcttgggggctatcttagctctgtctgtctgtctgcctgtctgtctgggacaatacttcccaccctcacccacccctctctccccagtcctgggcttagtgagccaggtgttcaggtcaatcggaggcccaagggcccccagccaggcccccacacttagggaagccagaacctgtgctcagcaaatgcttgcaaaggccatgagtagatggaaagaaacagtcatcacggattccaggatgctcccgaatccagcacatgcttgagtgcgtcccggcccagctcagatctctgagagattatcctgggggtagctgccagggactggcgccccagccttctcctcccaagtctctgctcctactttcctcaaagcctactgagtcccaggggaaagtagcaacggggcctctgccaggccaaggcgggtgggagggcacagggctgaccactcagggcctctggagaatgttgttggatgaatgagcacttgctgtgtgccaggtaccttacatcagccttaaatacttttctggaacaaatctagggttgggggagagaaggatgttttctacctcaccccctagccacgcaactgccctcactttgcgatgaggttactagctggatccaagtcgcacagttataggtggtggctcccacctgcaagggcagagggacagatggaaacctttcttgaagcattctgttatgaaactccccactcattcccctgagcaagtggggttgagtatagagtttccctttcgaacacaattgcctgcccatcttttgctatcagaagcctccaaccccacagctagagcccctggacagtccgagagcctgggcacaccccacctctgcctgttggccacttgggcaagttgcccacattcttcaccctctccctgcaccggtgcttcaggcgtacctggatttctttggcttctcataacctcacctgtgcacctcccaaccattatttcatttgcttctcccagcaaaccaggagatagaaagattatgtccattttgtcaatgaggagactgaggcctggaaaggtcatacagacaattagaagcagagcccaacccacacccaggcagattccaaacccaaccctcttctcctagtcccagctcctgcctctgccacggctgctgagtcattggtggtggcagcaaggctactgcagagacctcagggtctgggcttcctgtggcttctgccttccttgtcacctccaccttgctaccagcttggcctcaggccccagacccagacttcaagccccataaggcccagcactgcctagtccttgcccgggtactcaaacagctctctctccctttgctttttactcaacactttcagtcatgtggttcctctttcaaatcctcaaactctctgtttttacctaccccagggatcttactgttacttctatttttctcttttaaaaaatgtattcactggatggatgtatgggtgggtggatgagtgattggatggatggatgaatggatagatggatggatgggtgattgagtggatggatggatggatgattggataggtgattgactggatgggtgattgagtggacggatggatggatggatggatgggtgatggagtggacagatgggtaaatggataaaaatgagtgattgagtggatggatggttggatgggtggatggatggatggatggatggatgggtgacggagtggacagatgggtaaatggataaaaatgagtgattgagtggatggatggatggatgggtggatggatggatggatggattgttgagtggatggatagactggagggatgaaagggtggtgggtgaacaaacttgactggatgaatggatggatggatgggtgggtggttgagtggatggttagactagagggatgacagggtggtgggtgaacaaatttgactggatggatggatggatgggtggatggatggatggatggatggatggaggaatgagatggaaggatgctgctaccgttctgctcagattttggtcttctctctccccacctaagtgccttgtacctacagttttcacccccaactctaatttgcccggtcctgcaaagtttgagggaacaactgggagaccacagtaacccttctctttggtccccagtttcaattctccttggggtgtcctgacagctcctttcaggtccccaaatcagcctctgggaggaaggaggcagcctttgtcctcagtacaaatgcttgaatatttgagccttttgcctgttacagtgactcccactttgggggtggttttacatctctttaattgtcttgaaactaaaaacaaaactgaaaatttccctcaaataataatgcactttaaggttaattaactaaaattacttttggtgacttgatcttaaactctaaaaaactagaaagattgttctttctagaagtgttccaaagtaaattaataaattttaaagggacacccatctcctaccaaaacaccatgtagttaagagatcattatttaatcgcccccaaatcaagcatgaatatctataagctgaggagctaaacaacaaagaaaaagtggagcaaacaaaatcagatactcggtgggtgcaaaaacactgaaggggggcgtcaaaaggtgaacaggtcattgggttaacagagttttagggaatgtagcagacaccccatttttctctcccagatcccttatcccaactcagagagactagagcaggaatcttcacacctgagttcttgtccaggggcagcctgtgagccctgtgctcacctggtcacaagaggcaatcactaacactcaggaagtacctgccttctttgccctgggccaagcccctcacacgagggcctcacttcatccggacctcagtattgtgatctccatctgccaggtgcaaagctgaggctcaaaacaggaagtggcagatctaggatcaaagttcaccttaaagaatatctacctcatattcccatgaattaggtaaagcaaccaaagtttagagcagaccagaccacacagccagcgagggcagactggacttcagttgtacaaacagtagtgcaagtgtcgagtgaatgagacagacagtggatgccagagccatcacatgggagatcagtttctgcgggggtgtgaagtggtggtgaatagaaggagagataaacagcactggtcagggaggacttcctggaggaagggggcattgaccaacacagaacatctggcaggaccagtatcctcctgaatttccatggaggtggaggaaaggagaacccttcttttctctcctcctgggctctctcgtgcagttggagtcaacagagtagccactggccccccaactttgagtaaaaccccatcccccagcagggcaagaggggcagaagcagccagcagcctcccatcaagccttgacaggagttgtcaccagtgcagagccagcggagtgtggtggggccctgtctggccccagccccactgtttacctgtctgggttgttgctggaaccattcatctcagtgaaggatgacatggcctccctcctccctcctcctgctcagctcctccactgggcatccacttctgcagatctccagaatgctccaagcctcctagatgcaccccctgcatgcctgctccttcctggccagccttgccccaggtgtgctcttcctcccattctcacccatgtgctgaataagcagagtgccactggccacatcaagagctacctgtgtggctgcggccctgctgggtgccaggctctgtgataaggaaacacctgatggccatcacttcttgatccctcatctacatggtggctatgaaggaagagaaaaacaggtgatcacatttctgtgtgatcagtgaggtgggagagtccatattagttatagtgatcagaccacggagattggagctgctaattctgccaaaggaagtggacagggatgggaaagtggagatggatgggtggatgagtggttgagtggatggatggatttgttcacccaccaccctttcatccctccaggctatccatccactcaaccacccatccatccttccatccatccactcaatcactcatttatccatttacccatctgcgcattcaatctccatccattcatccatccatccatccactcaatcactcatccactcaatcacccatccattcatccacccatccactcagtcacctatccattcatccatccatctactcaatcacccatccattcaatcagctatccattcatccatccatccactcaatcacccatccattcaatcagctattcattcatccatccatccactcaatcacctatccagtcaatcacctatccattcatccatccatccatccatccatccatccatccatccatccatccactcaatcactcatccactcattcacctatccatccatccacccatccatccactcaatcacccgtccagtcaatcacctatccattcatccatccatccactcaatcacccatccatccatccatccatccatccatccatccatccatccatccactcaatcactcatccactcaatcacccatccattcatccacccatccactcaatcacccatccactcaatcacctatctattcatccatccatctactcaatcacccatctattcaatcacctatccattcatccatccatccactcaatcactcatccactcattcacctatccatccatccatccatccatccatccatccatccatccacccatccatccactcaatcacccatccaatcaatcacctatccattcatccatccatccactcaatcacccatccactcaatcacctatccattcatccctccatccactcaatcacccattcagtcaatcacctatccattcatccatccatccactcaatcacccatccagtcaatcacctatccattcatccatccatccactcaatcacccatccatccatccatccatccatccatccatccactcaatcactcatccactcaatcacctatccattcacccgttcatccatccatccactcaatcacccatccaatcaatcacctatccattatgcatccatccactcaatcactcctccactcaatcacctatccattcatccatccatccactcaatcacctatccattcatccctccatccactcaatcacccatccagtcaatcacctatccattcatccatccatccactcaatcacccatccatccatccatccatccatccatccatccatccatccatccactcaatcactcattcactcattcacctatccatccgtccatctctatgggaaagccatagagaggggaccatcaaggatgtccttgaaggaggggagggtgttttcaggtagaccaaggataaagcattccaggcagatgcagggtaccatgagcacatgcacctggatactccacacataaccagcagtcaggagtgaccaggtgtctgtgtgtggaaaggggctggcaacttccacagggctttttgagcaccctccttctggaaagccccctggtcactggtcctcaaccccttccaggttcctgtagcatttgcagatcgtacttataagacccttaaaagaacaaaactcaccttctgttgtaactctcccagcccatgtttccactatctgaggatcacagaccccttgaaggcaagagttgtgtcttatatttcctgacatttgttatcctcaacccctggccctgtgtttagtacaattgtgaaagcatacttgatgttcaaaaaagattcattaaagtggccgggcagggtggctcatgcccatcctcctagtgctttgggaagcccaggaggaggatcacttgaggccaggagtttgagatcagcctggacagtgtagtgagacctcatctctacccaaagaaaaaaaattagctgggtggtgatgtgcacctatagtcccagctaccctggaggttgaggtgggaggatcacttgagcccaagagtttgaggtgagcccaagagttcgaggccacagtgagctgagatcatgccactacactccagtctgggtgatgtcatctctatttaaaaacacaaaaattaattaatggaagccttggtgaatggatgggtcgctgacatctctgcaggtgtgtgtgtgataagaccacgcatggtgaattctcaggacatagcaggtgttcaggagatgatggttcaggccactatcctcctcgctcatgtgactctcaggagccagggtgcctcagagctcacaggggacagagctgaatggggggacacttcgccttccactttctcatctgtgatgtgggcaaataggaggtttcttccagctaggacggcgtttgggtcccgagccctctgtctctcatgctgctgcctaaactcaggacacccgcggtacggtggttatgcacatgggttcttgggactggcacgcctgggtctggaactcagctccctcctgtacccaccatgaatgcttggaatggtccctgcccctcactgagcttcagggtccccatctctaatcaaagactctggaggcccttccctggtgagttttcatggaatgaatgagatgcagtgtgcataggggtccacagtactctcagtaaatgttactgtcataaccatattttaacatcctaagaataccccctcctccaggaagcctcctctgactgagcctaacagaggtaagaatttccccctttttgcttctgctcagcagctcccagctcatattctgtaagctctcagtttaggatagaacagcaaagctgctctggccctagttctggccccaactccagtaccagctctggccccaaccctggagtccagagaagtctcgtttgggcagtttaagtcagagggtcatttctgggcctgggctccaggttccattcaaatgggggatcccagagggtgcggaccatgtcctgtaaattcaccccagcggctccaggaaggctccttggggtgtgagacatgctggtggccagctaccccccagctggagtcctcacgctgaaggcgagacagcctcagcggcggtggcactggctgtgcctgacaccctcacccgggacatcaggctgccctgcccagtcacccacagggctgaggcctcaccacatttgctgcaatacccgctgcccttgggctcacggccatcctatctgcggcagcctctgtgtgaactctgccccgtgaccccagctggaatggaggatgccttctccagcagcctcccatcggtagccagcagcagggcagggcgggggcgggagccacgggacactgggggctgggccaggctgcactgggaaaaggggcgctttagtcctcagaagaccctgatggagactgccttccccatggcctctttgctcaaaggtctggtcagaacccctgtgagcatggagtcaggggatccccagaaagcagcgctggaggagggggcctgctcaccctgggggaatgggaccttcacaatttaggtaggaaaagagaagtggctcggcagagagcctgctccccacacccgctcaccctggccacagatgtcctccccagccccctacatcacaccttgttgatttgtcttctccttagcccttcccacaacctgaaaccccccaccacactgtgagcaccacagtgtgagaacagacattgtctggtttgtcacatgtccccagtgtctggaacaaagcctggcacacggtgaatgctcaataaatactcattagattaatgaccatactcatttaatccttacacccacccttcgctgtaggcaacatcagttctattttgcagatggggagactgaggctccaagaaaagaggggaattggctactctgcaaacccggtaaccagcaaaacctaaatcaaacccaggcctctcacctcttgaccacaagccggcgtgtgatgacaccaactggttgggttcagcataaagaaagaaacagaggaacacactggcctgctggcttctgctcccctcaggctgcttccccaggcaggttgtgcaggcttttgttggggtagggggtggattttattccctgagttaagtaacctgtgatcaaccccttgtgttaacagctatcatgtgtagcctcagcctcctgccttgcccctgagaggatctgtgttaaattgacaccagcgatgaacagtgtggctgagaggcagggatgggcaaggaggggcaggaagcaggggctggtctgtggcctgtggacgtggatagaggctctggcctggaattgactggatgcatgttatgtgtaccaagcgctgttcccagcacttctcatgcatcatcccagttcatcctcacgaccatccttgaagatcctcagcatcattctccccagtgtctggatgaggcagctgagcccaggagaggttgagctacttgcccaaagtcacacagctggaaagtcaagaagccagcacttgggacccaggcgctgtggctccagagcccacccatggctctcccatgtctgggggaggaacacagcttcagagctggattccaacctgagttgcattgtgtacaagctgcctgagccagctgcttaatctctctgagcctcggtttcctcagctgtgcaatgtggacacaatacccactttgcagggtcccaatgaggcaaggggtagaaagggcatggactgtgcctggcacatggaaggggtatgacaaatgggggtggcacttgtggttcatgtcccatggcccgtgagtgtgccatgactgatgtttccactctagtttcattttctagaaatgcagggtcagttacaagtcagtgaaatcagcctcagcccagtctcagtcctttctctgtatcctgatggtgcctgaaattctgccactggggcagcattccctgaattgaaagctgtgttcccgggtgaaatgcaacttcccacgggtgttattatggctggggaaggaagtgatgctgcacatgatggctgtttttgtttttgttttttgaggcggagtttcactcattacctaggctggagtgcaatggtgtgatctcggctcactgcccccttcccgggttctagtgattctcctgcctcagtctcccgagtatctgggatttcaggcacacaccaccatgccaggctaatgttttgtatttttagtagagacgaggtttcaccatgttgtccaggctggtcttgaactcctgacctcaggtgatccaccctccttggcctctcaaagtgctggggttacaggtgtgagccaccccacccacccagctgttcgtagtcattttcacctccatgtgaatggagattccagaattgcatgccttggtgaagtggtccccagaaaacaggcagaaagggggtgactttgccaacctcacagttttctgcctgtccaatggcagccttgggtcatagcccacgcccttggataccttctttcgcaggccaggtttagaatcccgagcacttccctttccacccaagatggtgatctgaatatgactcttagttcatattgataataacactttactttgtgtggcactcttttctcttgtttctccagtgtgagcattacaccccatttcacagatgaggaaactgaggcccggcgggaagtggctggcagtaccaaagcctgggctcagagccagctccggggctttctctggggcttgggcctgatgggcctcccccgggaccaccactgtccccctgcccacactctttcccaacagagaggcccagcccctgggccaggctgggaatgatctagggggaggcccacccgccctgtgtcaaggccgtgtgtaagtgttttattgtttgcccgcagaggtgtgaatgaagtaatgggccttctccagcactccatccgtctcaggctgacagccgcgctccgagcccaggctgctctgtgtaaacgctgtcaccctgccatccccgagcaggcagcttcctccgggaaactgtaatcagggcctcccgcacccgcagctggccctgtccgcagctcataaatcacgctgccttcccggaaagcagagggagagacagacagggtgacgggagacagacgaggccgggcgaggaagagacgatggggaggccggtggggagagagggaggcagtgaaggcaggctgagcaggcaggcaagcagggcggaggaacgagcagagatgagcagggagcaaggctgaaggaggagaggaaaggagagagagtgagagacacagaggcagagggagaaaagaggcaggaaacagaggtacgagagagagagagtcccacagaggggacacagagataaggagacagagaaagggagacagactcagagacaaagagaaaagcagaaacagagaccagaagaaaggtaagaagccagcaggggaaacgcggagtgacagaaacgaagtggagccagagggagtggacagagagagggacacacacctgacaggtggcctcggctggggacgagggacaggggtccagcccatcatttagaggaggggaccaggaggcagcagccttgcttcagctgacaggtcctacagctccccctggcctgggcccctcctggtgctcagacccccctccctccacacctgacccagccagagtttgcagccagccagtgggagggctgcatgggtgggagagaggaggagggagaaggggggaacctcctggactcccactccaggggtccccaccccagtcccactttcaccctaggaggtcacagtgaacctttgagggaagacaagtcacttagccagcagccctcgggacacctgggccttgcaggcacccgcatgctccacacactctcacgtcccccggtgtccacacacactcaggccgcaggcacatgggtgagtggccgtgcacacctgttgggagattcccacagggtggacagggagacgatggggctcaaagccctgctggccaggtggccacagccctggctgccacgggaaaggccttccagaactgggagagaatgtttcaggcagcattcagcctagcaagggattattttcccagtttaagtcatgaaagttgatttaaaaaaaaatctctctgccaccaagccctattataggctgtcaggatctagtgggaaacaaaatcaaatttctgtctcctcgactccacatctagtcagagagacagacaatcagcttacagagcaagcagccagcgcatcacagaatgagcgctgcggaagcccgaactgtggggaaagaatcagggtttgactccgttatgaaaggtggtcagcaaagccctcactgggagggggacctctgagcagaaactcgaggaaagtgagggggcgggggaacagcatgtgcaaaggccccgaggcaggaatgtccttggcacatctgtggctgcagcagagtgggcaaggggaagtgggttagggggtaaggtcaggtcccaggggaccttgatggccattgtaaggactttgactctccatgtgaatgccaggggaagtcactaggggtgaagatgacttgagctgacgcatctgcaagggggcctctggctgctgttttgagaacagactaaagcaggtgggggtggggagagggcagagcagagagccccgggaggaggtgatgggcgaccgaggcggaggtgagggaactcattcaggcgagaggcgacggcgcctggatggggcggctgcagtggagcagggagatgtggtcagattttggatgtgttagatttgctgatcgactggatgtgtgagaaatagaggtcaaagatgaattcaaggtttctggccagagcgactggaaagagagagtcgccgttgactgtcatgggaaagatggtgaggatttgagggctgggtttggatgggttcagtgcaaaaagcctcttgtgcctctaagcggagacgatgagtaggcagcagaggctgctcccgggtgatccaggggctgcggacttggacttggaagcagccaggctgcagttggtatacaaagtcacggagctggataaggttagctggcgatcgagtgcagatcgtccaaagactggggctctatgcctcatgcggaggctggagagagaaagcaaatgcaggaagatgaaacaggagactcagtgagatacaaggagagccaagagacagcagcatctcaaagccaagtcgaggaagtgttttaaggagttgatcagcaatcctgctgagaagccaagaaagtggagccctgaggatgggccgttggatttagcagcatggaggccactggagacctggacaggagcagttttgggggacatatcgacagtgaaaacatgactggagtgtgggcttgcagaagactgagagaagaggaaccggagacaatgagttcagacagttctttgggggaagttttgataaataagaagcaaaaagaagtgggaggggtgtggaatcaagacaaggtttaaaaaaaataacctttttactttggaataattttagatttctagaaaaattgcaaagatactacagagagttcccacatacccttcacgccgctttcccaaatgctaacatcttccttaaccacagctatgtgcatcagttggcgtatcagttccgtccgtccctggtgcatcagctccatccacccctggtgcattagctccatccacccctggtgcatcagctccatccaccccaggagcatcagcgtcgtccaccccaggtgcatcagctccatccaccccctggggcatcagctccatcaacacctggtgcatcagcgccatccaccactggtgcatcagctatgtccacccctgctgaatcagctccatccaacgctggtgcatcagctctgtctacccctggtgcatcagctctgtctacccctggtgcaccagctccatccacccctggagcatcagctccatccactgctggtgcatcagctccatccacccctggtacatcagctctgtccaacgctggtgcatcagctccatccacccccggtacaccagctccatccaacactggtgcatcagctccgtccacccctggtgcacaagctccgtccacccctggtgcatcagctccatccgcccctagtgcgtctcctctgtccacccctggtgcaccagctccatccacccctggtgcatccgttccgtccacccctggtacaccagctccatccagcttcgctgcatcgctatgggccttgaaatgtgccaggtgagtgtggtggagcatagtctagctgggaacaaagaagtagaaaaggcaagtcagaggcatagagccaggaggggtcaagcaggggacctgggacaggacttggcctcactatgtcctagtgagtggggattggtggttaactctagccctctgcctgctccccactttctttgtttgtgcctataattcactttatgtataaggtgagctttgctcttttcaaccgaccatactaatgtctccaaaatgaatggatgaatgaatcccattcttctgtaagacccaaagccaacatcttgatgcttggttgcagagatcaacattggcacccaaatcaagactttacacacacacacgtacccacacatgcaatcacacacacacacacacacacacaatcacacacgggcaccttgcaaattgctctccccacccctcttctggaaactacaattttaccctcatacaagtccgcagtcccttatctaaaacccttggggtcagatacatttcagacttcagaatgtgtctgattttagaaggggaatttggtgcatataccatagatttcataataacctctgtagggcctgagcagcactcagtaagcaaacgtgactatttctgcagtgaaatgtgtgaatattcacagtaagtgggggaaaataaaggccataaatagcctcatgacatttcaagttgtgttttaccagacttatgagttaatagaaaacacggcctttggagcttcttggatttcaggatcgcaggtgagtgcctctcacgagtccctcagccaggtgggctgctcagccctgatgtacaccaacccacatatttgttcacttgtaataaatgtcaagagccatattcttgccatgggagcagaagggacggggctgtgtgtgtgcgtgcgtgtgcgtgtgcgtgtgcatgcgcacctacatacacgtccacataccaggaacattcttgcctctttcagtccttgaatttttctctttcaaggctggagggagcctcaaaagcatctcttgaatcttctcaacaacaccctcatcgagtggctacccagcttctgctgctgcagctgccctgaactccatccttctccatgacccctcctccttcctgtctcctccctaagcatctctttcctatctcttctagaccttcaccacctttgtcttcttcctcttcttcctccccctcctctccctcccttcctctcctcctcctcttttgtcccaggaaacaaggctagaaaatcaagcagccccagaggtcatattcatcagcaaaattctcccagtgggacctggtagcacattgaaaacttgggccacttcggcttctgcaagaggcagccaagccccagcttttgtgcagccaaacttctggccagtgagtttacttaagaggagggttctggatcactcgagcctgggaatgtcaaatctacagtaagccatgatcataccagtgcactccagcctgggaaacagagcaagaccttatcttaaaaaaaaaaagaaaaaagaagaagaagaagaagaaagaaggagaaggagaagaagaagaggccgggagcggtggctcacgcctgtaatcccagcactttgggaagctgaggcgggtggatcatgaggtcaagagatcgagaccgtcctggctaatacagtgaaaccccgtctctattaaaaatacaaaaaaaaaaaaattagccgggtgtggtggtgggcacctgtggtctcagttactcgggaggctgagacaggagaatggcatgaacccagaggaggaggttgcagtgagccaagattgcgccactgcactccagcctgggcaacagagcgagactccatttcaaaaaaaaaaaaaaagaagaagaagagttccctgccgcctactcccttccgccttcagaaaggactaacctgattgggcctgtagatactcagacagacgctccctggccttagagtctcttctttcgtttttattattttaaaatgagaaatatttaaagttttacatttttttttaccaagtagttcaaaaaaagatgaattatttttaaagcttcttattttgagatcattcgaacctacagaagagttgcaagagaatagtacaaagaattcctgggtatcttttgtccatattcagcatttcggacattttgctgtatttgctttctcattctatgtatatatattccctttttctgaaccatttgaaagtaggccgtgtgatgctactgtttgccttcctacttaagtgagtattttctaagaatgaagatcttctcttatataatctagaatatataatttcacaatccaggatatttaatatcgatacagtgtttctatctaattcacagttctcctccctgatttaaacgtccctttcttcacattttcttgaatgatcatctatgtttgggggaaatccatggtgctgagtccagccatggtgcccctgggttagtgtggattttagacacaaacaattccaggggccctcaaactaggtaccacagaaccctagaggttccatggagggaggggaggcagcactttggagtggaatttgtttgaagaaaaaaattcgactttaaagaaaaaaagatggatagccacagagaggccagtctgttcattttgtatttgagagtggaggtttagggaggttaagcaacctaccctatgcctcactgagcagtagcggtgagtcgagcagggatctaaaaccaaggcatttattcatttaaccgacatttctcgaacacagcgggaagagggaaatgggctgcatcctggaatctcagagaagacagacgaccagcccaccctcctgaagccgcctgatgcggccaggaggaggctgttgtggtcccctttgtggctctgctgaggtgggccatgagcttaccaggaactttggagaagggaagtagcctgtgaatcagcagcggcttttccaagaacaatagtgttctcctaacaaacattcgttccatcagcaaactttggaacattcaacaaacattggtccgttcaacaaatatttgttctctcaccagtgttgactcagctcctctcctgtgcacagggactgcagacgtggtgttagggacagagtcccaggtggcataaagtcgggttggtccttggcaaaagactcagggtggcagaatgctttcaatacctccctcctttcctctgtcaccccaaaccacagcaaaagagacaggatgaccccagccctttgctcccaagggactgactcccaaactcctcctttatcaacaaaaccgttcccgttatcaagcagaccctcccgtcccagattctgctttccagagagcaattcagcaagagttagtagaaactggccagccacagtggttcatgcctataatcccacactttgggaggccgaggtgggatggatcacttgaggtcaggagtctgagaccagcctggccaacatagtgaaatcccgcctctactaaaaatacaaaaattatccaggtgtggtggggcgcccctgtaatcccagatactcaggaggctgaggcatgagaatcgcttgaacctgggaggcggaggttgcagtgagccgagatcacactactgcactccagcctgggcgacagagtgagactctgtctcaaaaaaaaaaaaaaaaaaggaattagtagaaatctctcaaatgtgtacaacctttgaggtagccattctacttctaggaatttaatcaaaggaaaacctcagtgcagggatgcactgacatttcacatgctgcttcccatcgttgtgaaaggacgcctcgcattctgggtatagatgagccatgcccttcaccctaagtggcagtcctaatgctccttgctgggtcctggatttcaaccctgtgtctcacatgtacatgcaaacgtgtgtgcagacagatgtgtgcacagtgtgtttcctgaggctgggcatgctgccagctgatgccaaaataggggtggggacagtaatctctaatccagagacgagaatgatctttgatatgagagctggttcttaaagctgcttctcttgttccaggcaaatagactaattgggattgcctccccgtcattttcccaccctactccaaacacgcactcacacacccaagagacacacatgcgaatatacagattcttaacagctaggcatggcttctttttgctgggagaaaaacagagacaaaaggattaaaaacatacatgtggtgacctcgagtgtgtctgcacaatctccaccgggagtgctccagcaggcgcacccacgtgcacgtgcacacacacacacacacaaacacacacacggcatgctcccaaggacacagcatctgtgtgtgctttggggggtacacacatgtgcccacacatctgggcagcgtggtcctgtgaaaagagacaggtccgtgtccagtttgctgcttattaattttgtgaatttaagcaagtgtggcctctggaagccgttgtttcttcctctgggcagtgggagggcaggtgtggacgtgctttatgcattgtaaactgccatctacattagggagcccaccgttgttagatatgcacgggctcatatttataaaaaccataggaagcagtgttggtagactctccctctccccgcctctgccttccgcactgggatgctgttctcatggcctcccttctgctctgctcggctcactgctgtcatctccgcctgcatcacgttaattacaaatcttggcgctttcagatctagctcgggaaaggatctcagaagttacccagtcagagaggcatgcgctgtttctgtcccagagaggtataacccaggtctcagcagaacctggcatacactctggatgtggcttcagccctctcagggagggcaccactcctggatgactgagccagggcgcgagccccagggaaagggggatcaacagacccaggaactcgcactagctcaccccagcaaggggaggggctggcccaggggccctgctggcagagccggccaggctgggatttatgggccccttttggacacgttaaagatcacattaagtgcaataaatgtagatcacgctcctaaataagctgagatttatccccggatcctctccgcaggggccagctccataaatcctgcgcgaccctgtcccctggccaagggatgggggaggggaggccagagtggggaggggcgaggtgtagcagggcagttccaggtacagaaggatggagctgagcaggggctgcaacaggggccaagaaagggggcaacagtgggcccaggcggcctgcccctgacctcccgctcacttgcccaagctccttaccccagccctctcctagccccgcccccctcgcatccttcccctccttcctgccccctcccccgcccccaccccgcccccaccctctctcctggcccctgcctgcctataatctcgttcttgacattaaaacaatataatgactccactgctggaaaagacaagcatctgtagcttctaaatgggcagctcagccacagctgaaattgcctttgtctgtgggatgcgagggccctctgcgaagaaaaatgtattgtaggaaaatgcaaatttacaggccaataaattagggggtgattagtcacgttgcaatccttcttcaaaggattctttaaaagctaaactcgttcatttaggtgtctgtttatagctcagtaacttccagacagagaggctgggaggccccacgggacacagccagggaaactgggaagatgcagagaaaaagggagaagtcttccgcgcttaaccagcttgcggctaaaacatcccaaaagggtcctcccatcacctggctcgtgtcgattcaaaacgggttcgtccagcatctactacaggccacgtgctgcctccaacacgggggaagcggccagacaggaaccccgggctctcatggcgtttacagggtgttggggggccgggaggtggggaacagggagagtcacattcattcgattctcactggctccaggttgacaggatgtgatttacaggcggctgtctctgaacacactcatggccaaatgtcagggacggtccatatgcacgacggcggaaggaggggtgaataatcaaagatgggatttgaaaaagggcaaaacaagcataaatgccatggcttctccagcttttcccaaaggacaaacacaaagttcggccttcactgaatcagtgtcctggagtcccctgttctgtgtcctggatgaaatcccgtagccactcagcacttaacgccatttactgcaggcagacagggagagaccagcttgcgccccggccactgggatcgtgaaggaatctcttctgagggtgaagtaagctcggctgggtcggcactactcgccctccttgaagccacctggacctgacgctcttgcccagactcttcctgcctcctgtctctgttcttcccccttctctgcctcgcaaactcctcttcatcctgcaggacacaacttctgtcaaggagttattgcattatattatcatttatccattaatgccgactgcccctgggattatatgcaccttgaggttagacttaagatgtgttggcacaattattagagtcaatcgcagtgcctggcacattaggtgctgctccagatttgtttgcagaatgaatggcttgaagtaactggacgtataaatgatcacagcatcaccgtcatcagtcactgtgcaccaagcacctcacctccatcatctcatgtaatctttacaccaaccctgcaagggagggttttaaaatcactgtcttacaagaggaaaaactgagcctggaaaggttgaaggcttgctcaaggcggaagagctggtgaatgataggaccaggtccaaaagatgttttctttcactggcatcggttctgcctcccagggcagactgtgtggcactcatctatgtacacccctcctcccaggacccagcataatatgtgcacaaaatcaaatgactgaatgagcgaatgaataaatgaatatgtaaccactgtcattttcacatcaaccacgactgagctaaattccagggccaccgtgccaagccatattggaacccaagcaaaaggaaaaatgtgcgcctgtgtatatgtattttaggtggtttttcaataatttttttctagaacattaaggaaaggaatattgaagaataaaaagcaagactactaaaaatcacaacattattttttaagtttcgatattttatttatagcaaaatcacaatgtattataattttgcctgcctgtctttgctgaaaataaactcatcaataacaatcaaaatgtaaagtcagtctacttatttgtacttatttgcttctctttttttttcttttctctttctttcttttttcttttttttttctgtcacccaggctggagtacagtggtgtgatcttggctcactgcagctgcgacctcccaggctcaagcgatcctcctgactcggcctccctagtagccgggactataggcaggtgccaccacacttggctaaattttttttggatattttgtagagacagggtttcaccatgttgcccaggctggtctcgaactcctgggctgaagcgatcctcctgtcatggcctcccaaagtgctgggattgcaggcgtgagccaccacacttggccatgcttatttttctttctcaattgagagttgtaagttacaacaaatgagagaaaactttgaaagtatgtttgatgaatgtaaaactttagaaaaagatatgaatatactctctagatacttaagcttaaaatactattgtgagttttaataacccactttttaatgttttaataacttttcagcttctttaacattctgggaagcatatttttgaaaaatgcgtaaaatcatgtgtataggggcacgcggttttcctcaggcttcgacatagccgtgtggtggacactgtcaaatcttatttttatttaaaattttgatatttgattcatcatggattttcttttggcgttaactttgatttttaaataaagtattgcattgaaatagtatttatcttaattactgagctttttggcaccctctcaaattttgtgccccaggcaagtgtctcatgggtctcacccaatctcagcccaagtaaattctaaaagaggaaggtattgtgaatggaactgctcctgtcctactggctgggatccagactgatacagcttctctgcagggcagactggtgatatccatccaaaaacattaaaatattcatttcctatggcctaccacaatgccacctccggagatttatctaaagaagtcttttgatacgggcgaagtttgttttttgtacaaagatgttcatttcagtgttatttatcacggcatgatgttggaaataacctggctgccccaaaacagaggattcattttttaaaacgctgttgatcaatgtgcttaaaaaaaagtacagctgttttgaatcatggtttttcagaataaaacttttgaagaatatttaatgacatgggaaaatattcatgatgccttttatggaaatgcaagataaaagctataaatttcacattctttcgttttaaaatgcatatttgttttgaaaaaactaaatacataaaaatgttaatagtaattgtcccagggtgatgggatgatgagtcaatttttaaatctttcttctactttttttgtatatgtcttctttctactgttttttatattccaaggagtttatggttttttttcttatttttttctttttctgtgtttttttttgttttgctattttttttattatttatttttttatttgagtcacagtctcgctctgtcacccagactggagtgcagtggcacaatcttggctcactgtaacctccacttcccgagttcaagcgattcttgaacctcagcctccccagtagctgggattacaggtgtgcgccaccacacccagctaatttttgtattttttgtaaagatgggggttcaccatgttggccaggctgatcttgaactcctgacctcaagtgatcctcccaccttggcctcccaaagtgctggaattacaagcgtgagcccccaccccctgcctatttttttgttgttgttgtttcagagacagggtcttgctatgttgcccaggctggtctcaaattcctcccctcaagcaatcttcttgcttcagcctcctaaaggctgcaggattacaggtgtgagccactgcacctggcttgtattcattttataactgggaattaaaggtgaattttttttttttttttgagagatggagtctcgctctcttgcccggctggagtagagtggtacaatcttgcctcactgcaacctctgcctcccgggttcaagtgattctcctgcctcagtttcccaagtagctgggactacaggtgtgcaccaccatgcccagctaatttttgtatttttttttagtagagagagggtttcactatatgttggccaggatggtctcgaactcctgacctcaagtgatccgcctgccttggcctcccaaagtgctgggattccaggtgtgagccaccgtgcctggcctaaaggtgatatttttaagttagttcaccctttgagtctatacttcagacaggcctaggaagactggaaacatgtctgctttgtcccctattgcatttccagaactcatactaggacctggcagatagtaggtgctcaataaacatttgtttaataactgcttttttttttttttaaataggatttcactctgttgcccagactggagtgcaatgatgtaatcataactcgctgctatgccttgaactcctatgctcaagaaattctcccacctcagcctcccaagtataatagctgggactacaagtgcacaccactgtgcccagctaacttttaaattttatgtagagctggggtctcactttactgtccaggctggtcttgaacacctggcttcaagtgatcctcctaccttggcctcccaaaatgctgggatcacaggcatgagccaccgcacctggctgaataactgcttattaataaatggctcaaacactcctcagattaatcagtactcttttggctgcaagagacagaaacataacttggtttataagagaaagggaaagtgttgccttgctggtgaagctcacagctttaaaaggctggctttggggatcagggccatctgcatcttaatctcttactcctgcttggttccccagtttcagcagggaagatgggccggatagctcctgagccgcctcctcccacctcctctacaaagtcatggaatcaggggagatgaatcccaaagggatagattctgggtacaggcccctccagtctcacttaccctctagtcagctctgtatccatgactaatggaatgcaaaacttaagtgtagtcaaatacagcatccttaacagaaatttttttttggctgggcgcagtggctcttgcctgtaatcccatcactttgggaggccaaggcaggcggatcacttgagggcaggagttcaagatcagcctggccaacagggtgaaacctcgtctctactaaaaatacaaaaattagccgggcatggtggcaggcgcctgtaatcccagctactcgggaggctgagacatgagaatcacttgagattgtgccactccactccagcctgggtgacaaagggagattctgtctcaaaaaaaaaaaaaaaattttttttgcatgccttatacccatagggtagaacttataaaacttgtaacatttaaagtttcagtaatgtaaacataaggggttcagaagttaagagtcagacagttcccaggataattagatagcaatggtcactggacaaagaggttcccgaaggtttctgcttcgggtgaactgacatctcccctccttcaatgcatgcacctcaacctattggtcagagccattagacattgacatttcccattcctaaagctccctgtgacgtaggccagaggcacctgcttgctggagggcagtttcaggatgtcaggcgcaagcaagctattgagttcccaaggttaccagacttctgtacctgggggattcagtgtgtgggtgacactcttaggctatcaccaccaaggacactgttcatatcctttgacggttctgctgcaagagcagaatttagttcagagaaggataactcattgtgccaggctctcagtggatgacttcatatatataaccctcaaaacaaggcaaaaataaaacaggtaaggcaataatgataatgatcccatgttacaagtgagcaaatggaggctcaaaatataaaggtcacacagctaccaaacggcagagctgggctccaaacctggctgtgctgtctccaagtcccgtcatctttccactccccaagtgcgtcccatgggtcatgagagccaccaggtaatatgccaaaaaagaacttcttgggtgaattgttttgggaaatgctgcaaactatttctccctcttggaaagtcacaatattcattagcacctaaaggctctgaaaaatcctccatgaaagaagctggattgatattgtttaatgtagcgtatcagtctgttctcacactgccataaagatactacctgagactgggtaatttataaaggaaagaagtttaattgactcatagctctgcatggctggggagacttcaggcaacttacaatcatggtggaaggcaaaggagaagcaagtaccttcttcacaaggtggcaggagagagagagcatgtaggggaaactgccgcttttaaaccatcagatctcatgagaactccctcactatcaggagaacagcatgggggaaaccaccccccttatccaatcacctctcacctcccaccagatccctccctcgacatgtggtgattacaattcgagatgagatttgggtggggacacagagtcaaaccatatcatccattttgcctgaacgtatttgaccacgtaattctttttccttcccatgacaactatatcttataggatatactgtgggaatcactgtgttcattcattagaacaacagctttcaagtgtttgcctagcaagtgaaaatctgtgggaggtgtatcccagctaattctacagaaagtcactgagactcagaaggaattgagttatcatgattctcacccacatacttttggacagctttttgggtgcaggagaaagctgtggaattacagctttagccctgggctttgctcaggactcacagcctatctgtgccttgtcatggaaacagtactggcatcatgacctgcgtggacacaactataatgcttatgggttttgatgggtttataggcattactgttttgttttccatttgaatcaaggataacctttgtagcacaggtgcaagggacatcgcttgctatgtcttccccgggttcccatcccgcatggttccagtggatcaatcaatggcagggctccctgctatgtctgttgttttgccatgggtctcaccctcatagttcttggcccaaggactgggcagctgatccaaacacagccaattggattccttccacgaggtcagatgtatggactgtgggagaaaacaacttactggatcataagcaatgtagagtttggcagagacttggcatagtttctttctcaccttgtgaggtaaaggttgtctgagatttaagctaacatacagaaggaagcagagctgaaaactacagagagaggactgaagaaagatggccagagtcttggaaacatcacttgagtccctggatccagccatgcctgaaactgtcgtaccgtcagtattctacttatatgaaccaatgccttcccctttttgcttaagctcattacagtcatgtttctagtcattagcaactaaaacagtaatgatgtatttagaaattggtaccccaaaatgatatattatagatgacaacctaaaatgtggaatgagctgagttgaggggagatgcaggcctgggagggttccccagtccttgctggggaattgaaaattcttgttaggtaataggaggcacttggctaaactatactagttgtatactgagactctgattttgtgcctcaagggctaaagccttagggaatttggtagaaaaacgtaaggatgttggactgtgttggctcctttttgtagccctcaataagattcttcaagagaaagagaaaagtttcaggtccagccagcccatgtgaaagcagaggaggttgttgacgccgtttctgctgtgatggccctggtggggcaggcttagtatgtagtcctcctgagcccagagggaagagtcgatgtcacagatgctcagggggccagggttcttcctgggagttgggagaggcagaccccccagaacacagtccagatagagggcagcattgtcacggtcctctgtccaaaaccaggagaggaaagcagttaaaataggggacatggtttggatgctggtcttctccaaatctcagattgaaaggcaatccccagtgttggaggtggggcctgggggaggtgactggatcatgggggtggatccctcatgaatggcttagcgccatccccttggtgatgagtgaattcttgcgcagtgagttcacgggagatctcattgtttaaaaagagcatggtacctcccctcactcttgctccatctcttgtcatgtaatacactgattcccccttttaccttccaccatgattggaagctccctgaggcctcatcagaaaccaaggagatgctggtaccatgcttcctggacagtctgcagagccaattcaacctcttttctttataaattacccagtctcaggtattcctgtatagcaacacaatgacggactaatacagatagagactaggggagaagggtcattcagttactcattcgacaaatctttattgtaagtccgtatgtgccaggcactgtcctagacagtgagtatgcaatgtcctaggcagggagacaggcaagcgtcctgcactcagagtgctgagtctgtagctgggacacaggaagtaagcaggtggaaaaaatcaacagaatacttgccaacagtgcaaagtgctacaaagaaattcagctggctgatatgacaaagagggacttggaggacttgtgaactaagattctccaagatgagaaagaaccagtccagtctgggggcaaagcatccaaattaaacagtaaaggcaagggacctgagggtagaaccagctgggtgaatttaaagaacaataaaaaggggtcaatgtaaaggagtcaggagttagcaagtgaggaagagaatgatgagaaattcagtacaagaggtaaagaaagcacagatcactctgaaccttctagacaacggtcaggtttgggtgttattccaagtacaacgaatagctccagaaggatttcagagggatggtgacctaatgtgagttatgtttttaaaagattgggctgggcacggtggctcactgctgtaatcccagccctttgggaggccaagggggggcggatcacctgaggtcaggagtttaaaaccggcctggccaacatggcgaaaacctgtctctactaaaaatacaaaaattagccaggcgtggtggcgggtgcctgtaatcccagctactcagaaggctgaggcacaagaaccacttgagctcgggaggcagaggttgcagtgagccgagctcaagccactgcactccagcctgggcaacagagcaagactctgtcttgaaagaaaagaaagagagagagaggagagagagagaaagagagagagaggaaggaaggaaggaaggaaggagaaagaaaggaaggaaggaaggaatgaaggaaggaaggaaggaaggaaagaaggaaggaaggaatgaaggaaggaaggaaggaaagaaggaaggaaggaaggaaggaaggaaggaaggaagattggattggtggttggttgtagaatggctggtggaggccaaagtgaaaccaggagatgggctgggcagagggtgtggggttggtgcaggcaacaggcagtggtggcagggactaagatgaagaagtgtgcgtggtgacaacttgtcataatggaatgccccacgaaggcagagctgacagtgtttccaatgggtaggatgtgggatgtgacgagcggggaatgagagatgactcatgtggtggatggtattggggtccccgcagatctcttttgctgctgggcaccccgccacctgggtggatggtgatgtcatttgagagggggaagattttgggaggaaagttttagctagaaaataaagagtttgcttttggatgtgttaaggttgagatgcttgctaaaaggtgtcaagaagctatttggaatggaaaagtgagcaggctgtatttagcatccgtcctgaccctgtgatatcactagagggatggttgaaggcaaggagccgctgagagcaggtggggagcttggaaggagcaggagcttaggtagacaacggaccaaagaatgtgattggccttcgggggaggaagttctgcccttggcacaaaccaattgcagtgaggactaagaatgattcctgccctcttctgcgaggctgtttctccatctccttctctgttttaacaaaaatcaggaggctggagaagctgactcccacctgctgagctagtggagagacggtcaggacagctcagatggactcttcctcccagcacatcaccagcagggagaagagaaactgagttgttctccaaggacccagacacctctgccagatattcatccctgaatgaatgagttctgagaagggcagccatcaccctctccaccatttgggatgacgaaggggctgtacggaggtcaggcggcagcctaggggttgggacacttgattctagtccctccatcttgctgtgtaacctcagacaattcattttctgcctttaggcagaaaatgcttgattttcttaatttcttaaaattcttacagtttctctacctgtgagaactggagggactcttctaggtctgatgtctcccccagacccgtcttttccttcagaacctctttcccccaatcctgacttgattcccatgcagtttggcttggtttttctcctggctgcccgagttagtatttctatatgccaattcacactaaagtgttaacgactaacaaaagatgggtttatatttaaatatatacctggaacttgttcagtaactgtatattgagcaccattcaatggtttaagacttatgccaggtgctatttataaaaggttccaagagaaggaaagtaaagccttagcctcctatcctggaactctggcaagagagatctcgttaggtccccaatgtgatctgggcttcccagctattctctctagaccttcctattacaatgcagataccttttctctgtatttgcagagaaggaagtagggggagtgagattaaaatccaggattccagcttgggtaacatggtgaaaccccatctctacaaaaaaaaaaaaaaaaaaattagctgggcgtggtggctcacgcctgtagtctcagctacttgggaggctgaagcatgggaatcccttgagcccaggaggtggaggttgcagtgagctgagattgcgccactgcactccagcctgggcaacagagtgaggctttgtttcaaaaaacaaaaacaaacaaacaaacaaacaaaaacaggattggccaggtccaaagcctaagtgctttcctctgtgccaatgaccatccattcagtctttgcttgttccccccacatcccttggaggaaacatggcctgcttctggtcatgccatctgtgatgaggcgctcacttccaatgtggtcttgtttgtggttcaaggaatctcacagctcaaagggatccaaatgtttttcctgtccaaaggtttctaccctgactctgttcaggtgaaaaataccagggccccgccttcatcctggaataagctgattcagtagttctggagtaggcctgggaatctgtattttaaggatgactcttcaggcaggcagatttggaaatcactggaaatgtgcaccttttcctggatcctgaaccaatcctgcaatgagaccttggcttggggttgagtagacctgaatctgactctgccacatacgagctgtgtggccttgggcaaatcacttcatttctctgagcctgttttctcgtctgaacaacgcagataagaacacctgcccataggaaagaggggaaaactgaatgagaactatgtacagtgcatgtcctaagcaggcactcagcaagttgtcactgtcaccaatgctattgttgctgcagacatgtggccatctgtccgaagaacacaagcccctcctgcctcccacatctaggccagtctctccctagtgctcaggacatttatactgtcaatcctggcacaggcctcctcccagcttccagcatcagcagtgaaccccctaccctcttgccaatgcctctagaatactcacttcttccacggggcctcccaggactgacctcaccccagggcctatcagctgagccctcaaagcatttctcccactatctcagctccccacacccagtggtgcctgggtggggctggacagggggtcaggcccttgtgtctgcagcccaggcagcccagggaatggtcgctaactcagggacagggtcaggagcacatggagttggccatctgtgttgttctcttctgtgaatggtgactggctgttaagaggcatcagtgaagtcatgggcagaaagcactcggtcagcgggaagcattgccttcgaggttgctttccttgtcagttccttccaggagcctggtgtctcctgaggctaaggcaacagaaagggccttttcaacatcatttgaagtgaggaagaacagacactctttcagcatggtacagtagaagaggctacttctcccagggcaaaagatgctatctgcacctggctggctgctgtgaatactccagccaaatcccagaccaccatgaaggcctccccagccacactccaggccccatcgtctgaggatcagaatccacaggaaagagcggacagggtagataaagaagagctgaaagggcagggctgggggagatgtcaggaagcgaaggagttcagacaaccaagaggagaagtcaggaggcagagagcccagccgggctgtcctccaggacctggagctgctgctgtgccatcgctgtggacctgtggacaaggagccaactggggaagcagcactgaaactaccacacctgggcgacttgggccacctgctcctatgtgtgctcaacctggtgactgcaaggccgttgcgaagcagcccctctccccctgtcttctacaataatggaatcatcataataattgctaacacacagggcacttgctgtttgtcgggcatggtccagggatcatccacattaactcatttacccctcaccacaatcccaagaggtagaggtagttcatgtctagatgaggaaactaaggcacagagaggttaagtagcttgcccacagtcacacagctactaagtagcagaactgagatagtctcagagcagtgccaggctcgcatcctctccctgcctccacctctcttctctttatcaccccaatgtttccacatgtccctccccatttcttcattccttggcctgccctctggcctgcaaagagcggcaatttcactctacttaatccccggccaggcttgtcacccagaggccagtgtttaagctctgacgcagcccacatcctcactgccagacctgactcctgtctgtctctccagctcagccttgcctcaccccctaccctgagcgcctggctgcttcttgctgcccccttagcctggaatgtccctgccgcacctacttggagggcacttgatcttctttcaatgattgaagcaagcagttgtgttttcagagaagcaaaaagctgggaacttcttaaatgtccagcaatagagatttattgagcaaatgagggaaattcatcatacattggaatagggaaattcatcatacattcagcagccatcaacaaagatactgtagaaaagtaagctcctgagatgtgccggtcattgcgctaggtaccctgtctatatacatcaccttgcttcatttaatcctcaaggttgctctgattattcaaagaagagtaagtgtcgtccaagcaagtggggcaggggcattccaggctaagggagaagctgccaggtacttaggaaaatggccgctggttggagtggggtgaggcaaggctgagctggagagctggtcctgcagggggctctggcctgccctttgatagaggcctcacttttctctcctcatacagatacaggaagtgaggctcagagaagatggtaactacctgatccaagtggttggaccgattttgacccaggacttcactgttcatgcttggagccgccaagctatgcttacaacatggaaaaatgttcatggcacattgtattgcatgaacatcaaagcaagttgccaaataatatagctgcgtgatcccaatttgattcgcaaaaatgcacgcccccccacacacagaaaaaaatatcaccatctcaactctatttctgaatggtggtgggattggagttcagttttactctactccttctgttcatctgcttttcttcattttgcacagtgagtaggcatcactaataggagacagtccttaccacccaccactacctgctctaaacagactccaggcccaagttcatgcaacttttccgccctcaggaacttttctgcctgcccaggtagccctgtcccatgtgccccacccacctgtgcctccgcagacctgggttctcccgtccatcagagccctgtgatgtttcaggacactcactgctggtggcctctttccgtggcattggactatggcttctcccaaagacgccccttcccccatgcctgcctttcctgtctgacatggtttggctgtgttcccaaccaaatctcatcttgaactgtagtttgcatcatccccacatgtcatgggagggaccccctgggaggtaattgaatcatgggggcggttacctccatgctgttctcgtggtagtgagcgagttctcacgagatttgatggctttataaggggctttcgccggcttcgctctgcacatctccttgctgccaccaagtgaaggaagtgtttgcttccctttccgccatgattgtaagtttcctgaggcctccccagccctgcggaactgtgattcaattaaacctctttcctttataaattacccagtctcagatatatccttatagcataagaacagactaatacacccgtctcagtctctccagagccccagcatgaagggtggtctgtggtaggcaccccatgtgtgtttttgaagtgactcacggagtgattgcctggctaaaggaagagagagcgggtggttctaaggccagctccaagcaggagtcctggttcgttcattgctgagggttgtccaagcagcattcccagagcaggagacgccttgtccacatgaaaatgtctgatttggctgccactggaggatgacctgataccccatgtgttcaaaggaagcatttactggaaccccaagcagccaggaggctccccatgcagaggggaaaaccaagcccagagcttgccttggagtcaacatctcaccctgcacaagactttcacaaatgcacatgtacacagagatgtgtacacatcctcaccaacagaggcacacacacagcatgggcataaacacagtgatgtgcagacacacaaatatacgcataaaggccatgtacacactcaggcaggtacatactggcatgtgtacacaatagacaggtgtgcacattttctgcgtgcacacataaatgtgtacacgcagaaaatgtgtatgcacagacatacaaacacatacatgtgcacaaagacatatatgtgtgcagaaaactgtgtgtaggcagatacgtgagcactcacggaaatggcacccatagacaggtgtacacagacggacatgtgactacacatgcacaaacacatccctccagagagatgtgtgcacactcccgtcgtcatccatgttgcagaaagggagctgcaaggcctgggaaaccagacagctgggctctgaccccgatgctgctgctcatttgcagcatgaccttaagcaagatactttccaggatgcgtctcgagttcccaaatgtttaaatatagtcatttccaattaactgagtaaacacctgaaaatcaaggggctggatgaaccttcacattttagatcaggaaggttcctccgtggtcttattcaaaccccactctcttttttttttggagatggagtctcgctcttgtcaccctggctggagtgcagtggcactatcccggctcagctgccaaaagtgctgggattacaggcgtgagccactgcacccagcccaaacccctcattttgaaaagtaggaaacaggtgaagtgacttttacaaggtccctcagagagtccatggcagattagaattagaattcgggtctcctgccctgggcaggacttgatctcattctctccaccgtttagggagtgatcgaatgttactcatgctgaggttctttacgcctattaataccacaactccccttaatgaattcaatactgtagacaaaatatccacattctgctggggttgtggagaaaaggacctcaggagagttgcttgaaccaaacacagctgggattgtagttctaactccaaatgccaggctgctgtgcccactgaagtgggcagagttgagaggtttgggtcaaccaaatctgaatgcaaagctgccctcctaacctatcctggcaataggcatcaagtgcttagtattttgcacactctttgacaaaacaattcctctctaaggaattttttgggaaataactgaggatgtgagaaaagatttatctacaagaatgttcatcccagtgtcattgacaacagctaaaatatagatccaatttaaatatcccaaactggggacaaatccatctattggagataaatgatccccacactcagaatatcatggaattttttacaattatttccccccaaagaatacttaattgcatgcagaaatggctatggcatcttattaagtgaaaagaacctgttatgaagcacttctagaagaggcactctagtatggagatgagaggcattagaattaaatggaactggagtgaaaaaatttatcagcattctagctgattatttttggatgggggtgggttcggaaatcatttttagtctcttctgttgatctactattcttcaatttgtacagtgtgcatacattatttatttaagacaatgctcacgtgagtacctctctgcatgctttaaaagttattcctctttgcagcttttcctgccttctctgcccagccaagtaactgtgcccacctgccccctgccacctgtgggacttctaccacttagcagctgtttgaccccaggcaagctcttaaccactttgagccatggtttccccatctagaaaagacacatgatcatagtacatacataataaagctatcggaaggattaaaggatattatgcatttaatttgcttagtgcagagcccagcatattgttaagagctgtaatgcattgttacatatatatgtaatatgcatacacacacatatgtaaactgataggagatacacaaagtattagaagtgcatctctagaagtttttgttttcttatttgtttggaaatcaggggagacaaaagttatttagaaaggaagctactgacctccaataccgctgtgtgggatacagcaggatgctggcagcccaggagctggtcctcatgtgcctcgtccagggctccttcctctgggccatgtgtgggagggtggatgctgagggagttggcatccaaggatgctcactgtggatcatcagaagagcccagaggttggccgggtacggtggctcacacctgtaatcccagcactttgggaggc

SEQ ID NO: 401 - DNA, 20001 bp, Homo sapiens
tcctttcatttcacttgtatctctgtacttcaacagcctcccaacaaggattctttcctagaggccacctgaaatgcccttgtccaccgtccttgcctgggtaactcatactgtccggtaagacaaagcacagacatcccctcccccaggagccttccatgaccttccacccaaaaccaaggaagaggccttcttctggagcacaggggcttacctctggccatattctccatggaactgtgagtcattttggaagggaaatgcatcgacatcacataggggccatgagtgactgaaagaacatattattaaaatctgtgatgaattccttgctttctaggacacaggagagttgctttgtctcttcaacagcattctaagaaaagatgaaaaatacaaagaggaagagaattgaaaggaggagatgaaaaaggaggagaaaaagaaggatgagtctccccaccctacacctactctcccagatgccccaaatgactttttctcttcagatatacacctgggtattccaagtccttccactctcaggcctctgtctactgccaggacctcaatggggctcatggtgatgtcacattaacctctgagaaccagtctcaaaggtcaaaaatgcttcctgatctccccagcttaccttttaaaaacttttcaggtatcaagcatccaaaacctatataaacatttgagacatttttgattttagccaaatattcttcttaggaaatgacttaaacctaccccttcaagttaagagattgaacataacttttttttatactttaagttttagggtacatgtgcacaacgtgcaggttagttacatatgtatacatgtgccatgttggtgtgctgcacccagtaactcgtcatttaacattaggtatatctccaaatgctatccctcccctctcctcccaccccacaacaggcccctgtgtgtgagaacataactttaaattaaggagaaaggaagggaacatcatcatatttaaagacccttgaatttggtcaacttcagcaaacacagaaccaccattttaaggaaatgggggcttctttcaaagtaaatcttttcccattttcaattaaatgagattttcctctactcccagctctcccacatccaccttctgtattccttcattaatacatttaccccatcaataatcatttgtcttccatcatcttccacttactatacctatggcatagtacctatcctctaggaacttataacccaggaaaaaataagatctatatataaatatctggaaagtcctaatttcaatagtaaatgtcatatgaataatataaataatagataccatgggagtgcataaagaggtggattcatttctggtttagagtaatcaggaaaggctctcagagggtggtagacatgagtaaagctttgcagaatgcttaggattcccacaggcacagggagaacacaccaggtaaaaactaacagcccaaactagaaagtagaggtagagaaaactgggtgtgtttgctttgaaacttttcctttcatcccctgacttttattgacttgagttctaagaaaacgttttccagaaggcaaagagacaagttaactttgttccagcctgttctcctggtcactatgaaaactctgtgagtaactccactttcataagggtgtcataaatcaaggttgagaagatgaagattgtctgccttctccttcctctctcttccccttcaccccacttcacaacccaagagtaacaaatgaaccgcaatttccctcaagaccatcacgcaggaaaatcactctcttcagcaggctgaaagccctttgttcgcttggaaccacaggacgagccttcatccttgcatctgaagggtgactttctaggcttgatgaagaagtgtctgcaacaggccatacaagcccttgacccagagaggccccaggccttaggcataaaatcttcccattggtgaagatgagatgagcaaggtggatcttatctctcaccacatcctgtaccagtttgggcagacaaggaatcctggttgaacagactgagataacactttatgaacattcttttcctgctgcctctgatgagagagatctgagagaagcccctccctgctgaggtctggtgaggacccacaggccaaaatgcagtctgattaacaggcatcccaagcagtgactcaaaccatcggcaatttcagaggaagcttgttatggtgactccacaattaataccacagcccatgtgaccagtcagtcccgcgggaggctggactaagcaacatataaaagtcccaccttgctgggcttcacagtccacagcctttgttgagtcttgttgaagatcaggtaagtggggcatctgtgccctctctctccctgttactctgtctttaggcggccgctgttctgttcctcttatggactgtactttctactgattttttaagtggtttgccatttcttgggcctcacaaactatcctgtatattctatccagactagaatttgcctatctagtctagtctcttgcacctgattttcaaaaggattcgtagactagaagagaagggaaaaaaacctgtggtaagactggggtttggagctatggatgtctagacagaggccaggagaacactcccactttggagacaggtgccacagggagctgcagccaggatagaaaagagaaagagataaaaagcagccaagaaattagttcttacttccactcctcattccattccattagttcttccatccactcctcattcctctttctcaacccttcattccccagttcccatgctgatatttttaatacagataatttcgaatcttgtgtttttttcaggctctgcaaatcaccctaggatgtccttcagtgagcagcagtgcaagcagccatgtgtgccccctccatgcctcccaaagacccaggagcagtgccaagcaaaggctgaggaggtgtgcctccccacatgccagcacccctgccaagataagtgtctagtgcaggcccaggaggtatgtctttctcagtgccaggaatcaagtcaagaaaaatgcccacagcaaggccaagagccatacctacctccatgccaagaccagtgtccacctcagtgtgcagagccatgccaggagctattccagacaaaatgtgtggaggtttgcccacagaaagtccaggagaagtgctcatcccctggcaagggaaagtagctgctcatatgtcatctgggttcaagaagatggccagcagatgaaaccctgaccccagcccacgctctggtgaccttcttctgtgggtacctctgtgtgcaatgtaccttcttgcctcctggcttccttagcattccaggacttggtctgtgtctctgaagacagttctttctgtatttcatcaccctctgtgaataagcattgttctcagcagtctgatggaaggtctcaaatgtaggaatggtgtggttgtcagggaagaccacagaagcctagcacagcttccttggtgcaaaaattcacccagctctgggtgtgtaacagccaaggataccttcattcatctttcagagtttcaggctctcaaataagcctcaaaacaaactgaattctgatggactttccacttatcaccaccaccaccacctccaccaccaccaccaccacaggtgttgagacaaagcggcttgcggtgtttcaaaaatcaaaaatttggtgattttgtctctgtacactaaaaagaacagcaaattattgaactttgaaatgttggttgtgcttttttaaaatgaaccgaaagtatgtaaacgattgaatccaaacaaccagaagggaaagataagatggatgtttggtgcccttgtcaatctctgtgcttcatagctggtctaatgtgggcccttagttctcaccatgtacactctttagagatgtgatttgtgtctgtgtgatgcaggctggtctgttctccagcttccttgccttcttctccctggtgaaggtaaaatacataataaagctgatcctaaggctgatatctgacttgacgtgtgctctcttttctccaccatcaaacccctcattgtccttgtgacaactgtcttctcctttggtgggggaggggagtaatctgaaacaggaataaaacacagacctcaccggtgcataaaacagcagttctgaaagaggcttcctgaaggtcactgagaccaccccacccacaacatatcctaggttcacccacttgtgcacttcacacatgagaaaatccagcaaggggctaggacctgcccacactcaaaacctcaggtccaggttctttctactacagcatctttcctctctgatccttgctttccaaagggaaaggctgaaatggaaaggaggggagatgtgtggaagagggatcccaaatcaattcataacacctacaaacatagcatctgtgtcaaaggagagagcaaagcatgcctctgagattaatgcagactcgaggaccaaaactgtctgccctgccatctggccaggtttcaggtaggcctggggcctgggtaaccggcctgctgccccccacccatggaggaaacacaggcagtggccactggggtttgtgaacgggtggagagggcactgtactgacatgaaataaccacaggctgctccctcggcagtgccccgagctccgacctgagcccaaaggaagctatgccaaggaccagcttcctaggggggatgtagcttcttacccattctacaggtgccccctcccttctcaatcctcatgaggaagaggtggagggccgggacagcccctccttgtagggcgtgtagagctctatgtctcagtcatttggctaaactgagggtcactgagtctgtgggtgacatggaccaggccctgaactccatgcacattctctatggggattctaacagcagccttggggagttcctgtgctgcccatttgcttaggaacttgtcctaaagccagtaagtggtgaagtcaggatgctaacccaagtccctctgactccagaatggagctctcacttttgtaatgaaagtgctatggcatacagaagagatttccagaaactcattcattcatttatccacctaaaacatgctccctgatacctaccaggtgtcaggcaccatgccaggtactggagagacagtggtgaaccaggcagtcagtatccctgtgcagagttacgagctgtctcttctgcaggccacatgcaccaaggatacctttctgaaaacctcctggatatctcaagtccctgaacatctccagatgcctgaatcacagttctcttgcctccttgcctagtcgaaataggttttctcatccattttccaaccttggaataaaccagctgctccccagggccagcagctcccagagctccatcctgcggagatgtgccagagaggccttcctatcagtgaagcttctgttcacagactcttctccagcttggctcaagtccaagaaacatctttgttctccagcatcaaaggcatgcacagattggagtccaagatcagacacccaggcattaaaggaagcacgaggctaatgaacagggagagtccagacttatcagagagaggggaaatctgctgattacaggggaggcctctacggttaggaaggggacaagtctgcagattgcagataggagagcaaacgccaagcagccagcaggccttcatctagctctgtcataggaacctccacacctcctcatcctcacagaggtctgccccagccactgcctgggccactgctgctgcagcctggtctcttaagacacagaccaggtccacagccacagaggccacagggacagctaggacacagcattcagacttccccagctgccgcttctgtgctgagcctttcaggaagtagggaggggccttaccaaggaaagccctggatgttaggggttctagctaacagttaactcaacatgagacaatagtggatctgtgggccccatatgccaagaggaaaaaatacaaacagacaggaattcacaggaggagctgtggattcactcaatcactcaaaatatttatggagaaactactatgccaagccagactctggaaacctgcgacagtgccaggaggtgggcaagcagagcagtggcctgaaagactttcacatcaggaagagttgaaaaatatttagtctacaaaagaaaatacccaagggagtgggacagctgaactcaaatattttaagtgcttttatgagggaggagtgagatttttgtgaagtgccaaagaacaaagttaggacccatgggcagaaatcatgaaattgggctcagtttaagaactttcttataatgagatctattggactgcgacaggagctgcctttagatgcactgtgtcccatgaactggaggtttgcaagccagtagatgacaaccagctcctcccaatccatcaaatactgtgactcctctaactgtaacttgtacgtggaaatgggacccaggggcagggagcctcccacgaagggagattcagaagacctgaccgcaagctcaggagacaggaagtttccctggcttccagaacactgctgggaggctcttcggggggcccaaacttctggggaccagcagaatgtgtgaccatggcttgaaactaaaagaaaggaggaagacaggtaagtcatgggaagaggctcccccagatttggggttttcttaatgtttttggacccacaaatgcttcagccctgagaagcaccctacagtaattcctcactgctttctaatctcgttcttcccagctgggtttagtgtgctcgctcccttttacatctcatttatttaccatccagataccctttctcttctgtaccaaagtgatccgcctgttcttccacctgacaacccatcgcagattcctttctgccttcaccttcctctctcccacccaggactctcccctgtttgtctcagccaaaccaggggtttcaacctgacctccaggaagccctccatggtttcagcctagctcctaagtactgcagcttgggctctgtgctgcagtggccgcaggggtctgcagccctctaccagctgcctgtatttgaatgacacatgtctcctgtcagcatgagagcccagatgacagctcctggggctggctgtgttcttgcctgacttcacagggcccatcacagtgaggtctgagacacctgtacggctggccaccagcatgccccctgagcagagacaaagcggggtgctggcttctagaccacctggacaatctcttttattgatagggtaaccagctcatcttgatttgcctggaactgtcccaattttagcactgaaagttctgaatcctgggaactccctcagtccccgacaaactgggatggttggttgccctaagcacctgtgtgtataagacatgatgctttgttccaggtgggggagcacagagggaaagcagatgaggccctccatgctggaggaacttatagcccaagggatttttctggaaaactgtaaacccaggaggcctagttcccactgcctgccccctccatagccacattctccatgagcaggggtgggggcagcaggggctggtgaggggtgatcaaatactagatcaatgagcaggttcccagcctaggcctgtttcagcatgaactggcaggtcttgaccaggagaagtggtatcgtgggggccaccacccctattcgacagcagatctggacttgtccactcctgctctccttctctcctacggacacctgcctcacatctgaaaatggttgaaagaaaataagtggccagctggcagggccttctcaactcaacctccctcatcacccggttcccaagccagcctcataacctgtctttcctcctttagaagccgctggggaccgtttctcttctcttcccaacagcaccacctgctggccatagaggcacttggccttctactaatcacacccagtctggcctgagttggagatggccgcacacactccggccgtcagtgctccatgtggagaagacaagagtacagagatgcagcatctaacagagtcagaggaaggctatatgtgcaagacagagttacactatttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgagaaggaagacagacaaaaagcaactcagcaaatgcataaataagaaagtgaaaatgaagaaaatgaaacaaagtggtgaggagagaccagagaagaggggtgctctttagctcgggtagcgtggaaaggccgatctgagatggggatgtcggagtagcgacatgaacaataggaggagccatccatgtgggatcggggtaagtatcagcgcaaagagaacagcaggtacagggagtactgcaggtcagactgcccctggagccttaactcggatgctgcatttgaaggtagaccctggccaacttttagttcatccaaattaatgtgagaaaaagagcgaggtctctgggcaccttgtcacatgagctgtggctgaaggaagggggcgtttcatccagagatgaggagacttagagacacacagtggctgtcttcaggcctgtcaaatgtcaaagagagaggcagtggatatattctttgtgatcccaaggagaatagcatggatcagtgagttctgggcacagaaaagcagattctgctcatatcaggaataaaatggcccagcaaatgaaatgagctgctcatgaagtagtgatcccaccatccatgaaatatgcaagcagagaccaaataagtagctgagattataggaagtgtggatgcaatgcttttaatctttaattatcacctactcttgcacttgaattgcttataggttaccacaagattttgcttctctctgaatacagtaaaatagcctttgtcagccagtccctgaagggatgtccgccccagggttggggaacatcacagcaaggcaggagaaaactggctgttgggtacagaacacgcttcttgtcaaacccggagcagactctggcaaagatgaaaagcggaggtcctcacctccctttcatatgctccccttttctgtcccagcaccagaagatggaacttccttttccttacaatggtctaagaaaaaactagtctaagcaattagagaaaatatcctacaattcccaagtcctaaaagtttttatgttgcacatcctggtaataaaaatatttcagcctcaccaataaacatataaaaacggtgttcaacctctcattattcatcagagaaatgcaaatgaaaacctcaaagagataccacaacacaccgactggaggggataaaagtaagaagacagaatcacagtgtgggtgaggttgtgggagtgcaaattggtacaaccactttggaaaactctttgacggtcatgactaaagtagaatgtatacacagccaatgactgaacaattcctctcctaggcatctgccccgcatacggtcaccaaaactcaaacattagaatgttcattctagctctcatcaggcatccttgtgaaagtggcatcacctttaaaccctgcatggcaacccctgacacactgccaggctgcccagggaatacagggcaacctggaagtccaactacttccttcagatcatccaatttttcaatcattatctgaaatgtttcattgtagaagcagcaatgtgggctccaagtagatgcagcagatccacatgtccctctgagggaaagccatggtgccaatgggcaagaacaccatgatgtgcaaggccatccaagggcacctggaaaacaacccagctctggaaaaactgttgcctcatatccagggaaatgtgggctttgcgttcaccaaggaagacctcactaagttcagggacatgctgctgaatagtaaggtgccagctgccacccatgctggtgccattgccccatgtgaagtcactgtcccaggccagaacaccggtctggagcctaagaagacctcctttttccaggctttaagcatcaccactgaaatcctgagtgatgtgcagctgatcaagactggtgacaaagtgggagccagtgaagccacactgctgaacatgctgaatgaacatctctcccttctcctttgggatgattatccagcagctgtttgacagtagcagtatctacaaccctgaagtgcttgacatcacataggaaactgcattctcacctcctggagggtgtccgcaatgttgccagtgtttgcctgcagattggttacccaactgttgcatcagtacctcattctaccatcaatgggtacaagcaagtcctggctttgtctgtggaaactgattgcaccttcccacttgctgaaaaggtcaaggccttcttggccgatccatctgcctttgtggctgctgcccctggggccactgccaccactgctgctcctgctgcagctccagccaaggctgaagccaagaagagttggaggagttggatgagaatatgggatttggcctatttgactaatcaccaaaaggcaaccaactcagccagctttatttgcaaaacaaagaaatgaaggcttacttctttcaaaaaaaaatgtttattctagtgttattcataatatccaagtatcagaaagaatacaaatacccatcaatgaataaataaacggtggtatattcagacaatggaattccatacagcaatgtatacaaatgatctacagctacacacagcaataaggatgaatctcacaaacataaagtaagtggccaaaaaaaagacacataaaaaagcattaggatgaaacatatgaaattgccatttatggaggtcaaaaactgttcatagggttcaacataaaacacgctgtatagttccatttatatcatttatgtacagtacaaaagctggccaaataaatctctgttgtagacagtaagaacgtggttgtgtgtgtgttggttgtagtagcgtggtcattggatgggagaagaaggaaggtttctgtgttgctggtaacattctatttttttatctgggggctgcttatctggttgtgttcagtttgtgaaaattcattgaggtggacatttacaatatatgcacttttctgaatgcatattttaataaagagttgaaagttctattggggttcatcatataatacatacatattatttagaagcaatagatatgtactgtcattctaacatcatgaaagttaaaagacaaacacaaaatacagacaattttaaaagaaaagataaaaatacataaagaaaaaattcaaattttttctttctgctcccaatgaatagttttatgcaccctcagtgaacaatcagctcttctggagattttttataatgaagtcctggattacgtaaatgctgcatgatctttggcaaatctcccagcctcagtttctgcatctgtaaaattgcactgatgatcacccacccatcctagatggctgtcctcaggatcgaatgaggtatttgtggaagtatttagtaatttgtaaaatgtgaagggttaatatgattattactattagcagatagttactattaacatagatttacatgatagtgaagccaattctatagtaaatagtttggatttcattaaaagtagctagagatttcaagaggagtgttccccatcactaggatggcaaaactatctgccaaaggtattgtagagtgattcctgcaccaggaagagagtggaaataataatattaaaagtgataataatggtgaatattatgtggcagatattttctaagcactttatgtatattagctgctattataaccgttataacaagcaaaagaaggaggtcatattaatatgactattttatagacaaaaaactaaggctcaaagaaattaacctacgcgagatctcagagataacaattgagatagcctagtttagatgctcttcacattaccctccaaagctgatgcgagcattcaaaatctattcccattcagcaaagttcagtctaatatcaaggcaaacttcctttcattaatctattactcagcaagtatttttgagcccctattacatgccaagctctatactgggtattgggtatgcaatgataaataagcaaacacagtccctgcactcagagcatatgagctagtaaaagaggcaatcaatataagaaatacacaaaaataaatacataattctaaattttgttacattcaacaaaagaaagttctaggttatataaaataatgaattggagaacctaatttagattagagatcaggaaaatcttccatgagaaaataaaatttaatctgaaactggagaggtaggaggagttgtccaggtgacaaaaagaaaaaaattatagtgaaaacaaaagatggttctgatataggaaaagcctgattgttgtctcagacacaaagatagagagtgagagggactgtgtccccagacagggacaggaggtgtgtgggcaggagcagaccccacaagcctctgagaccacgtgacaggttttgacttttgccctaagagtgaagcattaaagatttttaagcagagagtgacaagattcaatttgcagattgtaaatattgctctagttaaagtgtggagaatggattagaggaagcaagcaagaggtgaagcgggagccactggggacaccatggctatagccaagtctctgtgcagcagcagccaccatttccagaagcagctgggaaagactgaaggaggaacaggtttgggtgcagtccaggtaagaagaccaggggctcagttttgaacctgtcaattttgagacgcatacagaataaccaagcagaaatacaaagtaagcacttacatctatgagtcaggagcgcgggaaaaattcaggaatggagatctacacttgggagccatcatcgtaggggtagcattctagctttggggtgtatagatcatccagtgacagaatatagattaagaaaagaagggaacttaagaccatgccctgagaaacctcaacagctaaaggttgagaagagagagagcccttggcaaaagattaagaaggagtcaatgatttaagagaaaagtcaggaaggagagagtgtgcaaaatgctgaatgccactgaggatcaggaagtgcccacactgagtgacaacatggagagcaggcatgggggtgggagggtccagccaggctggtcacccagggattgctcaaatactggaacctcttcccactcacttctcttcttctaaggcacagtggtttgccattagatcctggtacatgggaataagtgagtgaatgaatgataaatgatctgaggacccaaaaggtttaacagcttgaccaagattatccggccagtaagtatcaatgccagagctgaaacccagctcatctgattccaatgcccatattcttggtttaaaaatacaagctttaacccaggggaaatacctttgatgacacactctctgtcatgtttaatatcatactttaaggactattatacttatctctaaaactgaatctatggcttaggagttcatcaaaaactagggtagggagtgagaggcatcccctaaggtcgcctatccaggggataatgcatgaaggaataacctttacactaaatgaatgtatagtttgggttacatccttgagaccctgtctcaactgacgagcatgtgagagtctggccactcgccctgtagggccagctcagaggggagcttggtgttctggagttgtcggtcaggggtgatggtggtgactgtggtatcgtgggggccaccaccgccattcatggttgaaagaaaagaggtggtcagctggcagggccttctcaactcaacctccctcatcacccggttcccaagccagcctcataaccagtcctccctcctttagaagccgctggggaccccttttctcttctcttcccaacagcaccacctgctggccatagaggcacttggccttctactaatcacacccagtctggcctgagttggagatggccgcacacactcgggtccagtcaatgctccatgtggagaagacaagagtacagagatgcagcatctaacagagtcagaggaaggctatatgtgcaagacagagttacattacttatagggtgggagcaacacgaataatggttcaggacataggctcaggaatcagacttctggaattcaaatctagactccaccacttctattgttcccttaaaacaaatttctcctatgtgagagtaagtgacacagaatctcctatgagccaagcactggagttacagcagcgaaccagatacacagaatccctgcctcccagagctcacatgaggaggaagacagacaaaaagcaactcagcaaatgcataaataagaaattgaagaaaatgaaacaaaatgaccagggaagaggggtgctctttagctcgggtaatgtggaaaggccgatctgaggtgagagcaacagaaatgatgggttacatgatggtggcaatggcagcgtgctggaggtgagaggaaatctgagggaacattttcttgaatgtgaattgactgacaaaagtgtcactgaacacattacctttgattcctaaatagccagaatgacaaagcctatctgtagattactcattgtgttctcattcatttattttttcattcaacaaatctttgttgagtagctactgtatgccaagctttcctttaggtgctggagatgtagcagtaaacagaccaaaagtgctgtttttgtggagtttacacttagaggacaccaaaagctcatttatccattcactgagctcctgctgagcacctaatgccaagcatgatgccagacactgatgggtcccagaccctaaacaatagggctatcttggggtgggcacattgtggccagggtgaatatgcacctgcatctgtttaggtttgttcacaggcataaacacacacctgcctgagcatgtatcccatcaaacctcagacaacatgtatatactgttcagatgtttttcaaaatgcatcgggaagaccccgaaggggtctcagtagaggctttttatttgattcaaagcttcaaaagattattccatctgcaaaatgtataaaggctggatgttggaggaagcatgaaatagggagaggaaggacctgctactagagttatggctaaaggtggtagatggcagcagtggagacaaagacaagagggtgacgctaagtgttttggaggaataactaacaggagtagcagggggactcaatgtgtggggtaaaggaggagaaagaaggcagaaatactcccaagtttatggcttaggccactaggtggatgcagagaggtgaggactaggagatatgtgggtacatgtctgaagctcagagatatctgggccaaaaatgtacatatttgagagctgtcatcacatagaaggtatttaaagatatgtgagtggctgagatcacccaaggagaagaagagagggccctaccgagctgaggactccacaagatctcaaggttggacagcgcagaaggagcctgtacagccagctgacaaagagcggtcagtgaaggaagagaaactaggagggtggagactggaaagacaagagaagacaggtgtccaagaaaggaaggaaaatcaatggagtcaaccaatactaactggtcaagaaatgcagagtggctggtgaccttgatgaggacagcctgagtggggacacagaggccagaacagaacagagtggactgaggagcaaagggaggtaccaagcagggcagtctgtggggttcctggatgcagctggattggtttgctgctcaaagaaaatcccagctcagacctactctaggacagaagaggccttcatgaaagatgcctggctgcaggtgtccaggtgtgggaaggtgagtgggaggaggcaggactgagcagcacttccccaaaccaggagggaagccaacaccgaagcccaggcttccatttatagagtttccacaagtggacccggactactccaccctgttcacaaagcaacctcgcctgaacctttgacaccagaggctgagtcaggcccagatggcaaacacactttaagccctaatcagactttgcatgggtttactcagcccatgcctgcttctctgcccctaccatgtcctcctagaagagggagcacctcttccccgtcaccccccagagactcacctgcatgaggttcacacactgcactctctcacaccatataccacacacacacacgcacacacatacatacacaaagtcagtgtgatgattccagatgctggaaccatgcctccccttgccctttgccaaatgcctgccatgctggccacagaggcagaaggaaaatgacaattctgcccttttgtaatgcatgctactatttttgtccatcacaggttcctcaatttgaggcctaagtgttcctagacttcatccggtgttggaggaagcccttgctgccagggaagccccagtgtgaagacaggacatagcaaacctcagggagaccccgggatgaggaagaagacagccccaccctctggagcctgcagagggaatgcagtggagagacacagtcctggccttaaggttatccccagtttgaggagaaagaaaaggtccctggcctcagaagatccccagtgctaatgtccccacaaagtgtgagggtctccatcgtacgcatctctgtcctcaccctctccggacttggattttttaaagatatagtacaaaatacaaaatgaaaatcacatccaacttactcacctttaaagagccctgatcaaaatatgacaagtgtgtttctccagtcatatgttgagtactcacctgaagtctaacccaggctggagttaaaacatcgactctgacactccagtctttatatcatcatatctaccaccaacacatcacccacgtttaccttgacccagtttcaaatatgagaattttagattcagaggcagagcaggggtcaagaactggcgtagagccaggctcctcagaatgtggcctgtccctgttcacacggcccaggcaaagcctcaccagggaaccatgctccagctccctgccccactccaatcctgcagaccccaggtgacattcctgaggccacacagcctgagtaatgacacagcttagtggagctgactcatggaaagagttgccccatgtgcatttggaggacaaggacagttgtgcaaggtgtttgtgacaggccatgaggaggggcaggacgtgaggcagcaagaagtaccagttggtaattgtcattacttctactagaatctccaggtgacaaatctacctcagtgcccatagccctagatgttgcaaagcaaagcagcacttccacccacggcctcaaagagcattaaagagtcactctgtttcagctcacatgaaatcaaaccatcagtccatctgactgccctctggatcgcagctcttggctaggtacaagagctggggatatgaggtcttttcagcccccttatctgtgaaagaatgggattgcactagatgctctttatggcttcttccacctatgacatccagtggttctaagcaggtctcaacagggaccctgaagtatgtcatacatatgtgacacaagaggggaacccactcagagcacccaagttcaaggtcccaagaaaggaaagcccagtctccagctccatactacaggctagtggcaaatccctggcacaaagaatgttggcagtcaaatacaaatgtgaggatcgttcatcaaactggcatgctgtgtccattcatctattcattcatttgataagcatttaatgggagccttctatgcctgctatggagccagctactagatatgcagaaaataatagacaaagccactcccctcaagggcctcaaagtcaactggcagaggcagaggcagaaagaggaagaaaaaaaaagcaacatgctgaaagaaatacaatgttggagaaatgtccagcttaaaaggggccaggagagggattgccaaggtgagcgaggaatcaaattcactgaagacatagttgagctgttaacacttaaaagaaactggacttggaacccccaccatcaacttggactctaattcatgacatatatgacctttgtactctctgtttcctgacttataaaatgaaagtactgaagtatgtgcccacaaagcacagagttctgaatactaaaaaaattaatatagtagctccaagcttaagcatggactcaaaaacaaaatataattcaatctctacaggtcaaaatcagccatgggctcaagcactaagtaagctcaatccttaatgagtggcaacattcaaatctcagtacaactgcaacattttaagcatttaagtgttagtaaatgtcttagaatttccttgataattatactaataatataataacactgttagattaaatggatttgtgccttcctgccatgcgtagttgaaagacagatgatgtagctctatatcatgattcaaagtctcaagggactaggtcctagaacctaattagtcagagagtatgggtcaacaataattgataattcatgaaaatggctaccttgggtaatttcctccaaaattcaattgactcaataattccatggagcaaacctgtacattgtcctggaaagagtggcaatagagattgtaatgggaaaccatttgcagctaattcaaaacaaaggaatcctgagagaaaccctcagctcatgatcaggggagccttgtacagaattttctgaaaccaagcaaatgatttgctttcaggacaaaataatctgtttgtgctgtgaagcaggagattggggattcagccaaggacctctgtaggggacacagctgaccctaagctgcttcctacagaaagcccaaccctacctgtgggtggagcaaaggcctggccccattcagaggcaggtagctgtccatctagaagagtgcactggtttgacttctcaattttcatactagattatcaaccctgctacctattcatttgatttccaaagcatatgtaaatacattcaacagcatcttcaagagcttcaggcatgtatctgagagtgtaactcttaatcctcatgggtccagagctcatcagaaggctcaactgaaagaataatgactaccttaactaacagtgttgattatttatgatgtgccgtctcatctaattcatacaacagctctcttcagcaggtacaatcatctcctccatcgtgagattaggacaccaccctgaagagatgtcagcgtcagagaattagagaagaggtgtagacaggatttgaacccagcagtttgactctaagcctttactcctaaacactgggaatggtagtctaaggaagtcactatctagatactaatcctttcctctgagttctatccatgagacaagttagacaactgtaagactaaatagtcaactgcattaacctagttgctcagaaaatggtcttccttggactgaaacttcatgtgttgacctgagattttatgctagtattaatgaaaattggccatgaaaaactacttccacatgttaccacactcttgatggatacttggtattccgtggcactcagtatctcctctgtaaggtcctactgatagatatttcttagggagaaaaaaataagattttccctagctactgtgaaag

SEQ ID NO: 402 - DNA, 127839 bp, Homo sapiens
tcacacagcagacggcttcatgaatcagcctaagacacactaactttgactcacaggccattttttctcagggggacagaggcaggtattgccatgctagttggcatttagaaatctgtgtgtgtattgggggttagtggggaaaacgtgacaacgtggatggatctcaaaaactatgtctttttttttttttggagatggagtctcgttctgtcacccaggcttgagtgcagtggcatgatcttggctcactgcaacctccacctcccaggttccagggattctcctgcctcagcctcccgagtagctgggactacaggtgtgtaccaccatgcccagctaatttttgtatttttagtagagatgggatttcaccatgttggctaggctggtctcgaactcctgacctcagatgatccacccgtcttggccttccaaagtgctggggttacaggtatgagccactgcgtctggcttcttaaaaactatttcatgacacaaaagagcatgtactatatgattccacttatatgacgattaggaacagacaaaatccatctacaatgatagaaattggaataatcgttatctctgaacttttgcgggtgatggaaatcttctgagtcttgctcttggtgatggttatatgagctcatgcagttgtcaaaatgcactgaacagaacacttaagatctatacattggactgcttgtaaagtaaacctgaagaacatgtgtgagcatttttggttgttataatgactgaagggtgctccaggcaaatatataggagatggggccagggatgcttttacatcaaagaactctcccacccaaaggccagtaggtccctgttgagaaatacggctgcaagctatggggagccacagaaggatggaaacaccagagacttggccacatctgtactttggtaagacagggctctgtggtggtgggagtatcttgggacagtgatgtggcacagaaggtggatatatgattttcactgccactcctaggcctcgtatttgcctaactcttagcccactggcctgatgctgccccgaaggggccccaggaggtccctctgaggtacctcagatgctgaccagctagggaagtagcagaggcagcagatggcagtgggaaatggcaatgcctcacccccagcctccctgcctcatgataagcagcaaggatgatagaagtgatcatcttcctctgaagtggagtctcagtgaaggggtctccctgagtgtctagagtccctggaagcagggctgaacgctactgctgctactataggaaagcactgttttacatcatgggctaaagaagaacacagctgacttgcgtgaaaatactcacctgacccctgccttcggaaagccttctctgacctccgtcctgggcaggtgtctctcctgtgttcccacagccctacagagcacagttactgcctaggtttaaattctggctctgactcttgctgtgcgtacctgaaatagagttactcaagctctctgtttcctcacctgcaaattgaggataacagaaaccgtcttcactgaactgtcaccaagattgagataatgtagtaagcactcagtaagagtgagtgcttatgatgagcctagaatgcatcagtacagaccactgttgccaggtgactcctctggcacctccactagacattaagctccttgcgggcagggtccttgtggtcgtgttgattgctgagggccttgtgtccaccacagtgcctggtacagtaaatacttgcatgcttgaatcaattccacccactaagatctctcctgagagctttctttttccacccacaatgcctctaaatcacaacaattcttcagaaacggagtcagactcatttgtattctgttccctcttctctcttctctgttacctccatggccatgcagaacccaaacaacatttagtttttaaattaacagcttcttcctggactctctattcctaagacttcactcagtggtcttcatactgggcacacaaaaatcctttttaaaaaatgcaccctgcacctctcaaaaagtgaaacacagaatgatcatacgatccagcaattccactgcgaggtatataccccaaagaattgaaagcgggggctcaaacagatcctggcacaccaatgttcatagccgtattattcacaatagccaaaaggtggaaacagatgaatggccaaacaatgtggtatatccatacaatggaatatattcagctttgaaaataaatgagattctgatatatgataccacagagacgacccttgaaaacattaggctaagtgaaagaagccagacaaaaaaagacaaacatgatgccacttacacgaggcacctagaataggtgaatttatggagacagaaagtagaacggaggtcaccagaggctgggggagatgggaatgaggaattagtatttaatgagtacagcgattcagtctgggaagataaaaagattctggagatggacagtggtgatggttgtataacactgtaaatatacttaacgccacaaaattatacagttaacattggttaaaatggtaaatttcgtgttatgtgtattttaccacaatttaataaaagcctcccacaccaaacaaacaaaacactggaaggacagacttccctctgaaatctgacagagctgcatgtccctctgccacccctagggctctgtgaccttgaccccctggcccatgatctatcttcctctccatcctctccttggttccaactcttgggttccctgttctttttctttttttctttttgagacagggtctcactctgtcacccaggctggagtgcagcggcgctatcttggctcactgcaacctctgcctcctgggttcaagcaattctcatgcctcagcctcctgagtaggaggggctgcaggtgtgcgccaccatgcctggctaatttttatatttttactagggacagagtttcaccgtgttggccaggctggtctcaaactcctgaccccaaatgatcccctgcctcagcctcccaaagtgctgggattacaggcatgagccactgcaccaagctccctgttctttttctactccagacgccagggccacgacatgttcttttccttgcacccctctttaaccaccttgatcccatcatatctcttgagggtgcttcagatggatgctttgagactctgagatggaaaagctatgtgcctggagatgctcattattgactatgtgcaacaataaagacatagttaaataaagcaggggtcagccaaccaagtataaacagagaagtcatgacaaaatgttaagtgaaaaatgcaggctataaacctatatgtggactaatttcaactattacaaaatacagatttacagaaaacatagaatagggcatataaaatgatggttcatcttacgtttgttctctagcatggagtatggttattttcacaactgtaatttataatttataccagacaacatctttaggcagatgatgaaatacacacattgttagttttgcaagaatcttcagaattgattccagatgcccatatgctgccaccattgaggcccacaaatccctcccgaaaggcttgcagaggaatgggaggcgaggggctgtttcatgtcgactcttcagaaagacacttcaggacttggtgtgtctctctaatgactccaaccaactacctcaccacaaaaaaggagggcaatttagggtctttattttgctactggactaaccaggaaatttggctgtgaacagtttatcccttacattagcccaaagttaggaattcccatgatgcttgttcccttacaaatctgcaaacagtggatctcccgcatctggtgtgaggggatcccctccccatccaacatgctacaccccaggtatagaaacttgagtcacgcttgcttcaatggggacaaaggaaggagggtggcttctgttccatgtgctgcagcacagtgggaaaagcttttctcagtctaagagtttggaaattactgagttttgccagacaccggtggccatgatgctcgttccacatctcaccagatgcagaaaagatggagatgatgttaaagaatggggggaatctatttttttttttttttctttgagacggagtctcgctctttcgcccaggctgtactgcagtggctctatctcggctcactgcaagctccgcctcctgggttcatgccattctcctgcctcagcctcctgagtagctgggactacaggcgcctgccacggcgcctggctaattttttgtatttttagtagacacgggatttcaccatgttagccaggatagtctcgatctcctgacctcatgatccgcccacctcggcctctcaaagtgctgggattacaggcgtgagccaccgcacccggcctagaatagggggaatcttattttccacaatcccctaagataaggaagagccttttggtgataacactgcttaaaagagaaaagagtttctagtttttgtttttcttttttccccttgagatgacctgagtttctaccttctacatatgacaggtgacagacctgtggctgcagatggaatctggactgggggtccagagatcctgtgattctaagactgagcctgcatgtcacctagcccctcacatggtccagccagttttcccatctccacctgtagatccatttcaacaactgattaggtgcccgaagcatttatatgtctataaataatttctccctccccactgccttctctttttgggaatctgtcagtttactggagatgatagcatcttgtcctgcaaatatgggtctttgtgttagagatgagtttccttaaaacctctatgaaggaaatggttgagagtgcaagagaaaatttgaaatgaagccagaaggatgtatatttgtgcggggaggaggatgaagaaagaccaaaaatgttattttcattgttttacagtcatttcaggtacgttttactatttcgtcttagtcaacagcagtgtttataatataaagccatactgaataaaatatgcagacttcacttaaattttcatacttgagtgacaacacagcattcaagttatctgagctttattattttgatcatagtacagattactatacccttactatggtataatatctttatttattggttcatataagtctaagatatgcagtctcacacataaatggtcatttccaacattcattcattcattcattcattcactcattcaacaatgatttactgtgaagggccaggcttggtttgctaggcacaaagaatataaggtgaataggatatgtgttctcttagattcattaacatcatgcagcttctcattcttcaggtctataggcccttacatgattggctctgcccactctctcacctttttccttatcactttccccctttgtctgtctcttacaggtacacttcaggttccttgaagacaccaagctattgttaccccagggcctctgcacctgtggtctcctctttttagaatgctgttccccaggtctcctcttcactcaggtctttgttcaaatatcacctcctcaaagacaattctatttaaaggcagatctctttctccattcttcctcccagtcatccctcttcctacttaatttttctccaaagcactgctcaccacctgaacaattttatcttctgtctcccctggtagagcttgggcaggaagttcgtctttttagcaacgtatccctaggggctagaacaacctggcatgtaacagatgtttatatgtattcagagaataaatgaatgaatgaactggttcttgatagtttagggtgcttgatgaaccagcttttcaggagggctcattatggtccctggtagattcatagtccctactcctaagcctcccactcctcctcctattgggctgtgtctgtgaatgacatccttggccattcagcctcaaagccttgccatcacttattcttccctcctgttagtgcctacatccaatcagttaccaattttagtgacactgtggcctcttgcatcaactcctttttctaaccattcttacaaccacccccagtccatactctctttatctctcacctaaaccattgtcatcatttcctacctgggcttctggccagcaggctctccacatccaatctgttctccaaggggtagccagagtgagtttcatcatgttacggtttgattatgtttctcccccactcaaaaactaaagactcccaactccttagcttggcagtcaatgtccccccaataacctccatccccttacccaaccttccttctcaagtcccttcttttattctttttgctccagttggaatgaactgctttccagtttctgtatatatcctagaagtccccatgcctgtccatcctctgctcatgctatttccactcctcgaaatagttttcttcctttcttctaacgtacaaatcattcacccagtttaaatgctacttggcttctccaagaagccgttactgacctgtgaggagaataaaagtcctctttcaactgtttttaaggggttatccgcctctcttttagggcaagtctagggaaaggacaggcaatacgacacagaacaaagagttcagaatctggagtcagatcatctgagctggaggcctagctctctggatctgagacttttgaggtatgcacccttagataagtgaaaatccaagccttaatttccctatctgcaaaatgaggatgataacactattgtcacggatgtcttatgaggagtaagtgacagagtataggaagagcttttgacactacatacaaattaattatgaaattctattacgctaacgtacaaaaggttgaataaacaaaagtgttgatcctcccagggagttttcacagatgttttatgctggctgagcctgaagtccaggaataggtcagggggaaaggaattttttgagggaggaggactttgaggccttaagaatcccatgtccttggatgatctgaagaaaggaagaagtatagggtatatccacaaagctggagtcctagtggaattactagctaccaattcctgagcattttctatgtgttagggactgtactaagtactctacatacatcattcttgagtcagaaattattccttcataaagcaaaagaagcccatagcagttacataaatacgtgctcccaccccaccgccaaatagttcataacatcatcaatccaatgatgttatttttttggatggagaaattgagacccaaaagggttatatactgacaccgtacagccagtgaggaagagactgggactggaatccagatcccttcactctcaaggcagaaatccctacatggcaaaaacccaggggccaccattcattatgaagtctgtgtaaacttcatagccaatgccatctacatggactacactgtcagtggcagcccctgaagttctgccacttggccaccctggctcagctccatgatgagctgctcacccccctcaaaaaggaagttctcgatggaactggagactatgattctaagtgaagtaactcaggaatggaaaaccaaacattgtatgttctcactcataagtgagagctaagctatgaggatgcaaaggcataagaatgacacaatggactttggggacttgggggaaaggtgggaggtggatgagggatgaaagactacacattgggttcagtgtatactctgggtgatgggtgcaccaaattctcacaaatcaccgttaaagaacttactcacgaaaccaaataccacctgttccccaaaaatctatggaaataaaataaaaaaaggaagttcttgagaccagaacctcaggtccctggagactgaacactgccctccttgccaactattccatccagtctcctccaaggtgactgactccatcccttcaccatccgtctatgcttgtactccttcaacacatctctcggggcaccctctctgcaccaggcatcaggctcagctctggggacacctggctgcccttgagggagccgcgtgctgagaaaccacccgaacctggtgtgattgtaactcaagcttccccagcagctttgtcagcagcaccaagaggctgcccttaacgagccccaaggagaaagaggtggggacctccgcaaagggatgactacaggggcctggttggagtagaagatctggccctcaagcgggagggaagggtgactgggagggcatgcagtcaggacacagtggagaagaggacgaatcctgggatgccacatcacctggtccaactgaggacactcaggctcagtgtgtcctgggtggatcaggactaacgcctgggaatctgatctcaggtcctgggcttcttcattctcccaaacgaatcccaaacccggagtgtttgagtgttatgagagctctcctttgaggttgaaggaagcaaattaaagccccctctcccctttttttggtaccataggtagggaaggtagaaaatgaatggcacctgcccctccaagtggggcagggctggaattacacactttcgtggtacactcaggtgaattttggggttctggggcttcaatgtgggtgggatctagttgtgtaggaggggagcatgagtatgaaaaccaggaaccctagattctaatgaaagctttaccactaactctctggtgaccttggtccgccaccttactgggcctcagtttccccatctgtaaaatgagaaggttgaataagttcccaggattcgtctggccctgatcttctaagccctgtgatccttgataaggtaagcctcccaaggctctgacccgggcaatctccggttttgcaggagcctgggcctcaaccagaaacaagcagcatgctgggggaggggagcgcgctaagcttgtattctaggggagggtgggacgcgggaggctaaagctaaagggtcggtggaggcgaagcaatgggaaggctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccggctccgcacacaaaggcgcagacggaggcgccgcacttaccggccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgggggccgcgccgagctctgtgcgtctgcgtgtgcgggggcgtccgtccttcggtgcctccgtccttcggtccgtccgcctggcgctccgtcccgcgctccgtgcgcgctccctcgcccgaccgcctcaccaaatgcgcttcagctgcagagtcgctggcgcagccgccgggtgggtttggcaccccccagccccggctccgccccgcccccgggcgggcttccgccgctcgccgggaattgcgcagggctggcggggcgggggaccgggagagcggcctgctcccggggcacgaagggggccggatcacagacccttaacccctgacctcatctcaggtgcctccctctcccgagcaactctgcgcggagtctccgcagtcgtcgcccccatgccaaggttgcttggacaaggagggcggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcagagttgggggagggagtcggctcattgggggcatgccgtggcgctccccgcatgttgccaacacctgcgcaagtggagcggccccatactagggcgcatgcaataccaggtgccgaggactcgttctaggacgctgaggaggcgtcctttttcccagttctccctgttcagcctctggggagctagagcgagtggacagcccctccctccactgagtcttgccctcctgacgtgcggcgcggggcacgcacctgttttggttttctcgtgggcaccaggggcccggacgagcagggagctgcccatgtgccccacaatcctgccacaatcttccgtattctccaggctgctagtgcgctggccagaggtttccggcattccatccccatgggggcttgaggctgtgggctgcacacagggcagggatcctaaactccattttttacacggggaatcagaggcgagccaccacgtagctaccaccctggttccagccaccatccacccccgccccccgggatttccattatagtctctttactggtctcccagcttccacccttggccccctgcagctgattctctacacagcagtcaaggcgatcctttaaaatttaagtcagagcacgtcgttcctttactggaaatcctacactagcactccatttcatccaagggaaagttaaaggcccctcatgacctgcaaagcccttcaggaactggctcctttttagctctttaacctctctttctaccaccctcccccttctcccacgctccagtcacattggcctttttaatgcatcatcggcgtggcagccctgtggcctcaggacctttgcactgctggtctgtctgcctggaaactcttccctctgatagtcacacggctactcctttacctcttcaaagtgtcactccccccacccccccgcccccgagacggagtcttgctctgtcgtccaggctggagtgcagtggctccatctcagctcactgcaacccctgcctcctgggttcaagcgattctcctgtctcagccttccgagtagctgggactacaggcgcccgccaccatgcccagctaatttttgtatttttagttgagacggggtttcgccatgttggccgggctggtctcgaactcctgacctcatgatccgcccgtcttggcctcccaaagtgctgggattacaggcgtgagccaccctgcccaggctcaatgtgtcgcttctaagataattgctgtaactatcctgtttaaagttgctggccctccctcctcattttctccatgcagctatgacttttatttctgttccctgcccctgaggctcactggcttcattgccagctcccatctcaatcccctcccatcccaatccttcagcctcacctcactaatctgttttttaaacaaaccctgtgttttcctgtctctaggcctttgttcacgttgtccctgttcagtctggaatgccatccctcccatgtcttgactaatttttaaggtccagcttaaataccacctccttctccccacatttccagggacactcagctctcattactttctgtctgctgtgatagtggttccttctctttttccccaggtgcactatgaactcctggaaagtagggcggggtgtcttccctttccccagttcccagcacagaagggcccatcagcacatgtttgtggatcaacggcactgattgggaggccctaggctgggcctcaattggtcttttttttttttttttcccctaggaaaagacctagagacctagacccaattaggtccctgtgttgccctcaaggagtttcctgtggggtgggggaggattatatattgggtaaaaaggccatactgcttgggttgtgtggaagtgtgagtagacatttcagcctgtacgccaggacctgctccctaccccccgagagcatcatcaccatggttcggcatgaggctgatttctccaggctgcatcagttgaacaatagcagctactatacatgggcactttagtatgtgccaggtagtgttttgtgttttctcaaggcactgctctattgaatcttcatgacatctgtgggaggtaggccttttgacatccccaatttcagtagaggaagcagaaggaataagtgagttacttaaggtcacttaagaggtgtgtgtttcaaattcagatctagccagttccatagcacgtggtcacagaagcagggatgccttaacatgaaagccctttgggctgatggaaggaaggggagaaagtagggcttagagagcttcagtggcatcagcctggcccagattcttgatgtccccagctcaggggtcacagagtcatggtactccaggtgcactggggcctcacaggttcctgtcagtgctgcctctgatgtcctgtggtggaggctaatggctgcccttgtaaaggcaacttcggaaagctagcggtgcctcgcaaacattcctagctgtgtgctctgggttcaaagcccagccccagctgtcacatgtggataataatgcccatcttaaagggctatgggaaggaagaagtatgacaatacctctagaaagtagtaaggcaacagcaacaacaaagatctttcttcttttgtttcttgtattgagtttctgtcagatagggatatacctaaactagtctcctcaccctgtttccaccctatacaccctcttattgaagagtgttaccccagggtgcagttcaggaaggaaatctagcattttctgagggctttaaaaataagctatccacgttgcttccctgcattctctcgtttgatctgccaaaacaccttaggagggactgctattaccaaggaggaataggaggcacagaaaggtccaggggctttcccaaggccacagagctcactaaacgagattctagcttatgtctgactctgttcacttaaccagcaccctgccaacacacggaaagtgactgctttgatttcctttctcttctctgatgaggaagagtcctgtgaggcccatggcaacgaaatagttgtgaggttgtgacgacttaggagtcttcttgagccgttttgtgtaactcatttaccctttcatgatagagggaagaagagggatttaagaaagaggagatggggagaaaaagatggtctgagaaaccagagagtgttttactggtggttcttggtggactgttagagattagagtccatctttcttgcttttggcccacttgcaattcactgtcttggtaatgaaatgctttgcttcagtgaaaatgtccccctatccagatttttatttatgtatttatttacttacttataacttaccccaatccacaaaggatttgaagtagcttaccaaaggggcaggatccataaaacaatgttaaaatatcaatgaggataaagaatcaggaccaaagaaaatgtaaataaacgttgagtgacatgaccaaagctcaataatcacagctgtttttttattgagtttattcttgtgtgcaaaggaatttgtgtacattatttcatttaatccttaaaagagccatgtgaggtaagtactattattatcttcattttgaagcatagggaggcatttctctcaggctgggagacatgaaatatgatgccctaagtcacgtagctggtaagtggtagaggcagtatttgaatccaggttgacagtggaaccgatacccttaaccactgtcctatcctgcctctcgaggacaaaagattacaaacgtacagaccacaggggcctctagagtactgtgcttgaacctcaaatttggttctgatcatttgggatgccaaaaagaaacaatctgttacatagaactaatgcctttatatccttcaagtttttgctccactgtcattttctcattgaggcctcccctgacctctctacctaatacgtcagagcctgccttctcccgttcccttcaggagtcccaatctctccttttcttttataatgacacattttaccttctaatgtactggataatttctttataaactatgttataatatctatctcatattttatatatttcttatgacatatattctatattaataaatttatttacgagctatagattaggtagtttatctattttgtatgttcaccctttaatatctgttaaatatctgtttttttcccactggaatacaaggtccacagggcatctgcatccgttaggctcattgatatatcttaagtgtccaggacaatgcctggtacatagtaggtactcaataaatttttgttgaatgctgaaataagtatctcagaggggaagaaacagactagtatatctgaagtagcaaagtatgtcactttttttttttgcaagcttatactactttctttccattccctcctttcttttctcattttgttttttgtttgtttgtttgtttgttttttgagacagagtctcgccctgtcacccaggctggagtgcaatggtgtgatctcagcttactgcaacctctgcctcctgggctcaaacaattctcctgccccagcctcctgagtagctgggattacaggtgcacgccaccacacccagctaatttttttgtatttttagtggagatggggtgtcaccatgctggccaggctggtcttgaactcctgacttggtgatctgcctgccttggcctcccaaagtgctgggattacaggcatgagccactgcacctggcccttttctcctttttccctattcacttccataaaaaatgtgaggtagttctagcacttagctctaagagcaagtcttcaggaggttttcctgatgttagacctttaggatttatgcagccagggaccttagtctcatcgttagagtaaatgagcaaatgggaattcatgaacctaattgtggtggaatctctcagcaaaagctggatattatccccttacctaaatcagcaaaggtaatccttttaggggtataggaatagtgcccaagtgccgtatctcaaggatttgggatttcgagcagatgctattatgatggagatgggaaaataaagaacagagctttttttgtgaaatgattgatttaaagagagacgacatcctggtgctcctaagagctcatctccagggtttatttcctggctgcaagcctgaagagtaaaaagccaaggacatcagcgaggtttctcagagaaccttagctgagaccatttgctggtgtttgtgtgtgtgtgtgtgtgttggttgcggtgtggtgtgatcttcctgtaggggctggccacagagctgggacaagcccctgggggctacagataccagtctgtcagctcagggtgaagggcaaggtcacctggctgctgatcccaggaagaaacatcagaaacacttggtcaggaggagtgagcatcacagctttgtttcctccatggtcatggttctgaacccttgcagagcaaattatttaacaaatattttattgagggcctactctgagccagctactgtttcaaaaactggatatgtagtagagaaaaagacaatcagcttccctgctatcatggaactcgcattctggtggggacacgctgacaataagccaggttaaaataacagataagaggataatttcagacaatgaaaggcacaatgaagaaaaagaaaagaaggtgagtgatggagagccgccattttcaactgggtgtttggagaaggttttttggaggagataccatttgaagagagacttgagttgcaagaaggaatgagccactcagagtagggcaaggatttcctgggcagaacgttctcttctaggcacagcaggagaacagagtgaaagattgggtaggagaggagcccagagcatcccagctgtatctcagaaacatctcagtgaactactaagaagtatggattctgggccatgtgcggtggctcaggcctgtaatcccagcactttgggaggccaaagcaggtggatcacttgaggtcaggagttcgagaccagcctggctaacatggtaaaaccccatctctactaaaaatacaaaaaaattagccgggcatggtggcaggtgcctgtaatcccagctactcgggaggctgaggcacgagaatcgcttgagccaaggaggtggaggttgcagtgagccgagattgcaccactgcactccagcctgggcgacagagcaagactcagtctcaaaaaagaaaaaaaaagtgtggattctgaagctcctacccctggaaaatttaattcagtgggattgaggtgaggctcaatgttaaatgaaaataagttctccagatgattctgttgactggcgattggccagggttggaaacaactagcctggccaaggaccccaacttttggaggaggatactgaggcacagggggaggaaatctcttgtctggggtagcccagtgagttaatggctgaaaagtctcctgaatctggaccagacatggtcagggatctctggcaacaggccacagaaatgatcattggctgatttaggtgaaggggagtttactggaaggctgtaaggaggctcatgaatggaaatggaggctgaagaaccaggcttggaaaggtggatgtcgggaagctccagaagtttgcagggttaggaacatctccacagtcacatccagatgtcaccacaaggaagtatgagtaactaacttttcttcttccttcctaattcctcagaattttggctgagttccaattgtggcctcaccccactggctagaggagggcacatcctagttgatgtcatatcaaaacttcatccaagtcttcatccaaaaggaaatcaggaggctgttaccaaaaaagcagccccaaaggagcaaatgtgcactacacctggcacctcagagggttgaaaggatcagtcatcactgtcatcatcattacaaataaacacacacttatttgtttagtaactacttactatatgccaggtactgttcaaagcatgtacatatattgactcatttaattcttcctttatgacaatgaggcagatactgaggtaggtactgagtcaggaaactgaagcacagagagggtatgtagcaactaatgtttaattctgtttctacaggttctaaagctcataacacctcttgtctaagttgctccttacaacggcctgtaaggatacgcattatactttaagaggtataatgagctttatctacctgtaaatattacgggtagagaaagtaagcatgcacattccagggtcacatacctagtaaatggtagagtccttagattcgtagattcactcacttattcattcattcatttgtcaaatggcatgtggctttcaggggccagatactgtgctaggttttggcaactcgctggtgaataagctatatttcttctctccagaagttcaccaactccaggggagtggcaagagaaaaggctagagtgtgagcaaaggccagaaaaaaccaagggttcatactaaggagtctggatttcatctcaagggcaaccacagaaagatagtaagctggaaacttgtgttttgtaaaggcagctctttgcccagaccaatgtccagaaaagagagttttcctaggttttctgtgagtattttaatagtttcaggtcttacatttaagtctttaattctttttttaagagacagggtctcactctgtcactcaggctggagtgcagtggcaatcatagctcactgcagtctcagactcctgagctcaagcaatcctcctgtctcagcctcccaagtatctaggatgcaggtgtgcaccaccatacccagctaatttttatttgatttgatttttttgtagagatggggtcttgctatgttgttcaggctggtcttgaactcctggcctcaagcgatcctgttgccttagcctcccaaagcactgggattacaggttttaatccattttgagttaatgtttaaatatggtgagagataggggtccactttaattattttgcagccaaatggatagaactggatgggggccattatcttaagtgaaacaattcagaaacagaaagacaaataccacatgttctcatttataagtgggagctaaataatgtgtacttatggacgtagagtgtggagtgatagacactggagacttggaagggtgaagggggtgggagaaggtggaggatgtgaaattacttaatgagcagaatgtacattattcggacgatggatactctagaagcccagacttcactgccactatgacatagagccatgtaacaaaattgcccttgcaccccttacatttatacaaataaaggagacctccacatgaagataaatttttatcacaatttttaaaaggcaactttgactgcaacatgaagaatggactggagggggctaagaatgaagagagggagacagtcaggtgctgatgcagtgattccagtgaagacatggttgcctggattaggaggatggtgctgcagatgaaaggaagtgaacagagtagagaggaaagaaatggaattgacaggatttactgattggatgagggtagaaggggagggagaagttaaggacgaaagcgagatttttgagtttggcaactgggtgaggggtagtgccatccactgtgaggaaggctagcagaggagccatttgggaagaggataagataagctcagttttggaaatgtggagtttgaagttccagtgggatagggacatggagagatatgggagtttgctggacctttgtctccagatcccattattttcccacaatgcctggctaatttagagtctccatctgcagaggctgtcagaaacccagagactgtcagatcaaaccattgagattgcctgcttcatctctctcacagttcaggtgagaaaacaagcctgagagaagtggcttctggaggtcacaagccaagtggatgactgagctgaaacccaagcccaggtcttcccagagggcttcttccctgtcaccccacagtaccctgagccagagggtgcagactacaaacctgaggctgaatccagactctagtagggccctgtttggcctgcaatgaattcagattggtggccaccatagaaaaaattggagcatttcaaatataaatccatatttttaaaaataacagaaagtttgggaacttcaggctcacatctctacatgacagtgaccacatggagctggatagcagttgctcctctgaggcagagcaagtccaggttgccacagtgcccattcttgcctccatcactgagggcatgtgctatttgccatttatcaaatgtttgctctgttgtttttcttaaaggggaaagtcacacatttcctgtaatatatctaaagtatctcttatctgaccccagcttgcttaatttccttggcccctgcaagcatttgagttatgatcttgccccttctgctctgaaccgtgcatccttcatttgcaaagtgagtaattttaatgtggtgattccaaggccctctctagttctggcttccagggctctccaagtctgcacttcagaaatgagttgtgctattgacaatgcttaattgttctgcagatggtttttgagggattgctcacccttgactcttttgtccttgatttataatttatctcagtccttggaaaaaatgtcttttgttttgggagtttatccttcatctttgaacaaaatgaatacttcaaacaatgcagcatagctgcagttgctaggaagacagagcagcaacagaagctgcctggatacaaggccatcagaaaactctcattttttccctccctccctccctcccttgcttccttccttccttcttcccctcttcccaccctctttcccctcttttcagtgaagatatcacactaagtaaataaccgcttctacaaagaccagtcttagtcatcaatagagtttaggttgtcctgaatccaaagggttatttctacagacaacttccaacaagccaaacaattaaatagtcagtgaaataatctcctgggttttatcccaggctttgcgtctagatagtcatttgactttgggcaagtaattgttaagttttctctgggcctcagtttccccacgtgtaaaatagaagagtggaggaatggctgacgcccttgcagcttcttctagcctggacagtttacaaggagactgccagagatttagacagcgaggtagcgcctacgggtaacttctctatgactctaaatccaggtgagcgaggccctgggaccccttcacctagaagccatactactcagctccacgtctgtggcctctggctctctgctggctccctagtaagtggtaaaggagtgctttctctccacctttctcactagatgggatgttctccaagaatcaactttgctctgtaatatttcttttgatgtcataactttgttgtaggaagggccagtgacaggacctaaatgtctctgattgtttattcttcaagtcctgcatctcagattctgcaggtccccggcagcaggaatgtgatgatgtaagcaacaagtgcgccctctggtgccatatataaaacttgcgaaaaggatctgccattacgtaactgaatttaataaatcccgtttctgtctaacccacaagttaggataaaaatggacctaaatatactgtaaggtaagatactgcctacaaattggaagcctattgtttctgaatcttgcattttccctttcagagatgacttttgctcatttggcatgccacccttgcccctcagttcttgacttggtagctggggtagaggatatatcgagtacaacactgccctcctctagtcatacctgcctctcagtgaaacaatggaatggattattttaggagcaatcagctctcaattgctagacttgtagaagcagattctgcatgagtcctttttgagaatgctataaaatggaggggtaaggttattcaaacaagcaaatatttgttgagtacttactatgttccagaaactttccagagtgacaggtatacagttgtgaacaaaacaaactccttgttttaggagcataccttttattgggagaaacggcctccaatattcttttctaaccagagattctaagattcatcaattcacagtaatggtactgtggtttggcaagaatatgtaacgatgattttggccagagactcagggccctaaggggatttgtacatcacagcgaaagcagctgaggtttctggacatcaccttgacagacaggagccacaccactaggggctgttctgggtcctgaaagtggactccaagggaatctggttcaatgtttttattcttggagtacaaatggtcctgggtgtggcctatgggaaagagggaaggagacagaagaacatgtacaagcatcagaagtggcatatatacacaatcaccagagctggaagacattttagagatgatcttttataacatacctattttagtgatggagcaactgagacccagagagaagtgccttgcccgaaatcataatcaatggtcattagcaaataggaattaaaaattgaatttgtatttattgataaggagaccaagcgtagtacaaataaatgtaaatattgtgattttaactttgattaaaaataacgtgtggttgtcttttggaggtgagattgtaagggttttaaattttctttggtatatattgatgtattttgaaaaacattctacaatgagaatggataattgtaaaataaaaataattttattcaaaagatttttttttgatttgagacagagtctcactctgttcccctagctggagtgcagtggcacaatctcggatcactgcagcctacacctcctgggttcaagcaattctcatatctcagcctcccaagtagctgggacaacaggcatgcactgcaccaccatgcctggctaatttttgtatttttagtagagaaggggtttcaccaattggctaggctggtctcgaactcctggcctcaaatgatctgcctgccttggcctcccaaagtgctgggattatagacatgagccaccaccctcagccacgaatttgtattttcaatgactcaaagaaaataaaccagaaaccaacagcagtgggggcgtgtgtgtgtatgtatgtatgtatgtatacacatgcatgcacatacatgcacacacacatagataaaattgattttttgactttcatgaatcttccacattttatttaataactgttgacattgctaatctccccagtatgcagtcttcttattctggacatagagcagaattacccttccttgatcttgcagttattgtaggataatatgactaattctggtcaatgggcagtgacccatgtgatcaatggagatgatccgggttgcctcagagttgcagcatttaatttccagtgtgaaatttttttcacaatgaactttaaacctcctgtcaagatggaggtgcctcagaatggaagctgcctgcactgctgagtggtgaatgtggaggacagctgccctgaggagttgtccagacatgctgtaaactttgtatgaacaggagtttaacctctactgtgttaaatcactgagattttggtatcatttgttgcaacagtgtaacctagtctactccaactgttgtaagagtgtaacctagtctattctgactaatatagtaacatgtttaccttagtaataaaaagaattgttaccattttataaaatgtaatcaattaaacaagtaccgtattcaaaaattttcatgtcagaatttcagaaagtcacattaaattacatttgtaataaatgatcatgctatgcctggtttaaaatcaagatcactttttcaattaagagatattgatttgtgataaattgttaactgaaccatagacttgtaatattggcaggaacctcaaaatttcattttgcatatcccacccacaagttcatatacgggtatgtctaaaccatccaatacaactgagttgtctaaaccaatgggttccaaaacttccatcatcagaaatattataacttaaataaaagaggagactcctaagtcagacttctggaattttggttaaggagatctaggacaggacctgggaaatggcattttaaaaactgtaccatgtgatttcagtcacagggaggattgggaatccctggtccagaacataactttcaaatgatcattacttcaatttaagcttcacttaaactttgtgcccatgttgaaattgagatcacttttgtaatttcaggccacgttctccagaagcagaatctgaggtggggattcatgtgcatgtgatttactaaggagtgctctcaggggaagcctgtaagggaatggggaaaggaggacagggaaggggaagaatcaggaacacattctatgatttaatgatttgaaaatgaaacaaacattttattaaatacagaaatgatggtatggtggaaaaaacatgggcttcagaattagatagacctgacattaaaaaatttaaattattaatactatgttagattgacaaaccataattgtatacatttatgatgtaaaatgtgaagttttaatataggtatacaatgtggcattaataaattaagctaattaacatatcaatcacctttcttgcctatcattttttaaggtgagacatttgaaatgtacttattatgaaatatattatataatacattgttattgattatagtcagccttctgtgcaatagatctcaaaatcctttcctcttatgtaatctgggtcttggtactctttcatcagcaactgttcatttcctccctcccctcttcctcagcatctggtaaccattattctactgtctacttctatgaattcacatatttacatttcacttataaggaaatcgtgaggtatttgtctttctgtgcctggctttttcacttaccacaatgtcttccagattaatccatgttgttgcaaatgacaatatttcccccattttaaaggctgaatagtagtccattgaatatgtacaccatatttctctttatctgttgatggaaacttagatcgttctcctaccttagccattgtgaataatgctacaatgaatgtgagagtggagataccccttcaacatactgatttcagtttctttttttgagacggagtcctgctctgtcacccagcttggagtgcagtggagcaatctcagctcactgcaacctctgactcctgggttcaagtgattcttttccctcagcctcccgagtagctgggcttacaggcacccaccaccacaccaggctaatttttttgtatatttagtagagacagggtttcgccgtattggccaggctggtctcgagcacctgacctcaggtgatctggccacctcagcctcccaaagtgtaatttcagcttcttattaatatatacccagaaaggagattaccgagtcctatagtatttctatttgtaatacttggagaaaactccatactgtttttcataacagctgtactaatttacattcccatcaacagtatataagagttccatttttctctgaatcctctctaacacttgatatcttatctctttgataaaagccattctaacaggtatgggggatagttcattgtggctttaatttgcatttgcctaatgattagtgatactgaccttttttcatgtacctattggtcactcacatgtctttttttttttttttttttgagaaatatctgttcaggcgctttgcccatttaaaaattgggttatttattttttttcttgctcttgaattgagttccttacatattttataaattaaccccttatcagatgtatggtttgcaaatatttctcccattctatgggttgtctcttccttttgttaattgtttcctttgctatgcagaagttttttactttgatgccatctcatttgcctatttttctttttgtttcttgtgctcttgggatcctatccaagaaatccttgcccagaaaattgtcatgaagctttccccctacgttttcttctagtagcttttcagtttcagctttatagttaagtcttttgcccattttgagttgatttttgtgtatggtgtaagataaaggtctaatttctttcttctgtgtgtggatgtgcagtttttctaataccatttattgaagagatgttctttccccattgtgtattcttggcatgcttgtcaaaaatcagttgactgtaaatgcaagggttatttctgggttttctagcctgtcctactggtcagtgtgtctgttgtatgccagtacaatgctgttttgattgcattgctttacatgtttcgaaatcagaaagtgtgatgcctccagccttgttctttttttttaattaattaatttattttttttgagatggagtctcactctgtcgcccaggctggagtgcagtggcgcaatcttggctcactgcaacctttgcctccctgcaacctttgcctcccaggttcaagtgattctcctgcctcagcctcccaagtatctgagactacaggcatgcaccaccacacctggctaatttttgtatttttagtagagacagggtttcaccatgttggccaggctggtcttgaactcctgacctcgtgatctgcctgccttggcctcccaaagtgctgggattacaggcatgagccactgcacctggcccagccttgttctttttgctcaagattgttttggctatttggggtcttttgtggttccatacaaacttaaggatttttttccattttgtaaaaaatgacactggggctgggcgcagtggctcacgcctgtaatcccagcactttgggaggccgaggtaggcagaccacgaggtcaggagttggagaccagcctggccaatatggtgaaaccctgtctctaccaaaaaaaacaaaaattagtcgggcgtggtggtgcgtgcctgtaatcccagctacttgggaggctgaggcaggaaaatcgctggaacccaggaggcggaggttgtagtgggctgagattgtgccactgcactccagcctgggcaacagagcgagattccatctcaaaaaaaaaaaaaaaagacattggatttttgatagggattgcattgcacccttagatcaccttggatactatggacatattcacaatcttaatttttcacacccatcaacgtgagatatcttttcatttatttgtgtagtcttcaattttttattttttagaaacaggaatctcactatgttgcctacactgtacttgaactcctggtctcaagtgatcctcctgcctcagcttcccaagtagctgagactacaggtgcttaccactgcacctgactttcaatttatctcatcagtgttttatagttttcagtatacaggtattttacctccttggttaaatttacacctaagcatttaaattattttgttattgtaaatgggattgttttcttaatttccttttcagatagtttgttattagtacatagaaacactaatgatctttgtatggttcttttgtattctgcaactttactgaatttatcagttctaacagttttttggtggaggctttagattttctatatataagatcatgttgtcagcaaatagagacaattctactctttcctttcctgttaggatgtcttttttttttttctcttgcctgatttcactggctgggacttccagtactgtgttgaaaagaagtggtgaaagtgggcatccttgtcttgtcccagatcttagaggaaaagctgtcaactttttagcattgagaatgatgttagcaatgggtttgtcatatataacctttattgtgttgaggtacagtccctctgtagctaacctgttgacagttttatcctgacaggctggtttcttttctttctttccttccttccttccttccttccttccttcctgccttcctgccttcctgccttcctgccttcctgccttcctgccttcctgccttcccgccttcccgccttcctgccttccttcctcttccttcctgccttcctgcctttctgcctttctgccttccttcctcttccttcctctttctttcttctgatggggtcccagtttgttgcccaggctggtatcaaacccctagcctcaagcaatcctcctgcctcagcctctaaaagtggtggaattacaggtgtaagccaccatgcccagcttgtgatatttttaatgcctgcaaatctttgcctctagcaatactgtgctctcttatctatctctgtagattcttctcagtcaggagccactggctgatactccgaccttgctgcccattgtggtaactatgttcttctgattattattattattattttttattattatactttaagttttagggtacatgtgcacagtgtgcaggttagttacatatgtatacatgtgacatgctggtgcactgcacccactaactcgtcatctagcattaggtatatctcccaatgctatccctccccgctccccccactccacaacagtccccagagtgtgatgttccccttcctgtgtccatgtgttctcattgttcaattcccgcctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccatattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctatatccctgaggaatcgccacactgacttcctgttcttctgattattaatgctgctgtttggccccttcaactccagaatcctattattcccctgacaccaaagatcccagcatctcctactgtcactccagccttcagaggacagctaccactcagctcctcagccatactgacaccaccctcattgttcattccttattatcttggtaatggttcatttccctgggctgttctgaggagcagagcctgaagtgtgtattgtgcaagtgataattaatggactgttctcaggagaaacctgtaagagggtgagggaagcagaatagggaagaggcagagctaagcatggaaatggtttcaggtaaagtcaagtctcatcttgattttgagtataaactgggatgtggaatctgtctcatcttgaggcaagaaagaaggtctttgtaactttcccctaggtcaggcatctcacaaattgtgaggtggctccacttgcctaaggacaattctctggggaaagttgcaggtatgagctattagcagtggcacctgcaccaggtgataaatggacagatggtaccaaattaataaaataaatcagtggctctggatgtgtcaccaacagtgtctgctatatctggataagcttcaaccctcattaactctgtacttatcttgcatctgtactctcacagctgaacgtggctggaggaggaattttgctgaataatatcactatataaatgataaacagacccaagtaaatccttaatgctgcccagcaattatgtacacttctctagtccactcatgtcttgttgtcctaggtgactactccatggctatccttttccttaaacctgtgacaccttctccattattctcactgtcagttgatgaccatgactgatgactatttcaacagcaacaatcagaagagaaattcctcaaaactccacttctattacttaccagcatcattaaccatgtactctgccttcccttctattactaaggtcaaccaccaactccatgcagtaggagagtgggcagctggaggatggatccccactcagacagcattgctgggggattggtgagagcaggagaagaaatattttgaccactctttcctgctttctgatctcctggtgcctcccattgcagaaccaagaaagcccatgtgtgtagtttgtggaagacagcctcctgggacacagagaaaagcgcaagataattggtggcggtggatgcaaaaggacaaccaccagcacaaatgtgttctgtagtgatggtttccaaattcacatcttcaggagaacctcttaattccagactcacatatctaattgcctgttgtattagtttttctactgctgcataacaaattaccatgcatttagaggcttaaaacaacaaatatttattgttcctccatttccatgggtcagaggtcggagtatggcttcactgggtgctctgttcaggctcccacaaggctgcaattgagcacttgggttggggctgtgggtctcatctgaggctcagggttctcttttaagctcactggctgttgacagaatccagtgttctccataacatagcactttgctttgtcaaggccaacaggtgaacatctctggggtttcctctctgacagttagactgtctttgaaggtctcacctgattaggtcattctcacccaagataggctccctttatctcctactattagaccattcttgcattgatataaaggaatacctgagactgggtaatttataaagaaaagaggtttaattgactcttggttctgcaggctgtataagcatggcaccggcatctgctcagcttctggtgagagcctcagggagcttttacttatggtggtaggtgaagtgggagcatgtgtgtcacattgcaataatgggagaaagagagagggggagaggtgccatgcacttttaaacaaccagatctcatgagaactcactcactgtcacaaaaacaacaccaagacattcatgaggaatttaccccccatgatccaaccacctccaaccaggccatacctcctccaacactggggattatattttaacatgagatttggagaggtcaaatatccaaaccatatcactccctttagttgtaacttaattacaacagagaaattccttaacctttgccctataacatcacataatcaagggagtgatatcccgtaacctttgtcatattctactagttaaaagtaacttaaagattccatccacatatgaggggaggggattatacaagggagtgcatcatgaggagtcattttaggattttgcctgctgtacctgtcacctgttacctacatttatttacgtgctcaaactaactgaaatcttgatctctacttgtaaatcacctcctccaacagacttctccatctcattcaatggcaacatcatccttctgcttgcttggtcctcacatcccaaatacatcttgtctcctctctttccctcatcccttttatccaatctttagccctactttcaacatctaagaagagtctgatcacttctactgctactaccatggtaactggtttctctctctcttttccacttcattgcagctactccctattggcctcttcttccattctcttatattttcataacacagtagactgtgtctctgttgaagtgtcacttctctgcttctagcactctggtggccttcatctcacttagagtaaaggcaaattccttatgtgattgggtcctgttacctcatagcactcctttcacactttttgtcctaattcagtccactctagtcacaatggccaccctgctgctcctagcatgcagtaggcatttgctgtgcccacagatgcccacaggattcaattccttccttcactgaatggaaatctttgctcaatatttgctgttattggttagacttccctgaatatcttagttatattcacaactctccaactccctactcacttttatctttttaaaaaattaatttagggccgggcgcagtggctcacggctgtaatcccagcactttgggaggccgaggtgggcagatcacaaagtcaggagatcaagaccatcctgactaacacggagaaaccccgtctctactaaaaatacaaaaaattagcttggcgtggtggtgggcgcctgtagtcccagctactcaggaggctgaggcaggagaatggcgtgaacccaggaggcagagcttgcagtgagccgagatcgcgccactgcactccagcctgggtgacagagtgagactccgtttcaaaaaaaaaaattaattaatttataattgacaataattgtgtatattcatgggggtatgaagtggtgttttgatctatgtatatgttatagaaagattcaaacaagctaattaacatctccatcatctcaccagtttatcattttttgtagtgagaatgctaaaacatctattttagtaattttgaaatacaccataaaattatcattaactgtggtcactatgcagtacaatagatcacaaaagcttatgcctccagtccaactgaagctttgtaccctttgatcaatatcttccttttccccatgctatcccgtccaaccaacagcctctgctaatcacctttctactctgtttctctgagattaacttttttagattccacatataagtgagatcagtgtgcctggcttattttacttaatataatgttctccagttccatccgtgttgttgaaaatgacagaatctccttattttttaatggctatatagtatttcattgtgtatatacaccacattttctttatacattcatttgttgaggaactcttaggttattacatatcttggttattgtgaataatgctgcaataaatatggttgtgtagatattctttgacatactgatttcagttcctttggatatatacctagaagagggattgccagatcataaggtaattctatttttagttatttgaggaatctccatgctattttgccaaatggttatactaatttacattcccaccaacagtgtacaaagattctcttttctccataacttcgccaacgcttgttttcatttgtctttttagtaatagctattctaacaggtgtgaggtgtatctcactgtgtttttattttgcatttccctgatgattagtgatgttgagcattttttcatatacctgttggccatttgtaactcttcttttaagaaatatctgttcaggtaatttgtcccttttaaaaatcagattatttgttttcttgatgatttgagttgtttgagctccttgtgtattttggatattagccttttatcagatgtatggtttgcaaacattttatcccaatctgtggcttgtctcttcagtttgttgattgtttactttgctgtgcagaaaatttttagtttgatgctatctcatttgcctatttttgcttttgttggctgtgctttcaggagcctatccaagaaatcatgatccagtcatgaagcatttctcttatgttatcttctagtagctttacagtttcaggtcctatgcaagataaaggcccaatttaattcttctgcatgtgggtattcagttttcccagaaaaacttattgaagagaccattattttcttattgtgtgttcttggcccctttgtaaaagactatttgactgtagatatgtgaatttatttttgagcttcttatttggctccattgttctatgtgtctgtttttatgccagaaccgcactgttttaattacaatatctttacaatatattttgaaatcagagagtgtgaagccgccagctttattctttttgctcaagattgctttggctattttgggtcttttcaggttccatatgaatgttaggattattttttctatttcttgtgaaaaatgatgctggaattttgaaaggaattgcattgaatctgtaggtcactttgggtagtatgggcatttaaacaacattaattcttccaaatccacgaacatgccatattttttcatttatttgtgtcttcttcaatttatttcatcaatgttttatggtttttagtgtacagttgtttcacctcggttaaatttactcctaagtattttttgaggtgctattgcaaatgggattgttttattaattccttttacagacagtttattgttagtacagaaacactactgatttttataatgtgtagctttactgaatttgtttatcagttccagtggatttttggtggagtatttcagtttgctttatataaggtcatgtcatcagcagagataattttacttctttttttcttatatggatgccttttatttctttttattgtctaattgctctgtttaggacttccagtactatgttgaatagaaatggtaagagtgggcatccttggcttattcctgattttagagggaaactttcaacttctcaccattgaggctgatgttaactgtggacttgtatatagcctttattgtgttgtggtacattccttgtatatctatttctttgagagttttaaaaaacatgaatgaatattgaattttgtcaaacactttttctgcatttattgagaagatcatgtggtttttgtcctttattttgttaatatggcatatcacatttatgaatttacatatgttgaaccatccttgtatccctgggataaatacaacttgaccatgatgaatgaactttttaatgtgctgttgaatttgatctcctagtatttctcttcagcaaatatgtttatttttttattttttaaaatgacacataattgtacatatttatgtgatatatagtggtgtttcttttttcgtttcttttttttgtttgttttgagatggagtctcagtctgtcaccaggctggagtgcagtggtgctatctcagctcaccgcaacttccacctcctgggttcaggtgattcccctgcctcagcctcgcaagtagctgggactacaagcgcgcaccaccacgcccagctaatttttgtattttttagtagagatgaggtttcaccatgttggccaggatggtctcgatctcctgacctcgtgatccactcgtcttggtgtttatgttggtgtttcaagatatacaatgtgtagtgatcagatcagggtaattagcatatctattatctcaaatatataccatttctttgtattcatatattatttctttgtaagtgggagttaaacattgagtacacatggacacaaagaagggaacaacaaacaccggggcctacgtgagggtggagggttggagtaaggtgaggattgaaaaacattcaatatcctccttttagctacttgaaattatatgttattgttaactataggcatcctacagtgctatagaacacgataacttattctatctagctgtaattttgtatcctttaacaaatatttccctatcccccattcttcctacccttcccagcctctagtatcttctattctactttttatttctatgataattttttttttcagtttttgcatgagtgagagcacgcagtgtttaactttctgtgcctggcttattttacataacataatgtcatccagtttcatctatgttgccgcaaattacaggatttggctctttttgatggctggatagtatttcatgatgtatatatgccacattttctttttttttttagattcagggtacatgtggaagtttgttacgtaggtaagttatgtgtcatgggagtttgatgtacaaattattttgtcacccaagtaataaacctagaacccgataggtaatttttcagtcctcaccctcctgcacactacaccctcaaatacgccctggtatctgttgttccttctttgtgtccatgagtacacaatgtttagcttccacttacaagtgagaacatgtgttatttggttttctgttcctgcattagttggcttaggataatggcctccagctccatccatgttgctgcaaaggacatgaccttttttcttttgagacagagtcttgctctgtcgcccgggctggagtgcagtggcgcgatctcagctcactgcaagctctgcctcccaggttcacggccattctcctgcctcagcctcccaagtagctgggactacaggtgcccaccaccacgcccggctaattttttttgtatttttaggagagatggagtttcaccgtgttagccaggatggtctcgatctcctgacctcgtgatccgcctgccttggcctcccaaagtgctgagattacaggcatgagccactgcacccggcccgcaaaaggacatgatctcattcttttttttttttgtatggccctgtagtattccttggtgtatatgtagcacattttatctagtctaccatcgatgggcatttaggttgattccatgtctttactattgtgaatagtgctgcaatgaacacacggttgttggggtgatcagacccaataccaggttgtgggggtgacaaagtccggtggagtcaaaggattgagaaaaagacagtttgagagagaaaagtgggacaccagggggccattgctagtgtacagaggctgcgaagggcctgagctctgggagcccatgctatttattggtaatccaacagagaaacaggtgatgagaatggggaggtcaaaagggcaggtgcatggtctacagctgtgatggtttagcatttataaggaacatgttctgctgcttgagataatgggaataggagcctaggagggctagaagcaaggagtcagcaagtctagtcacattccagaggatattatgcaagccctgccttggtttccctcccaacactcagctttttcccaacatgccccacttctcttttttgtaaaagagaaggtaacattattactagcatgagaggtgacctcttttaattgagcaaggcgattgcaggctgtgcagcccttaattgctggttggtgatccagcttcacttttcttagcccttattcaaactggagtctctctggtttgaatgcttcccacatatctcccctttctcttttataagaggaccctgaatcctaggggttgcagaagagtgaaggtccgtcttctgtaacttcttcatgctgaataggggcgatgatactgctgcctaactattagcgtctcttgtattcagggtagagaggagctgagtcagaaagcattggtccattaagcatgatgactctggttggtcttcgttccatcttcgcattcagattcaactggatcatggctcatacaaggggaacccagtccatggttgggatccatgggtccctccagtctcctgttccatggttgtacacattttgagggcatccacacggttagttcatctcctgcaaaacacgagcctaccctcacccccatgttagtaaatctactgaaacagaagcaaaaacatttgtggctatagccggaaggccactgataatgagaaacaggccccttctaacagaaggcacagagaaagcaaattgaggcttttcaaacctttgattcacacagtacaggtgggtccactagatgctgtggctcatgatagagcttcagatgtttggtaggcacccacacaggcacctgattgtcacctggacagacacaagcaaatcctcttccccataaaattacctttaggcagggattggaggacgtagattcagaggtaaggagaattttggggcctaatggcttcctgatgtttgataggtgttctctcggaagttaggaattccctttctctccatattgctgcgtgggcatggaggactaggtaagcattcttagaatctgtatatatatttaccctttttccttctcctaattctgtgtataatggcccctgcttttgctaggatgtctctccctaacaaaggagtggggctttcaggcataattagaaaagcatgtgaaaagagtaaagttccccagtcacaacgtagtggctgggagaagtatctagtgactgcctgtcctaggaaccctcggatagtgacaaatctggaggacagttgtccgggacaggagaaaaagactgaaaaggctgcgtcagtgtccaggagacagttaacctcctggccctcaatggtcaagcgtacctggggagggtgatggcatgggctggtgcttgccccgggcaccctcagtcctgctgctggattatctggttaggggcttctgattcagaggaccttcgtcccctggggcagtaggccttccagtgattcacttgacataaggggcatggacgaggtggcggcttatttctattcggatctctccatgtcagatcaaagaattgtcctaactcttgtaaaacatcaatatagccatcagggttatctgagaatttacctaggtctattttaatttgtttcaagtctgaaagggaaaaaggtatatacactctgactgggccaaattctccagaatacaacttaagggcatttttgctttggggggaacgtttcccatctgaaaaaaagaacacagggatgccagcacccctagtcattttccaatgagcattagtcctacagcgtcctctatggtcctaatgcttattcttttccagggtgcgtaaccacccatggacctctgcttattggattggttatgctcaccaatgtagcagtcctgcacctgttttcccacctttcttgactgcaaagaaagggctctgggctgctggattctagtggtcctttaccagcatgcccaacacgcctttgtgcttagaggtgagttctagagctgggctgggttcctagttcataataacccaactgccccatcaagatgcattcccataaatagttcttatgcaaattcatttcagagagggtgtaggtaaccttttgagtcaggattgagatagagtttgattctgtgagtactttaaggcttggctgagtgcaaacagctctcacatttgagcagaccaattattaagcaacttttctaactctgcttctacaagtctccctatcaattactgaatacccattgtgtgtgtgtgtgtgttttcccctcaatcacccgggaggaacaatctatcatcctgtcctgaagggagttcctcctaggtctggttagacctttgtatggtaattaagttttaaatctctcattaggaaacctgctgggttaagggaattttcagtggttaatattaaatcacttttttttttttttaacagaatagccccatactttaagattgagtttgtaagctacctttttgcttttttaacttaggattgctctgaactggtggtgtgtgctcccagtgaggtttcttctaaaggttatttttctactttcttctgttagcaaagcagttgccgctacagactgaatgcatttgggccatctacgggttactgggttaaggatttttgataggaaggctactggttgtcactgatctcactgctttcgggctatgcccttgtttacactgacaacaaggtagtattggagtgttataggggcacagagaagaccttcaaagatcaattataggttttaaagttaccctggcttttaaaggaatagggtacacttttttctttacttgtgtttgtctctcctttgtagatggattttggaaacacagcggaaggatatttgctgtcctccctgctggattatagttacgggaaattgccatgcttcaaggtgtccttcagctctagccttttgaatagaattttgtatagcaccaccaggttttcatgttgcaactgcaggagcagtaagttttgtagctaattcattttcttgcccattaaggggagaaagaggaggtggcctttcacttaattcagcaggtggagctgacgggctaataaaacatactttttcagtttccctttaatttcctgtttcctgttcctcacattcagaatctgaagttttttacactggtcctcctcttccttatctgaatctgcctcatcatctgtttgaaatgtctcaagagctgcttttattagtgcccacactgagcaaaccgaaactggaatttttgctccatctttatacgcttttaaaaaatttcaattctctcccatttatccaactccatagtcccttgttctgggaactatggacaaaactgctttactgcactaaagagtgagtgatggtaaattctgagtactaactttcactccccttcttcgaaataaatgccttaagaaatttaaataagcagaatgtctgctttcactttgtccctctgttaccctggttctcccgagtgctcagctttccctctgagcttcttttagacgtccttgggtgtcctttttgacaatgcattctccactttcacacgctctagcattcctttaccagggtttttgtcgctccacattgggcagccaggaatgttggggtgatcagacccaaaaccaagttgtgggggtgacaaagtccagcggagtcaaaggattgagaaaaagacagtttgagagaagtgtgaaacaccagggggccatcgctagtgtacggaggctgcgaagggcctgagttctgggagcccacgctatttattggtaatccaacagagaaacaggtggtgagaatgtggaggtcaaaagggcaggcgcatgatctacagcaatgatggtttagcatttataaggaacatgttctgctacttgagataatgggaataggagcctaggagggctagaagcaaggagccagcaagtctagacacattccagaggacattatgcaagccctgccttggtttccctcccaacactcagctttttcccaacatatgtttgcatgtgtctttatggtagaatgacttacattcctttgggtatatagtcaataatgagttggttgggttgaatggttttaagttctttttttttttttttttgatggagtctcggtctgtccccaggctggactgcagtggtgcaatctcggctcactgcaagctccgcctcctgggttcacgtcattctcctgcctcagcctccccagtagctgggacccaggcgcctgccaccacgcccggctaattttttgaatttttagtagagacggggtttcactgtgttagccaggatggtctcgatctcctgacctcgtgatccgcccgcctcagcctcccaaagtgctgagattacaggcatgagccaccgtgcctggctggttttaagttttttgagaaatcatcacactgttttcctcagtggctaaactaatttacattcccaccagcagtgtataagcagtcccttttctttacaaccttgccagcatgtgttattttttcactttttataatagccattttgactggtatgagatgatatcccatttttttttttttttttttctgagacagagtttcactcttgttgcccaggctgagtacaatggcaccatcttggctcactgcaactactgcctcctgggttcgagtgattctcctgcctcagcctctcaagtagctgggattacaggtgagtgccaccatgcctcgctagtttttgtatttttagtagagatggagtttcactatgtgaaatgccaggctggtcctggactcctgacctcatgtgatctgcctgctttggcctcccaaaatgctgggattactggcatgagccatcatgcctgggccccattgtggttttgatttacttttttctgatgattagtggtgctgcacttttttttttcacatgcttattggccacgtgtatatcgtcttttgaaaagtgttcatttcctttgctcactttttaatttttttgtttgatttttgcttgttatttatagattctggatattagacctttgtcagatgcatagtttgcaaatattttctcccattctgtaggttgcctgtttactctgttggtagtttcttttgctgtgcagaagctctttaattaggcccaatttatcaatttttgtttttcttgcaattcttttggcatctttgtcatgaaatctttgaaagggcctatgtctagaatggtatttgctaagttatcttccagggtttttatagtttttggttttacatttaagtctttaatccatcttgagtttatttttgtttatgatataaggaaggggtccagtttcaatcttctgcatatggctagccagttgtcctagaacgagctattgaatagggagtcctttccccattgcttatctttgctgactttgttgaagatcaggttgttgtaggcatgcagcattatttctgggctgtctattccattccatgggtctatgtgtctgtttctgtaccagtaccatgctattttggctaatgtagccttgtagtgtagtttgaagtcaggtaaagttatgcctccagatttattctttctgcttaggattgctttggctattcaggctcttttttggtttcatatgaattttagagtagtttttcctaattctatggaatgtcattggtagcttgataggaataacattgaatctataaattgttttggctagtatggccattttaacaatattgattcttcctatccatgagcatggactttttccttttgcttgtatcatctctgaattctttcagcaatgttttgtaattctcattgtagagatcttttaccttcctggttagctgtattcctaggtattttatttttgtgtgtggctcttgtgaatgggattgtgctcgtgacttggctctcagcttggatgttgttggtgtatggaaatgctactgacttttgtacattgatttttgtatcctgaaactttgctgaagttgttaatcaaatctaggagctttggggcagaaactatggggttttctaggtatagaatcacataatctgtaaatagagatagtttgactttctctcttcctattggatgccttttatttctttctcttgcctgattgctctggctaagacttccagtactacgttgaataggagtgataagaatgggcatccttgccttgttccaattcacaaggaaaatgctttcagcttttgcctattcatgatgatgttggctgtgagtttgtcatagatggctcttattattttgaggtatgttccttcaatgcccagtttgtggatgatttttatttttgtttatttttatatttctatttttattttttatttccataggtttttggggaacaggtggtgttggttacatagataagttctttaatggtgatctctgagattttggtgcacccatcacctgagcagcatacattgtacccaatgtagtcctttatccctcccctccacccattcctgtgagtttccaaagtccattgtatcattcttatgccttcccatcctcatagcttagtacccacttatgagtgaaaacataacgctgtttagttttccattcctgagttacttcacttagaataatggcctcaaattccatctaggttgctgcgaatgctatcattttgatcctttttatggctgaatagtattccgtggtatatatttaccacaatttctttatttactcattgattgatggacatttgggctggttccatatttttgcaattgtgaattgtgctgctataaacatgcgtgtgcaaatatctttttcatataatgacttcttttcccacccaagagtgggattgctggatcaaatggtagatctacttttagttctttaaggaatctccacactgttttccatagtggttggactaatgtacattcccaccagctgtgtaaaagtgttctttttttcactgcatccccaccaacatctaatattttttgatttttttgattattcattcattcaatgccattcttgtgggagtaaggtggtattgcattgtggttttggtttgcatttccctgatcattagtgatgttgagcattttttcatatgttttttggccatttgcatatcttcttttgagaattgtctatccatgtccttagcccactttttgatagggttttttcttgctaatttatttgagtttcttgtagattttggatattagttgtttgtcagatgtgtagattgtgaagattttcccccactctgtgggttgtctctttactgttctgatggtttgttttgctgtgcagaagccttttagtttaatgaagtcacatctatttttctttgttttgttgcatttatttttggatttttgctctttgcctaagccaatgtctagaagggcttttctggtgttatcttctcaaatttttagggtttcaggtattaaagtctttgattcattttgagttgatttttgtataaaatgagagatgaggtttcagtttcatttttctacatgtggcttgccaattatcccaggaccgtttgttgaatagggtgtcctttcccactttatgtttttgtttgcattgtcaaagatcagttggctgtaagtatttgggtttatttctgggttctctattctgttccattggtctatctgcctatttttatatcagtatcatgcggttttggtgattatggccttatagtatagtttgaagtcaggtaatgtgatacctccagattcgttcattttgcttagtcttgctttggccatgtgagctcttttttggttccatatggattttagaattgttttttctaattctgtgaagaatgatgatggtattttgatgggaattgcattgaatttatagatttcttttggcagtatggtcattttcacagtattggttctacccatccatgagcatgggatgcgtttccatttgtttgtgtcgtatatgatttctttcagcagtgttttgtagtttttcttgtagaggtctttcacctccttggttaggtatattcctaagtattttatttatttgcagctgttgtagaaggggttgagttcctgatttgattctcctcttggttgctgttggtgtatagcagaactactcatttgtgtacattaattttgtatcctgaaactttactgaattcttttatcagttctaggaactttttggatgagtctttagggatttctaggtatacaatcatattatcagcaaacagcggcagtttgacttcctctttactgatttggatgccttatatttctttctcttgtctgattgctcgggctaggaattccagtactatgttgaatataagtggtgagagtgggcattcttgtcttgttccagttctcagggagaatactttctatttttccctgttcaatattatgttggctgaggctttgtcatagatagcttttattaccttaaggtatgtcccttgtataccaattttgctgagggttttaatcataatgcgatactagattttgtcaaatctttttctgcacctactgagatgattatgtggtttttgtttttaattctgtttatgtgatgtatcatatttattgacttgcatatattaactcattcctgtatccctgatatgaaacctacttgatcacggtggattatctttttgatatgctattggattcagttagctagtatttttttaggcattcctcaaggatattggtctgtagttttctttttttgttatgacctttattggttctggtattagggtgataccggcttcatagaatgatttagggaggattccttctttctctctctcatggaatggtgccaatggttggtaccaatccttctttgaatgtctgtctgatagaattcagctgtgaatacatctggtcctggactcatttcaatctcgctgcttgttattgccctgttcagaatttctcattcttcctggtttaatctagtagggatgtatatttctagaaatttagccatctcctctaggttttctagtttatgtgtgtaaaggtgttcatagtagccttggataatcttttgtatttctgtggtactggttgtaatatctcccattttgtttccaattaagcttatttggatcttctttcttcttttctcggttaatctcgctaattgtttatcaattttatttatcttttcaaataaccagctttttggttcatttatcttttatttttttttgtttcaatttcatttagctctgctctgatctttgttatgtcttttcttctgctggatttgggtttggtttgttcttgtttctctagttccttgaggcatgaccttagattgtctattcatgctctttcagactttttgatgtatgcatttaaggctatgaactttcctcttgtcaccacctatgctgtgtcccagaggtttggataggttgtttcactattatcgttcagttcaaagaatttttaaatttccatcttgatttcattgttgacccaatgatcatttaggagcaggttatttaatttccgtgtatttgcatgattttgagtgttccttttgaaattgatttccaattttattccactgtggtctcagagagtacttgatataatttcaattctcttaaatgtattgagacctgttttgtggcctatcatatggtctatcttggagaaagttccatatactgatgaatagaatgtatattctgcagttgttgggtagaatgttctgtaaatatctaagtccatttgttcgaggtgatagtttaaatccattgtttcttttttgactttctgtcttgatgacctatctagtgctgtcagtggggtattgaaattccccactattattgtgttgctgtctatctcatttttttaggtctataaaacaatttttagtaattgttttataaatttgggagttccagtactaggtgcatatatatttaggattgtgatattttcccattggacaagtccttttatcattatataatgtccctctttgtcttttttttaactgctgttgctttgaagttcctttagtcgaatataagaatagctccttctgcttgcttttggtgtccatttgcatggaatttttttttccatccctttactttaagtttatgtgagttcttatgtgtaagatgagtctcttgaaggcagcagatacttgattggtgaattcttatccatcctgccattctgtttttttttttttttttcctgacagagtctcgctctgttgccaggctggagtgcagtggcatgatcttggctcagtgcaacctccgcctcccgggttcaagtgagtctcctgcctcagcctgccgagtagctgggattacaggcgtgcgccaccatgtccagctaatttttgtatttttagtagagatggggtttcaccatgttggccaggatggtcttgatctcttgacctcgtgatccacctgccttggcctcccaaagtgctgggattagaggtgtgagccatcacacccagcccattctgtattttttaagtggagcatttaggccgtttacattcagtgttagtattgagatgtgaggtactattctattcatcatgctatttgttgcctgaatactatttatttatttatttatttattgtgtttttgttttaaagatcttgtgagatttgtgctttaaggaggttctattttggtgtatttcaaggattcatttcaagatttagagctccttttagcagttcttgtagtagtggcttggtagtggcaaattctctcagcatttgtttgtctaacaaacacaaacaaatttatgaagcttagtttggctggatacaaaattcttggctgataattgctttgtataaggaggctgaagatatggtcccaatcccttctagcttgtagggtctttgctgagaaatctgctgttaatctgataggttttcctttattgtttactgggtgcttttgcctcacagctcttaagattctttccttcatcatgactttagataacctgatggctatgtgcctaggtgattatctttttgcaataaattttctgggtgttctttgagcttcttgtatttggatgtctagatctgtagcaaggcaagggaagttttcctccattattccctcaaatatgttttccaaacttttagatttctcttcttcctcagtaacaccaattattcttaggtttggttgtttaacataatcccaaccttcttggaggcttcattcatttttttaattctttttcctttgtctttgttggattgggttaatttaaaaaatcttgtctttgagctctgaaggtctttcttctgcttgtacaattctattgccaagactttccagtgcattttgcatttctctaagtgtgtcctttatttccagaagttgtgattattttttatttatgttatctatttcactgaagatttttcccttcatatcttgtattttttttatttcattaagttggacttaaccttcctctggtgcccccttgattagcttaataatcaaccttctgaatactttttctggcaattcagggatttcttctcggtttggatccattgctactgagctagtgtgatcttttgggggtattaaagaaccttgttttgtcatattaccagaatcatttttctgttccttctcatttaggtagactaccatgaagggaagctctggggctcaagggctgatattgctggtgttcagattcttttgtcccatggagtgctcctttgatgtagtgctctcccccttttcctagggatgtggtttcctgagagctgaactgtagtgattgttattccttttctggatctatccacccagaggagatactcagctctgggctggtatcagggggtgtctgcacagagtcctgtgatgtgaactgtcttcaggtctctcagccatggatagcagcatggtttttgggctgtctcctggggtctgcaggaacaattttcttccttcaaagggtctgtgtggattcttttggctttcctggtatgttgttgaggattttaacatgaagagatgttgaatttcagtgagaatcttttctgcatctattgagataatcatgtgtttttttttttagttctgcttatgtgctgaatcatatttattaatttgtgtatgttgaacccaccttgcatcccaggaataaagcctacttgattatggtggattagctctttggtttgctagtattttgttaaggacttttgcatctatattcatgaaggatagtggcctaaaatttttctttttttgttgtgtccctgccaggttttggtatcagaatgatgttagcctcataggttgagtttgggaggagtccctcttgctcaatttattggaatagattcagaaggattgggactagctcatttaaagctcattattggtgtgttcagggattcagtttcttcctgattcaatcttgggaggttgtgtttccaggaatttattcctttcctctagatttcctagtttgtttgcatgaaggtgttcataatagtgtctgaggatctttcgtatttctgtggaattggtcataatgtcatctttcttgttattgattatgcttatttggatgttctctctttttttctttattaatctagctagcagtctattgatcttgtttatcctttgaaagaaccaagttttgcttttattaatttttttgtatacatttttgggtctcaaaatgttctgctctgattttagttatttgatttcttctactagctttggtgttaatttgttcttgtttttccagttcctctaggtgtgatgttagagcattaatttgagatctttctaactttttgaggtaggtgctaagtgcagtcaactttcttcttaccactgctcttgctgcatcctagagattttgatatgtggtgtgatgttttcatttatttcgaagaattttttggtttctgccttagttttcctgtttaccaaaaagtcattcaggagcaagttgtttaatttcatgtaattctgtgattttgagagagcttcttggtgttgatttctgtttttattccactgtggtctgagagtatgatttaaaaaatttttttgcacataaatcagaacctcaatgcgatacaccttactcctgcaaaaatggccataatcaaaaaattaaaaaaaaaatgttgacagggatgcggtgaaaaaggaacacttttacactgatggtgggaatgcacactagtacaaccactatggaaaacagtgtagagattccttaaagaactaaagtcattatatgaaaaaggtacttgcgcatgcatgtttatagcagcacaatttgtgattgcaaaagtatagaaccagcccaaatgccaattaatcaatgagtggataaagaaaatgttttataaataaatatatatatatatatatacacacacacacacacacaaacacacacacataagtatatatatacacgtatggaatacacacacacacacacacacacacactcaggaatggaaaacgaaacgttgtatgttttcactcataagtgggagctaagctatgaggatcaaaaggcataagaatgatgcaacggactttagggacttcggggaaagtgggagcgggtgagggacaaaagactacacattgggtattgggtacactgctcaggtgatgggtgcaccaaaatctcataaatcaccattaaaaacttattcatgtaaccaaacaccacctgttccccctaaatctattgaaataataaaaaaagtattacatgtgattgatcatgaagtatgttcattgtgcaaaacagaaaaatgtatattttgtgtttgatgggtggtgtattctgcaggtgtctattaggttaatttggttaagtgttgagttcaggtcccagatatctttgttagttttctgcctcagtacctgcctaatgctgtcagggagatgttgaagtttctcagtattattgtatggctgtccaaatctgtttgcaggtctagaagtacttattttgtaaatctgggtgctcaagttttgggtatgtatatatttaggatagttaagtgttcttgttgaattgaaccctttatcattgtgtatccattcccccacttttttactgttgttggattaaagtctgttttattgatataagaatagtgactcctgttttttgttttccatttttgtgatagatctttctccaacttgttactttgaatttgtggatgttgtttcatgtgagatgggtttcttgaagacaacagacagatgggtcttttttttttttttgtccaacttgccactctgttccttttaagtgggggcatttagattatttacattcaaggttaatatttatatgtaagatattgatcttattaagttgttagctggttgctttgcagtttttattgtgtagttgctttatggggtctatgggttatgtacttaagtgtgcttttgtggtagcagtattgttattttgtttctgtgtttagaactcccttaagaatctctcattaggctggtctagtgataaggaattctctagtgcttgtttgtctagaaaagtttttatttctcctttgcttatgaagcttagttttgcaggatatgaaattcttggttggaatttcttttctttaagaatgctgaaaatgggcccccaatctctcctgggttgtaatatttctgctgggaagtacacagttaatcttatgggactccctttgtacatgagctgatcttttcctttaggtgctttcaagagtttttctttagcactaaccttgtatagtctggtgactatatgccttggtgatatttgttttgcacagtatctcacagtttgttccttggatttcttgtatctggatgtctacctctctagcaagattaggaaaattttcttgaattattcccttaaatatgttttccaggtcatttattttttttctccttatccttcaggaatgccagtaatttctatataatcccattttttttcctcaaaggttttgttaattatttaaaaatcttttttttttttttttttttttttttttacttttatctgactgggttagttagaaagatgaggcttcaagctctaaaattctttttcttttttaaattctatttttagattccagatgtacatgttcaggtttattactttggtatattttgtgatgctgaggtttggggtaccaatgatcctgtcacccaggtaccaaaaccttgatgttatctcttctgtttggttcagtctatttataaagattttgattgtactttgaaaatccttatgtgagattttcaattctggaagctctgattggtttctttttatgatgtttatctcttccttcatttcttggatcaatttagaagtttcattgtgatcttccaccttatcttgggtctcattgagcttccttgcaatccatgctttgaattatttatctgtcatttctgggtcactattttggtagggctcattgctggagagctagtgtgatcttttgatggtatcactacattcagatttttcataatgccagaattcttgtactggttctttcttatctggagatgctggcacttttaatttttataattatttttatgcagataagatttttgctttttcttcctttccatataatactggtttttttctttcctttcccccgctctccttaaaggatgtgactgtacagaatgttgggtagggtcttttggctttgcttctatagccctatgcacttctgttggcaggttttatattgggttgtgctgtttaacctacaagccagtagatgaagcttataggtaagagctggctgtggccaacatgggtgggcatatgcttgattctcattttctgggaaaagctctctgttgtcttaggtgatcagctggttcatggagcatacagtcatctaacctccctgctcagtcccagacttggggggtgcagtgggcaaaatgggtggggccagaccaggcaggcccaccacaggtcccggtgtggaaggcacaagcaacagcgctgagggagaatccaatggccatctggcaagtgctcagaggtatgcctaagtgtggagctgggaaacctccttggccccaagttctctgcatattccaggagtgtgggtgctctagattcctggagatctgactgagtgtggagtagagagggtgctgctttaccacaatctctgcacaggaagtgtcaggcagctcaggctgctggtccaggtgagtgggtgctcttactgcctgagcataaagcagtaagggccccccttcaccaggatctctgcacgggaagggttggatggctcaggctgctatttaaggtgagtgggtactccaaatgcctggagatgtgcctggatatggagtggagagccctccctgctaccccacagcaggacctctgcacaggagggatgaggtgactcaggctgctgatccaggagagcaggtgctctgaatgcctggagatctgcctgggtatgaagcagaaaggacccccctgcaccaagatctctgtacaggaagaatgggatggcacaggctgcagaaccagtgagtgtatgctccaaatgcccggagttctgcctagctgtggagtggagagggccttgctacaccatgatctcaggggagcaggcttgggcaactagcagtgacacacactgaccagttccaggtcaccgtgctggccttggctgcaagtcttatcacgcaggagaaactgcagctgtcgcagctctcctcctacccctgacctgtgataggggaagagcacaattccagcacctactgctgaggtgctttccacaattctggcagtagaggttcctaccctgctccagagaaggcactccagcctctggcctccagcagcctgtgtggccacgctgccaggttgctgaagaatgattgactatatgtgactggattaaaaatggtgtcctgctcttggtcccaggtctgggaaaacacctgcagcttttccaggtgtcttttcctctcagcccctccaagcctctccttaggttaactccaggacttggcagaaacaaagtgttctccctcactctgggttgcttggatccctagtggaaagctgagtcacagagggaggctttttgcctctcttatgtatcagaacttcactacttttatcagctggacaccattgcagaggcagttggctggcactctcctccctgggattataaggagatccctcatgattctgttggaccccatttccttttcgaattaaagctcacagaattcttttttttttttttggagacagtctcgctctatcactcaggctggagtgcagtggtgtgatctcggctcactgcaacctccgcctcctgggctcaagcgaccatcccacctaagcctcctgagtagttgggactacagatgtgtgccaccacgcctggttaatttatgtatttttagtagagatggggtttcaccatgttggtcaagctggtctcgaactcctgacctcaagtgatctgcctgcctcagcctcccaaagtgctgggattacaggtgtgagccagcatgcctggccacataattgatctttatgcactatcttactatttccaaatagctgagtggccgaggcacagaaaaagcctctaattcaccatgttaaggaaagaaaaacaaataattgtttttagtagtccattttggaagacaaaaattaattatttgctgtgcccctttgtgctcttttgataaaaataaatctttctgagacatatatctttgaggagaaggtaacagagtaaattatggtggaggtgaagaagaggatcaaattacctgtcttgaactttcatcctgctacaaaaactaccgttttttggttgtgggaattacagatcacagagtaggtatcaacccatatttatgttcctggggacatcactagaggattctaggacatggtaataagcaacttttgatgaatttacattgtgtgggctttatgtcaattacttattcagattcatgatcctggatctgtttgccctcatgacagccctgagttggctggtggggagtgtaattgttctttagctcctggacttcctcatgtgcaggaacaccttctccatctacatccccaacctggctgggactgacatgctcctcttctcctgcaaagtggtgcaatctgtagaggatcttgtttttatcttacacattgttgctgtatgcactccattcttcagatcaattgtgaagtacttctcctacgcagtgggcctgagtatacgcagtgccattagcactgactgctgctgtccagtcctgtgccccaggcaggcactgctgccatgtctgagacacatgtaagctgtcatgggccctgtccctggtgctgagcatcctggaaggacaaccctgtggcttacagtttagggtctttaaagacagactatatcaggcttttgatttcatctctgccatctgagtggtctttctgtttgtggttctcactagggccagtctgactctgctggtcagtgtccagtgtgtttcccagcagacacagctgcccaggctctatgtgatcatcctgctcatggttctggccttcttttctatgatctgcccattagtatccactggttcctattttgctgggcagtggtctatcccaagaacattaagccctacctgattagtttaactctgtcctgtctgaagagctacaccaaccccatcatttactctttgttggtttctttagacagcattgatatgtgaagaccctcaagctgattttccagagggccctgtgtgatgagcaagagataaagcagagggaagccagccttcccttggaaacaaaggtgtcagtaggtggtgcaatcagtggtgaagagtagatttcagagtcagaaagacatgggtttgagatcatgctctgtgacttactagctgtgtagagttttaaattctaagtattaatgtcttcatttataatgttgggatgataatgatctatgtatatcatagggcaagggtgataatcacatgagatgatccttgtaaagaaacaaacacagggagtggggcggggccaagatggccgactagaagcagcagcagtcaggggcttccactgagaagaaccaaaacaacatgtgagtgctgcactggcaaccaaggtatccaggttctaccatcaggactgattaggcagttggtgtgacccacagagaacaaggaaaagcagggtcatgtgttggcgcacctgagagccaaatgggacaaggggagccaccacccttccaccaaggaaggtgatgcgtgagcatactacccaacctgggaaactgtgctttttccacagatctgtgcaactcacagatcagaagatcccattcttgagcccacgccaccagggcccttggtcccagtcacagggctacacagattctcaacagccacttggctggaatctgcctaagattacagagttcccagggagaggggtggccatcatcactgcagctgccagatacctaagaaaactgagctccctgagggagggacagcagctatcattgtggttgccagctgcctaagacactgaactcccagggaggaagggcagtagacatcactataactccaggctgcatttttcccttgctagagccagggagattggacagcttggttccaagaggtattctccacaatgcagaacaccggctgtggtagactgtgggagactgactctttaggccagaccctaacccatccctcctcaatgggaggggcctttctgcaggaaagccaggaacttcagccaggggcttagggacagaactctgatctccttgtgcctgaggccctagggggaggggtggctgtggtctctgcagaccagcagacttagtctttccccctgctagccctgaggaatacaggcagcccacatgaatgggtttccccccagcacagcacaccccctccaccaagggatagctaaagtgcttcattaaatggatcctggttcccatgccccccagctgggtgaaaccccccaacaggggttaccaagataccctatataggaccatttctactggcgtcaggttgttgccccttgaggtcagagatcccagaggaaggagcaggtacccacctttgctgttctccagcctccttgagtgacatctccaagtgcaggagcgctcctgatgaatagggcctgaaatgaacctccagcaaaccacagcagccctacaggaaaggaacatgaccattgaaggaaaaacaaacaaacagaaagcaacaacaacagcatcaatgaaaaagtctccacaaaaacctcatgcaaaggtcagtaacctcaaaaatcaaaactagacaaactcatgaagatgagaaagaatcaattaaaaaaatgctgaaaactctaaaggccagagtgcctcttctcctccaaacgattgcaacacctctccagcaagggcacagaactggacagaggatgagatggacgaattgacagtaataagcttcagaatgtgggtaataacaagctttgctgaggtaaaggagcatgttctaacccaattcaaaggagctaagaactatgataaaaggttacaggagctgctaactagaatatccagtttagagaggaatataaatgacctcatgaagctgcaaaacatagcaggagaactttgtgttgcaaacacaagtatcaatagccacattggtcaagcagaagaaagaatattagagctggaagactatcttgctgaaataaggcaggcagacaagatttagagaaaaaagaatgaaaaggaaagaacaaaacctccaagaactatgggactatgtaaaaagaccaaatgtacaaatgagtacctaaaagacacggggagaatggaaccaagttggaaagcacatgttaggatatcatccagaagaacttccccaacctagcaagacaggccaacattcaaattcaggcaatacagagaaccctagtaagatactccacaagaagatcaaccccaagacacataattctcagattctccaaggtcaaaatgaaggaaaaaatgttaagggtagccagagagaaaggccagtcactacaaagggaagtgaatcaactaacagcagacctttcagcagaaaccctacaagccagaagagagtgggggccaatattcaacattcttaaagaaaagaattttcagcccagaatttcatattcggctaaacaaagcttcataagtgaaggagaaataaaatctttttcagagaaacaaatgctgaggaaatcagtcacaaccaggcctaccttgcaagagctcctgaaggaagcactaaatatggaaaggaaaaaccagtaccagccactgcaaaaacacactgaaatacaaaaaccaatgacactatgaagaaactgcatcaactagtgtgcaaaataaccagctagcatcatgatgacaggatcaaattcatgcagaataatattaatcctaaatgtaaataggctaaataccccaattaaaagacacagactggaaaattggaaaaagagtcaagacccgttggtgtgctgtactcaagagacccatctcacatgcaaagacagacataggccaaaaataaagggatggagggaaatttaccaagcaaatagaaagcagaaaaaaagcaggggtcacaaacctagtttatgacaaaacaaactttaaaccaacaaagatcaaaaaagacaaagaagggtattacataatggtaaaaggatcaattcaacaagaagagctaactatactaaatatatatgccccaaatacaggagcacccagattcataaaacaaattcttagagatctacaaagagatttagactcccgcacaataataatgggagactttaataccccactgtcaatattagacaggtcattgagtgagaaaattaacaagaatattcagaacttgaactcagctctggatcaagtcagcctgatagttatttataggactctccacccaaaaacaacagaatatacattcttctcagtgtcacatggtacttacactaaaattgatcacaactggaagtaaatcactcctcagcaaatgcaaaagaactgaaatcataacagtctctcagatcacagcacaattataactcaagattaagaagctcactcaaaactgcacaactacatggaaattgaacaacctgttcctgaatgactcttgggtaaataatacaattaaggcagaaatcaagaagttctttgaaaccaatgagaacaaaaaggcaatgtaccagaatctctgggatgcagctaaagcagtattaagagggaaatttatagcactaagtgcacacatcagaaagttagaaagatctcaaattgacacagcgcagcacactggctgtggcagactgtggaagactgactctttaggccagaccctaacccatccctcctcactgggaggggcctttctgcaggaaagccagcaactccagccagggccttagggacagaactctgatctcgttgggccctagggggaagggtggctgtggtctctgcagaccagcagacttagtctttccccctgctatcgctgaggaatacaggcagcccacatgtgggctaacatcacaactaaaagaactgaggagcaagagcaaacacatccaaaaaatagcagaagacaataaataactaagatcaaagtggaactgtaggagatagagacatgaaaaatcctttaaaaaaatcaatgaatccagtagctagttttttgaaaaaattaataaaataggccactagctagactaatgaagaagaaaaggagaagaatcaaagagacacaataaaaatgataaaggggatatcaccactgaccccacagaaataccaacaacaatcacagaatactataaacacctctatgtaaaaaaaactagaaaatctaggagtaatgaattcctggacatatacaccctctcaagactaaaccaggaagaagttgaatccttgaatagaccaataacaagttctgaaattaaggcagtaataaatagcctaccaaccaaaaaaagcccaggaccagatggattcaaagccaaagtctaccagaggtacaaagaggagttagtaccattccttctgaaactatcctaaacaactgaataggagagacttctccttaattcattttatgaggccagcatcatcctgacactcaaactggggagagacacaacgaaaaaagaaaacttcaggccgatatccctgatgaacatcaatgcaaaaattctcaataaaatacaggcaaattgaatccagcaacacattaaaaagcttaagcaccatgacccagttggcttcacccctgggatgcagggctgcttcaacatacacaaatcaataaatgtaagccatcacataaacagaactaatgtaaaaaaccacatgatgatctcaatagacgcagaaaagacctttgataaaattcaacatctcttcatgttaaaaactctcaatcaactaggtattgatggaaaatatctcaaaataataagagtcatttatgataaacccacatccaatatcatatggaatgggcaaaaactggaagcattcccttcgaaaaccagcacaagagaagaatgccttttctcaccactcctattcaacatagtattggaagttatggccagggcaattaggcaagagaaagaagggtatgtaaataggaagggaggaagtcaaattgtctctctttgcgggcgacatgatcctacatctagaaaaccccatcatctcagcccaaaagctccttaagctaataagcaacttcaggaaagtctcaggatacaaaatcaatgtgcaaatgtcataagcattcctatacaccaaaaatagacaagcagagagccaagtcatgaatgaacacccattcacagttgctacaaagagaataaaatacctagaaatacagctaacaagggatgtgaaagacctcttcaaggagaactacaaaccactgctcaaggaaataagagaggacacaaacaaatgggaaaacattccatccttatagataggaaaaatcaatattgtgaaaatggccatactgcccaaagtaatttacagatttaatgctattcccatcaaactaccattgacattcttcacagaattataaaaaactactttgaaattcatatggaatcaaaaaagagcctatatagccaagaccatcctaagcaaaaagaacaaagctgaaggcatcacgctacctgactgcaaactatactacaatgctacagtaaccaaaacagcgtgatactggtgccaaaacagacacatagacaaatggaacataatagagatctcagaaaaaaaaccagatctacaaccatctgatcttcaacaaacgtgacaaaaacaagaacagggaaaggattccctatttaataaatggtgcttggaaaactggctagccatatgcagaaaattgaaactgggccccttccttacacgttatacaaaaattaactcaagatggattaaagacttagatgtaatacctaaaaccatagaaaccctagaagaaaacctaggcaataccattcaggacataggcatagacaacgattttataatgaaattgccaaaagcaattgcaacaaaagcaaaaattgacaaatgggatctaattaaattaaagagcttctgcatagcaaaagaaattatcatcagagtgaacaggcaacctataaaatgagagaaaatttttaaaacctgcccatctgacaaaggtctaatatccaggatttactaggaacttaaacaaatttacaagaaaaaacaaacaaccccagtgaaaagtgggcaaaggacatgaacagacacttctcaaaagaagacactcatgtggccaacgaacatatgaaaaacagctcaacatcattgatcattagataaatgcaaatgaaaaccacaataagataccatctcatgccagtcagaatggcgattattaaaaagtcaagaaacaacagatgctggcgaggatgttgagaaacaggaacgcttttacactgttggtgggaatgtaaattagttcaaccattgtggcagacagtgtgtcaattcctcaaggatctagaaccagaaataccatttgacccagcaatcccattactgggtatatgcccaaaggaatataaatcattctattttaaagatacatgctactataaaaacacatgcacatgtatgtttattgaagcactattcacaatagcaaagacatggaatcaacccaaatgcccatcaatgatagactggttaaagaaaatatggtacatatacaccatggaatactatgcagccataaaaatgaatgagatcatgtcctttgcagggacatggatgaagctggaagctatcatcctcagcaaactaacacaggaatagaaaaccaaacactgcatgttctcgctcataaacgggagctgaacaatgagaacacatggacagagggagggaaataacacacattgggacctgtaggtgggacgggggagagggagcatcaggataaatagctaatgcatgtggggcttaatacctaggtaatgagttgataggtgcagcaaaccaccatgacacatgtttacatatgtaacaatcctgcatgtttagcacatgtatcccagaacttaaaataaaattaaagaaacacagagcatgtccgtaagaaatgctcaacaaatgttagtgatgatgctaatgatattgataatgatgacaataataaagatgtcagtctacatggtggaaaaaatttcctgaaagaaactgagtggtgagaggcccttccctgaagattaaccacaacaatttccgcccatttactcctagggaaacagtagaaagggttctccaccccagtcattgaaccgattcaatatgcccatagatacatgtccatattcttctatctgcaaattccaaatccttgaaactccaaaaactaaaagttgttttgtaaatttggaaccaaaactaactgatctgaaatgctaagaggcagaaagttatcttttaaaatctcccttattgggcacattcataagtttctttgcagaaatactaatgtgtttgattatgcagtgctgcctcagattccactagggggttaaataacattcaatggaagcacatatgataatttatagatgatatttggatgtaagggtttccattaggagtttggacctgcatttataaaatgatgaaagtttgccctgccggggactgggatgctggtggctactcagtcacagatgttcttcagtttaggatgaatgtacacacatcagcactgttgtgaggactgttgtgttcctaaatttggaaaaactttgaggtttttctccctggggagcatgattgacacaaatgaacataactaggtagtggggttgtgttggtgggaatttagtgaggatgagattctgatttgttttactctctgcttatggagacctacagagagctgcaggggacagaaagaggcctcccaatggtgtgactacagcccttatccaattgtgggctaagtcctatcactcttcacacataccatttgctgtgatgctgaacctcagattgtccagaagggggagctgagagaataaatccataggttcacaagaagcagtaatgtggttatgaaattggtcctgagatttcattttcaattgttagagattcaggggtcacacccacctggatcaacatgtcatatagtttggcttaacccatattaataaaaatgtttttttttcacctctggcaactggagaaaacaaaatctagtcaccttttcagaccctctgacatttaacgttctggctcctagttacctttccatcttcatttattactattccaattctcctattttctgggatcatcctccaaaactccacccatggcagacatggttaatagatcccaggatgttgtctcattgagcctatcttgggcttaaaaataaaattcttctgaaagcagcattttgtagactttgcaatcagatgcggctggcacaagagatgaaatctccacatggtctaatgtttcctaaatagtttctgcatctgtgccaacaattaccatgagactcgattgcattttcttctttccacctcttttagttaaaaatcttcttgtcttaaacttacccaccttgagggattgttaggatgatcaaataatcaaaaaagatagttaccaggaaatggcctcattagtgagatgacatgctatgttaagacaggggctgtcctcctcaaattccaaccttttctttaagtttttccatccatcactaaacttctcttcctcttctcagctagctctgaggtagtagatattgatcacagacatcctctctttccctactgctgtaggctggtggagggcagagctatatcttgtcaacttctttatttccccaatgtcagagcctgggcaagtgtgttttgcctatactgctacctgctacattctcaattaactggttactggagagaaaggggctgtgcatcctctggaattttcaatgtaatgttgactaaagtcacagtggactctgaataacagagaggtagtgtaggatagggctgaataaaatcatgttgtggtagatgcaagttggcatggatctctagcacagaatgattctttcaggggacaatttttactacagctctttttcttttctttcttttttttttgctgctagtaattgaccctacttatcccatgaatttcaaatctttgttaaagtttatcacattcaccaaggttttgtgtagtgcatttgagtgcttgtttgtgtgtgagatttgatggactttaatttcacatttggtttaatatgctgcaaatatcagaaggggtaagcatggaatagagtccatttaacaaataaagacacagaaatacatagaggttaagaaacttgtccaaggtggcaaactagcatcgcctgttagatgttcttttttttttttttctgccaaccatcctgattctggcaacctgattttgctccatgtagcttccagcctaacatcatcctaccaggttcttttgtgtctcttcccttattctctcttctttctcttttttcagaagcaaaacctaattatttgcattttctcccctttattctaccctcatccatctttggagtccatccatcactgaacttggatggaaccaccaaactatctagtttgggttcttcttgacatctatgtctccagggcttcgctttcttctttaagtagttactatccttgccacatttaatgaatatgtttaagcttccagaaatccttcaaggtagaaggcagggtggttaaaacctgacagttttctgctcatgtttttggaacgtgacacctgatggttgaggttgctgaagatgcactccaaagatgcatgggggtagaataaaggggagaagatggtggtccttttggaatttgggttgtgccaacaaaactggccagtgcttgaggggcatttgccctaggccgtcgaacttgcagtctccataagatccctgtgtggggaaagcaagctaagtcctagtgttgtacaactccaggggatgtcacctacattgtggcctatgtgagtcctgcccctggatttgtgcaatgcacaccctgttgggcagcatgtggtggaactgactgaggagagaccctgtaaagagaggaagtccacctgtggtcagtacttaaatgaaagaggagacagggaagaaaggcctgataccactacatgaggtgcagaaaaataactgaaatactccttgttatggtttggctgtgtccccacccaaaatctcatcttgaattgtaatccccataatccccacatgtcaagggagagaccaggtgggggtaattgaatcatgggggcagtttcccccatgctgttctcatgatagtgagtgagtctcacaagatctgatagttttatagggggctcttcccccttcactctgccactcttctccctgctgctttgtgaagaaggtgccttgcttttccttcaccttctgccatgattgtaagtttcctgaggcctccccggccatgctgaactgtgaatcaattaaacctctatcctttataaattatacagtctcaggcagttcttcatagcagtgtgagaacagactaacacactctttcagaaattgaaagggagtaaccaatctgagtcatacattattatacttgaggcatctatgttattaaaagtatgagtgtataaaaggcacttgtccatgtatttaatttgttctcattaaaaaaatctaagatggaccataccatatgatgaggagggagggtcaggatggtctgtatgatttgaagaggttctttacttccatccagggttcagggtcatgcaaatatcaagtttcctggtacagtttttcaagcagttagctgttcctttacttgaacttccagaccacccagattagaacaacccctcttattcttattctaatctaaaagcacatgattattagggcacctggcattctttttaggagcctgagagctctggaggatggagtttgtttgcaaactcttcagtgcttgtaagtgttgcatgtacctgatacccactatttgttcattggatttgatgtagctctgaatattctctcctgttcaatgacttctgttccatgattgtctcttctgtgaaacaaatttctaggccatttctctgtttgattttcactggagctcctattagtaacttgcttgatcttcatttctctttcactcagacagctcctctctgagtccgtcaaactcacagaactgggaaggaccccagggtctctttagattcgtatctttacagatgaaggaactgagtcccagagggtggaagtgacttctccaaggccacacagagagtttgggcctcaggatctcagtctgagattttaggctcttcctgccttactttttcctctggttcttcccctctgtcattacctcttgtttcatttcacttaactcgtggctggaattgcccccaaagtggcagcagggccacaagggaatgccccaaacaatcctgagatgggggattccatctcatttagtacttccaagaagtactaaacactagaggaaagaggtgttgtacctaggtataaccagtataaccacagtgaaggggtcagggtgtggagattttatgagggtttaaggaattttgctaagatgccagggacagcttctttcagtgttttgggcaacaacctagatacctttatcagtgcctgagaatgtttataaggccccagtttgggtgcaaacatgctaggaaaaacctgtagctggctgggtcatagagtggtcaaggcattgggggaccctacacctctcttggcctctttctctatttgggtgatattactggggtaggaccaacatggataattcgcccttccagaaatagaaaatgcaatggaaaataattctaggggcatgtctgacattgaggcaggtctgcgggaagtggtagaactgtccaaactgactcattttgctgagatgtctggaaaatggacaaaagaacaatcagggaaacacaggcagaaccacctctttctgccttgctgcttctgcaccagccatgagtctatgtctttgcctttctgtacctgtctctctctctgattttctttctttctatagctgtgtctctctgggtgtgtttgtctctgttcctctcactgtttcttctgttctctctctgctccatttttgccccatcacatccttcatgcccacataataatttaaagaggattctcagccagtcctcacaaactttcttctctctctctctctttttttttaacctccaaattatccccttctctgaagtccctccaagtttttctctgatactttcttcttgtccaagggtgaatatatggaaatggaatgtgtgatagatggggagatggtttccttctctctcagactctgtcctgtgaacagcttttttgagcactgtttacaagtaaagtgagagagggcagtgtaggaagatgagaagagcctggacagagtctaggatgctggggttttagagagttagtaaatagccctttctttctccacttaacctctgaaccagttatgaagttgacaagtggcaagttagtgggagggcaaattgttatctcaattgctcatagagttattgaataacatgactgagacatatcatcagggagattcctgatactggaacctagtgttaggcaaatggaagcttccggtcactgcacaggtggcaccagggtgcagtgtacctcagttatttgtctaaaatgaggaaataatgttagcacccacctctttgggttattgtgaacattaaatgagaaaaatgtacctatttcctggcacatattaggtgttcaatcattgttagctgttattactagcccagatgccagctatgcccttgttctctggctccctggatctaccagcattcaagtgcctgcctggcatccagatctttattcctaaggggcccaagtccttaggtgtcttgccttgtaagctcatgctttctgcagttgttgtttcctggtgctgttaagtgtaaaatatatactagattataaagacttaatacaaaaaatagaatataaaatatctcattaattttttatattggtcacataacaaaatgataatattctggatatagcctataaaatataaaattacaaggtggctcacattttatttctgttagtgctattttagagtaactacaaaaatttaaaaaatgtatcattaaaaagctaatacaagagaaaagattaaacaaacaattcataaaaataaaatggattaaagataatataatagataggacatatagaaaacaaatagcaagatggtagacttaaaactaactgtaattaaattgcagacaaatggaccaaacgattcagttaaaagtacaagattgccagactaaatcttgaagaagacccaattgtgttatatttacaagatacacacttcaaatataaggacccacatagtttggataaaaaaaggatagaaagagataaactaggccgggcgcggtggctcatgcctataatcccagcaccttgggaggctgaggcaggcagatcacctgaggtcaggagttctagaccagcctggccaacatggcaaaaccctgtctctactaaataataccaaaattagccaggcgtggtggtggttgcctgtaatccaagctactcaggaggctgaggcagggagaattgcttaaacctgggaggtggaagttgcagtgagccaagatagcgccactgcactccagcctgggtgacagagtgagactccatctcaaaaaaaacaaaaaacaaaaacaaaagagataaactatgaaaatcttaaataaaataaagctggcatggttaagatgatataatataaattataatttaaggtaacgagtattactagtgaaaagaagaaatatttcataatagcaaaaatgtcaattcatcaagaatacattacaaacttaaacatgtattcaccagcagagttaaaacatgcaaagtaagagttgacacaactaaaaataacatacaaacccagaatcatagttggtgatttgaactcaacacttctaataaaagagaaaaagaagacaaaaaaattctgtaaagatataggagacttgaacaacataattagctatatgacttaatgatatatatggaacaatatattcaaaatatacattattttcaagtgaatgtggattatttctcttgtagaccatattatggccacaaagcaattctcaaaacattttaaaggattgaaatcattataagtagcttccctgaccacaatagatgcaaacttcattctattcaataatagaaaggtaaatagaagcctttgagatgtttgaaaaatgattcagcacactctattcattatagaataaattaaatatttataagaaataatactactaaacatcaaaattgtagcaggcagctaacacattacttatggtgaaatttatagcctttaatgcttatattaaaaaagagaaaggttgaaaatcagtaactggggaggtagagcaagatggtggactagaagcctccaccgatcatctccccatgaaggacaccattttaacaactatctacacaaaaaagcaccttcataagaaccaaaaatcaggtgagcacagcacctggttttaactttgtatcactgaagaggtagaaaaatctgtcttgaattgctgaggtcacccctcccctcccactgtggggtgtgtgctagcagagggagagtacagcaattatgaggcatcaaagtcattgctgtcttgttagagcagaaaagaaaaccggaccaaactcagctgacacttgcccatggagggagcatttaaaccagccctagccagaggggaatcactgatcccagctgttggaatttgagtttctgcaaaccttactaccatggcctaaagtgctctggggctgtaaataaacttgaaaggcagtctaggccataaggactgcaacttctaggcaagtactagtgctgaactgggcccagaacaagtagactaggggagcatgcgacctactgagacaccagcaagggcagcaaagggagtgctagtatcactcctcccctaactccaggctgtacggtccatagctccaaaagagaactcctccttccacttgaagagaggagagggaagactggggaggactttgtcttgcatcttgaaaaccagctcagccaacagcaggatagggtactggtcagagtcatcaggccctcttaccaggccctggctactgggtgatttttctagatatgccctggggccaggaggaaacccattgccttgaagggaaaaacctagtcctggcaccattcatcacctgctaactgaagagcccttgggccctgaataaccatcaacaatacccaggtactatgttgaaggccattcttcagcgatctggcagtggggccacacaggcattttagtctcaggccagagattggagtccttactctggagcaggttaggagcctctatggccagaactgtggaaaatgcctcagcagtaggtgctagaattgtgctttcccccatcacaagcctggggtggcaagagagctgatacagctgcagtttctcctaggtggtgagactagggccagcgccagcttggtgatctggaaccagtctgcatgtgtcatttctgggtactccagcctgctcccctgagactgtggtgtagcagggcccactctgcccaatatccaggcagaaatccaggtatttagaatacccattttcctggaccagcagcctgagctaccctacccttcatgggcatagatcaaggtacagcaaggccctctttgctccatgcccaggtagatctccagggattcagagcacccgctcatctggattagcaacctgagcagccccacccttcctgtgcagagatcctggttcgtggaggccctcactgcatcacatccaggtatacctccaggcatctggagcacttgctcttctgtttcagcaggctgagctatcccacccttcctggacatagattatgatacagtgaggccctctctactttatgcccaggtagacctccaggcatctgggacacctactcttctggattagcagtttaggccacccccatccctatgcagagaacttggggccaaggaggtttcccagctccacacctaggcacacctcagggcacttggtggctgcccactggatgctggtgtgtgtgtctcctactgggtgacccgtaggtggaactgcatgattgggctctgcccatcttggtctccatccatctcggctcccacccatcttagtctctgccttcctggggctgaacagggagctcaaaccactgtgcactttaggaagcagcccacagcgtgaggcgatagggaatttctctcagtaagaaagaatcaagtacatacctagcattgttggccacagccatctcttacctgtaagtgccatctactggcttgtaggttgaactgcacaacctaatataaaacctgccaacagatgtgcatagtgctatagaagcaaagccaaaaatcctactcagcattctctgcagtcccatcccctagtgagagaggaaagggaaagggaaagggaaagaaaaaaaaaaaccccaataatattacatatgaagacggaaaaaaatcaaaataattaccaaaattagaaatgccagcaaccccagataagaaggaggctgcataagaattctggcaccatgaaaaatctgaatgctgtgacactaccaaaggatcacactagatctctagcaatggtctctaaccaaaatggaaactcagaaatgacagataaagaattcaaagcattgatcacagggaagctcagtgagatccaagacaaggttgaaaatcaacacaaagatacttctaaagcaatccagaaaatgaaggaagagataaacatcctaagaataaatcaatcagaacttctggaattgaaaatctcacttaaggattttcaaaatataattgaaagctttatctatagactagactaagcagataaaaggatttcagagcttgaagactgctcttttcaactaacctgttagacaaaaataaagaaaaaagaattttataaagtgaacaaagtcttcaagaaatgtgagattatggaaagtgaccaaacctataaattataggccttcctgacagagaaggagaaaaagtaaagaacctggaaaaatatttgagaaaataatttaagaaaatttccctaatctggctagagaggtagacagccagatataagaaatccagagaacacttgcaagatactatataaaacaaacatcatcaaggcatatagtcaccagattgtccaaatatcaatgccaaagaaaaaaatcttaaaggcagcaaaaagaaaaggtcaggtcacatgcaaagggaacccaatcaggataactgtggccttctcagcagaaatattataagctaggagagattgggggtcttttttcaacattcttaaagaaaagaaatttcaaccaagaatttcatatcccaccaagctaagcttcataagcaagggagaaagaaaataatttccatataggcaagtgctaggggaatttttttgccattagactagccttacaagagatccttaagggagttctaaatatggaaacaaaaaaatgatacatgttaccaccaaaaacgcgcttaagcacatagcccacagactgtgtaaagcaaccacgcaatagaaactacaaagcaaccagctaacaacttaatgacaagatcaaaatatcacacatcaatactaaccttatatgtaaatggtctaaatgcccccagtacacttgtatgcaaatgatcgaaatgcccacaacttgctcctgaatgacctttgggtaaacaatgaaattaaggcagatatcaaaaaattatttgaaataaatgaacacaaagacacaacataccaaaatctctgggatgcagcaaaagcagcattaagaggaaaatttatagtgctgaacaactacctcaaaagttagaaaggtcttaaattaacaatggtctaagtgtcccactttaaagaaacagagtggcaagttagattaaaaaagacccattcatttgctgtcttcaagtgagccatctcacacataatgacacccatatcctcaaagtaaagggtttgagaaaggtctaccatgtagatgaaaaacaaaaaacaacagtggtaactactctagtatcagataaaacagactttaaatcaccaacagtaagaaaggacaaagaagggcattacaaaataacgaagggttcaattcaataagaggacttaactatcctaaatatgtgtgtacccaacattggaatatccagattcataaaacaagtacttctggatctacaaaaagatttagacagccacacaataacagtggggaacttcaacactccactgtcatcattagacagatcactgagtcagaaaactaacaaagaaattacggatttaaactggacatttgaccaattgaacctaatcgagatctacagaacactccacctatcaaccatggaatatacattcttctaatctacacatagaacatactttaggattaaccacatgcttggccataaagaaagtttccataaattcaaacaaattgaaataccagcgatactctcagaccacagtggaataaaaatagaaattaatacctagaagatctctcaaaactacatgattacatggaaattaaacaacttgctctcgaatgacctttgggtaaacaatgaaattaaggcagatatcaaaaatttctttgaaataaatgaaaacagagacacaacataccaaaatctttgggatggaaaaaaagcagcattaagaggaaagtgtagtgctaaacccctaccttgaaagttagaaagatctaaaattaacaatccaatatcacacctaaaagacctaggaaaaccagaacaaactaatcctaaagccagtagaagaaaagaaatatctaaaataaaagcagaactgaacaaaattgagacccaaaaatccatacaaagcatcaacaacaaaaagaaagttcgttgtttgacaaatttacaagaaaaaacaaacaaccccatcaaaacacgagcgaaggatatgaacagacgcttctcaaaagaagacatttatgcagccaaaagacacatgaaaaaatgctcatcatcactggccatcagagaaatgcaaatcaaaaccgcaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacatgtatgtttattgcggcactattcacaatagcaaagacttggaaccaacccaaatgtccaacaacgatagactggattaagaaaatgtggcacatatacaccatggcatatacactatgcagccataaaaaacgatgagttcatgtcctttgcagggacatggatgaagctggaaaccatcattctcagcaaactattgcaaggacagaaaaccaaacaccgcatgttctcactcataggtgggaattgaacaatgagaacacatggacacaggaaggggaacgtcacacactggggcctgttgtggggtggggggaggggggagggatagcattaggagatatacctaatgttaaatgatgagttaatgggtgcagcacaccaacatggcacgtgtatacatatgtaacaaacctgcacgttgtgcacatgtaccctaaaacttaaagtgtaataaaaaaagtttgttgtttgaaaggactaacaagatcaatagaccacaagcttgattaacaaagaaaagagagaagatccaaatgttcataattggaaactacaacagtgacagtacaactgatcccacagaaaaacaaaatatccacagagattattatgaatacctctatgcacaacaactagaaaatctagaggaaatgagtaaattcctggaaacacactctttccaaagattgaatcgtgaagaaattgaaatcctgaacagaccaatttgagttccacaactgaagtggtaataaaaaagcctaccaaccaaaaaagccctggagactttctttatggccaagcatgtggttaatcctaaagtatgttctatgtgtggacaagaagaatgtatatgccatggttgatgggggggtattctgtagatctctattaggtccacttggtcaagtgtccagtttaagtccagaatttctttgttagttttctgccttgatcatctgtctaatgatttacagctgaattatactagatgtacaaaaagagtgggtacgaatagtactgaaactattccaaaaacattgaggagactcctcctcaacttattctatgaggtcagtatcaaaccaatactcaaacctggcagagacaaaatgaaaaaggaaaactacatgccaacatcctgaagaacatagacacaaaaatcctcaacgaaatactagcaaacaaaaatcctcaacaaaatactagcaaactaaatccagcagcacatcaaaagttaatttaccatgatcaagtaggcttcattcctgggatgcagggttgtttcaatatacagaaatcaacacatgtgattcaccacataagcataattcaaaacaaaaactatatgatcatttcaatagatgtgggtaaggttttgataaaattcaacatcccttcatgataaaaaccctcaagaaactaggcattgagggaatatacctcaaaataataagaaccatgtattacaaacccacagccaacatcatactgaatgggcaaaaactggttgcattccccttgagaaccagaacaagacaagaacaagacaacatagtaatggaagtgctagccagagcaattaggcagaagaaagaaataaagagcatccaaataggaaaagaagaagtcaaacgatctctctttgaagatgatataattctatatctagatgaccctaaaaactctgccaaaaggctcctagaactgataaatgacttcagtaaagtttcaagacacataatcaatttacaaaaattagtagcatttctatacatcaacaatgttcaagctgagagctaaatcaagaatgcagtcccctttacaatagccatgaaaaattaaattaaacctaggaatacatctaatcaaagatatgagagctatctatgaggagatctacaaaacactgctaaaagaaatcataggtgacacaaacaagtggaaagtactttcattctcacggattggaagaatcaatagtgttaaaatgacaatactgccaaaataatctacaagtttaacactattcttatcaaactaccaacattatttttcacagaaaataaaaagaatttataaaaagctattctaaaattcataaagaatcaaaaaagagtccaaatggccaaagaaatcctaagcaaaaagaacaaagctgcatgcattacattacctgactaaaaactatactataagcctagagtaaccaaaacagcatggaactggtataaaaacagacacacagaccaatggaacagaatatagaatgcagaaacaaagctgcacacctatcaccctcagatcttccacagtattgtcagaaataagcaatggaaaaaggactccttattcaataaatggtgctgagatagctggctagccatacgcagaggaatgaaactggatccttacctgttaccacatacagaaattaactcaagatggattaaatatttaaatgtaaaacctcagactgtaataatcatagaagaaaacctaagaaacacataattctggacatcagccttgggaaataattgattagtaagttgtcaaaagcaattgcaacaaaaacaaaaatggacaagtggaacctaattaaactaaagagcttctgcacagcaaaagaaactagcaacagattaaacagccaacctacagaatgggagaaaatattcacaaactgcacatctgacaaaggtttaatatccagaatctataaggaacttaagcaattcaacaagcaaaaaccaaatagctgtgtgaaaaaatgggcaaaagacatgaacagacacttctcataagaagacgtacaagcagccaacaaaagtataaaacaatgctccacatcactaatcatcggaattataaatcaaacccacaatgagataccatctcacaccagtcagaatggctgttattaaaaagtcaaaaaactggcagggtgcggtagctcacgcctgtaatcccaacactttgggaggtcgaggtgggtggattatgagatcaggagttcaagaccagcctggccaagatgatgaaaccccgtctctactaaaaatacaaaaattagccgggcatggtggcgggtgcctgtaatcctagctactcaggaagctgaggtagagaatcgcttgaacttgggaggcggagattgcagtgagccgagatcatgctgctgccctccagcaaaaaacaacagatgctggtgaggctgcagagaaaagagaatgcttataagtcgttggaggatatgtaaattagttcaaccactgtggaaagcagttcggagatttcccaaataacttagaactactatttgattcagtaatctcactactgggtatatatccaaaagaaaataaatcgttctactaaaaggacacctgcacttgtatgttcattgcaattctattcacaatagcaaagacatgaaatcaatgtgcctatccatagttaattggataaagaaaatgtggcacacatacagcacagtagtaaccctccaggaatttcagcagcagggatagggcccagagaagagcacacatgatcattgacagggatcctgcatggctgcagtaataccagatggtaggccacaggatggacaggcaacacttggtgctaatggcactgggcatattggcctgtgatgcaggaaaagatccttacagtggaaatgaaaatggaattggaatggaaggagatgaagaattttaccagggaacctttaatatggcagcacagcaaaatagaggaggaagaggatgagggtgagatctgagtgccactgaaaagaggtatttgagttatgggagaatctatgaaggactactaagtgatgtgctgtggtgtgtataatataaacctactccattccttctcccaggagatcttgagcagagttttctttgctgatgaaagcttttctgtgagaggagtctataaggggaagttgaaaaagtgcagggcttggaatgcagagagaggtactcctacagctttccactagagagaggatataactcccatccgggtgaataacagcagcagattgagattttactgggtactgttttttaatcctttcagaggcctgtgaggtaagaatcagtgttgttctcattttggagagaatggaattggagtacaaaacagatgagttatttgttcctagtcttacatagtatggatttgaacccagcaagactgcctcagggtccatgtttttgacgagtgctttggacccagcaccactgtgtatcacttacacatgaattggagtgggtagcaaagtaattcccagttaaatccgagacgacagtcaaaattgtgcatgaaaaaaaagcatgagcaaattccaggaacagagaaaagaagccaattaaataaggaacaagagagaactgggtcgaagccaattaggaatagatagcagaatctaagggccctcttctgcctgaaaggcagccattgctctggaatccagagaactcacaggtgcaggaggcctccaagtgtacagaggacccttcctcctgtggaggtggagagagggatcaaaatgttatagaattatacgcaaaggtgtatctcactcctaaaaaaatgagtgcatgtaaatactggtgaaatctgataagatttgtattgtagataactgtattgtaccaatattaatttcattgttttgataatacatttatgtaacatgtcattactgctgtaggttggttgatgggtatacaggaactctccatttttttgtaacttcttgttagtctacaattcattgagaatgaaaagttaaaaaacaaccaaaaggtcagttcattgtatgaactacctccatggatactgaagtcaccaagaatgagaacatggggtatgcctgaaagaagtttgtaaatttggcatataggttagaagataatatgatatcttatatgaacttaaagtattcttacagtgaataggaaaaggaatattactgaaatcaaaataaccagttgcccagagagagccaacagtctttggttcaattttcaggtgaaatttcgctccagggctcctcattatggacaaaattgttagctgaagctgtgcaattgatgataccacaaactctcagggtggactctcctagtaacccccattctgaactgatgacatcacatctaaaccccatgcctggagcattggctgcaagcactgtcttcctgcttcctctgacctgcaagaaccctcacatacagccaagtcctactatggtgtttataaatcaagcgtgcacatataggatacagaatcagcaaagagctcggcctggaagagcaatcaatctggattcagaaggcctgagttctatatgctgaacagtgttataagagccattgatgcatttttttttttggaaaaatggaaaacaatagacttctttaccactttcatagctactttatactgtctcctgagtactcaaattgcatttgtcagctcccttctgtgagggtcaatctgaggggcatcctcactgcctgtgagcagcacagagcccactgtgatgtcccgtcttctcttggtggtctcttctgtctgcttgagttacctgtggaaagaataaccaatggcagagaagagtcctgagtttgtactgatcctaagttttcataatgaaatggttttaattgtggtaaaatttatgtaacatacattttactacgttaacgattttttagtgtataactcagtagcattaagtacattgccaatgagatgtaactgttaccaaacaaaaatttttgtgctcattaaataatgatttcatattctccccatccatcaccatcaggttcctcctaatctattttttgtgttcatcaattttcctagattagatactggaaaaatttgaacttacaatattgttcttttgtgtctggcacaatgttctcaaggttcatctgtattgcagcatgtatcagaattatgttgcaatgctaagctattatctagatactgtaattgacattatcatggaaatgtcaaataccttcaatcttgcttctgatagtgactggccatgaaactaactgaaagttacagccagaacaacttgtacaaaaatgggaagtatccagaattcctgtataattgaaggaatctgtcagcaaataataaatggttttaagataatttctacattgaaaccaatactgaggttgcaaatggccaaattagaactcatggggcatatttgtagactctacactcgtccctttgtccaggaaagctaaataagcacttactagttctgaaggggaaggagctgtggttatcttaacttgaaaccaaggccaacatgtcactgtgccatggacaaatgacagcacaggactttccataaaaccaatttcctagactgtttttatgaatacagagaatctgtctctaaggacattattttcccctgtatctgagaattcaatgaaattcagaggcagcagaactcacttatccagaatgagcttcctccctgcagcaatacccctaatcatagaagggaacatggtttttaggtgaacatagtccgagagaaagataaggaattttcccttggatactgtccggtaggaaatagttataaaaaaaaggttttccagttttagacaggaattctttccattcccataaaagttgaacgtgaaagttttcagtaagaaaaatttaatggaagataacaggggaaatttgttggtaataggaagaaggatctaaacagtgtactttcaaattaatgatttctctgagtaaaactagaaatgtgagattaaaaataaaactatttgaagatattgagggaatcacaggcatttctgaggcagaaagatgagaaaaacacatataattgtcaaggtggcagggcagtgtttctctcaaagtgccgtctgactgacagggcagaggctcttcctcatggccccaatctgcttcatgacagctccagggtttcctcagaaagccgccatctgccttcttccacctcaggcgtgtcctgcagagccctctggagaaccagctagagagtcttcctgttttgaagctgcctaaaggagcccatgaagaagtaaataatggggttggcactgctgttaagagtggacaggaaaatggaaactagacgaacgtgacaaatccacgtggatccagaaaaataggaatcactgaatgccaaagggcaggtcacagaggaggaagaccagcactctgagcaggatggtcatgtacagcctggtcaagggcatcttccgggatccacaaaggatcctgaccagcaggaccgggctggacccgcagagaaccacacataaaaaaatcagccatgtgactgtgatgaaatctgatgtttcacaccaaacagaatcagcaccactagacaggaagccacagaacatccattccaggatgctctgcagcagggacagggcccagagcaggacacacgactgctgacaggtgtgtggggtggtggcagcggtactagatgggccacaggatggacaggcagtgcttggtgctgatggagcccagcatgctcaggcctgtaaagtagagaaaggtcatcacagtggtgaaataggtggagatggaaaggaagaagtcatggtagaaattcacaatttctaaaatctgggagcagaggaagaagtcggccccggccaggttgagggtgtagagggagaaggtgttcctgtgcaggcggaatcccaggagccagaggaaatgactgcatttcctgccagctggaccaggtcaacgatgaggagcagcaacatgaggatcatgatctccatgccacaatgttgaagatgggtctcctcggtcctattgattgatgtcagttctgtacccaaggctgggatggttggatccatgcacagaaaccctagtctggtgcccctgggaacacaaaaaagatgtgatcagcagctgtgtgatctctgatttcacatacattctattatatgagaattattgtccccattttacagaggagagaaacaggcttgcagagaataagccacctgtcaaaaggtgaggagtgctgaactccagtttcaaatccagttcttggtgactctaaagcctgggctctctctattgcaacacaatttctctactgacatgggaataacattatgatgaaaacatccccactcaactggccagggctgtggatccaagcattactcggtcctggtcagaaattttctctcgagtgtaggagtttggataaagaggtggacaccttcatgataaaagtggtcatcatggatgaaaatgaaggttaggcattatttacatgaggaaaatgtgacgtcttgctaggacaagtgtgatgatgactgggcctggtgagctaggaatggctcagtgtgtgtccgtcattacagagaggagcacttttatatccccagtgcctagctccatgtggaacacactgtgttttgtgtaaatattcattcagtgaataaatgcatgaatgaagagcctaatggtagtgatagctttggattaaaaggaaaataaaaataaaaacacaattaaaggtgttggaacacccacatataatgagatgtaaaaatttcattcatcagaattttatttgttccgtctgtgttaaaaggcattactgatatgtgcccaaatacctgaagttgactactgatgtgcctttgaaatgaggactcagtgtggctttgctgagcccctagaatctcttttgtacacagtgttggggtagggtgtggtctgagctgaactgctcagcaatatagaaaaagaaagagtaagcgtgggtgaggtctgagtgccgctgaaagaggtaattgaaatgtagcaatatctttggaggactcctaagtgttctgctgggtgtacacagtgcaaaacaacttgattctgtctcacaggagatctttggtagactttctctgttgatgcaaacatttgtatgagaggagtccatgagaggaaataggagttcagcgcttggaatgaaaaaagagatgttcatgtagatttcaactggtgaaacaggactagctcatatctggctgaaaaacagcagctgattgagagtttattagggattgtcttaatgctctcaagagcctaggaggtaagagttagtattattcctatatggcagagaatgcaattagagcacaaaaagagtgagttatttgtccctggtcttacacagtgcggatttggacccagcagagctgcctcaaggtctacccttttcaccagccctttggacccagcaccactctatgtctattatacatgatagagggggaaggcagaggaatgactctcaaatttaacccaagttggcagtcaaaagtttggactgaaaaaaaaaaagctaacctaaacaaactccagatagagaatgagaagcaaatcaaatagggaaccaaatagagttgagtgaaaaccaattaggaacaaattgaggagctcctttctgcatcacaaaggctgcctttgttctggaatgccaaggatgcacaggggctggaggcctccaggtggaaagaagacacaccctcctctgggagtacaaaggagcatcaggagtggatgcatccatcctgagctctcttagagatacaagctgccacagccttcgttgtcctgaaaaggaaattaacggaaaaccagaacctctgttaaccacattgaggacacttaagattaagagtttgtccgcttatttttaggatatgatatatttgtcttccttacaaaacctgaagctccataaaaactaagctatgcctgttctggttcactgtagtattgccagcatttagcctgtgttcctcaaagaccatctattgtaatatcctcctatgacacaagaagctgctgaggcttaaagaatcaaaggatcttcctgagatcacactatgaagagcagatccagtataagctcctggtccatggagccctgcatgagacttctctactgttttctgcttcatcaatcattatttttgaggacctcctgaaaaatcttgatgtgagcatagaatctgagataatcaggagctttagagcctactccattgccccatatccattttccttttcagtcaaacaacaattctgagcatttaaaagcagcacaaggacacacattccagttttcctggatgctggatgacattgtatgaccaggttctggtcaatgggaagtaagaagatgtgatgtaagcaagtcctggctcatgggatcaatagaaggagcacagccttcccttcccctcttccttctccatcaggctggaatgctgaggtggttggcaggcagtaggaccacaagaatgagggcaactctctagacattagggagcagcaatttttggagtcctaatgtctgatgccttggagcctccagctcaggtcttaaatacagtcactcctgagtatccacaggggattggttctagaacccctgcacacaccaaaatctgcccatgctcaatttccttatagaaaatgatgtagtatttgaatataacttatgaactttctcctttatactttaaattatttctagatcacttataatacctattaaaatgtaagtgctatgtaaataattgttatatggtattgtttaggaaataatgacaagaaagaaaagtctgtacctgttcagtacctatagagctactcctgtcctcctttttttggaatatattctacctgtggtttgttgaatctagggattcagaaccaactgacatggagggacaactgtactttcttgtttaagatattcctacttcgtgtttcttttagagcagccaaacttacattctaacaaaaaggaatatgttttctctttttaaaattacatttcacttcctaggcatttttgataaatgcaggtatttctccataaaatcgacaatagagaaagaatttccaaacataaaaaaaactctgatagagattaaatgagacatgattcaatgagatttagagagagaaaaccccaggaggtaggaggaagatataaaaaggtgagtgggatagtttcatttgccttgaggatttgcttcccaatcttctctaccctgtttgacatcccaagagggtggcttctctgtacctcatcagtgatattcttttccttttggtttctggttgaactgagacactgagagacactggtaggagactggaaggcaggaggggagtgatttggaattttcacctcctgggcctctgcctttgtgactgtgtgttggtgatgcagggcttctccacctgcctgctcatcctctcccaaccctacagctacagctatggctatggctgtgctctcaatggtaactgctccttccctgtccctttaagcttaggggaggaagtagtgctacaccattgccatttagggtgcttccctaggcattgtcttttccccttaaccctgtccatctttgtacatagtcccctcatgaaacactcctcatttatttcattttggaccatctgtttcttccttagacctttccagataggcaaagaagaataactttgaaaagtaagtaaaataataagaccccttaaccacagctcagctgtaggaaggaatgcctgcatatccccttgctccttaaatgaatttaaaaagcatcattatctccatgaaagcagattgaatagttggaataaagggggtgatatggagagatggatcagagggagaaagctctgctgaccccatttgaaactcccgcagtctgggctgccagcactcagtttctagaaggaagcttcatgtctcctgccttttcttgaaggaaacttatgaacttctgtatgcagaaccccaaggtggaaacacaggtttgtgaacttatagcagaaacaataacttgctgtggaaagaagagagttcttggtacatacccttacctttcctccttcttcaagtccaaagataaagagctgccccttgctaaaggggtagagcctttctgggattccgtgacttcagagcactattctgtgttgtgtcatttaggagatgcctacaagagctggaatgagaactggcaaccaacccaggtttatgaagatacagacagcatgtgatttcctgtatgaggattgcaggcaaatcagaagccagagctgtttgagccacgatccctaactgagatgtttcttggcctctgtcccattattaatacatatctgcctctctcatcatatcccatctcattcaacttcctgtaagtaattgctgttttgaacttttacaatttattatgggcctaggtatcaatgtcaagcaacgtgagcttgttttgtgaggctttataactaaaaactaaagtagatcatagggtctttcagggcttgcaatggcttgatcccactctgtgtgtgggtttggttttctaagtccatgattattttctgttcaaagacaaagtagaaaactcaagagtttaaagttcatgtggaaccaaaaaagagcctgcattgccaagtcaatcctaagccaaaagaacaaagctggaggcatcacgctacctgactttaaagtatactacaaggctacagtaaccaaaacagcatggtactactaccaaaacagagatatagaccaatggaacagagcagagccctcagaaataatgccacatatctacaactgtctgatctttgacaaacatgacaaaaacaagaaatggggaaatgattcccttttaaataaatggtgctgggaaaactggctagccatatgtagaaagctgaaactgaatcccttccttacaccttacacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggttctaattaaactaaagagcttctgcacagcaaaagagactaccatcagagtgagcaggcaacctacagaatgggagaaaatttttgcaatctactcatctgacaaagggctaatatccagaatctacaatgaactccaacaaatttacaagaaaaaaacaaccccgtcaaaaaggaggtgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtacgtttattgtagcactattcacaatagcaaagacttggaaccaacccaaatgtccaacaataatagaatggattaagaaaatgtggcacatgtacaccatggaatactatgcagccataaaaaatgatgagttcatgtcctttgtagggacatggatgaagctggaaaccatcattctcagcaaacgattgcaaggaccaaaaaccaaacacagcatgttctcactcataggtgggaattgaacaatgagaacacatgggcacaggaaggggaacatcacactctggggactgttgtggggtgggggaaggggggtgggatagcgttcggagatatacctactgttaaatggtgagttactgggtgcagcacaccaacgtggcgcatgtatacatatgtaactaacctgcacattgtgcacatgtaccctaaaacttaaagtataatttaaaaaaaaggaaaaaaaaaaagaaaactcaagagtggaaaatgttaccttgtagttcacactcttttaatcccttagtcccataaaattaacattctaaagtgtaagcagtagaaataatgtaaactctattgaaacttaagtaaattattttttttcagacttggtggaggtccttttgctgaacactatactctgttgtgaataggatacaccttcaatgaggaagaaatccttgacctatttcaccatttctccaacattgcataaaggacatttttaaaattcagtttcttctctaactgcagcaaaaaggcaaggaggagtctgtttcaggaacctgaatcaattcctatgaaagccttgttcacttagaacaaggctttaatttgttctgtttccatatcaaggtctatgtcatgaaagcagggccaagtggcagtcctggcacgatgctcattgttctaaccaaagggccaatgaacccagcacctatgctggccttgacatcactgagaggtacaatgaagtcccttggcacaattttttggcaggttggtgagacagagaaaggtgggtccttgccatgcagatgggcaaatttctgaaaccctgttgagtgttaacaatctattttggtttgtgcctcaggagagagctggatatcgttggctccatagacagccagggccatggttcttatcttttccacaattggaagctgaacatcatacgggaaatggaatcaacttcttttacttgcagcttctctcaaagcccaagccaagtccgcaaccgttttctaccaactgaccagtgatagcaagggactgcatcaaaggcaccagcccgttttgtgagctcacacaccaagtcaatctcagcaccggtgtggatcttgaagaccttcagagtcaccataatgggaaccccaaagagctgagcaatctgaatttgctgctagaggttacggcagccatctgccaccaactggatgttcttttctttatgttctttcttcagaggaacaccagcagttacacttggcccgccactgtgcatcttcagagcttgcaccgttgccaccaacacaaccacactgggcaccaagctggaagcttgacacttgttgaaaaatttctccatttcaatgtcagcaccaaagccagcttcagtcactacaaatccttcttcaccaaccagtttcagggcaattttgtcagccaacactgaagaattgccatgggtgatgttagcaaaagggcccacgtgcatgaatacaggtgtccattccagggtctgcatcagatggccaccaccatccttcccagccatgtcttcatgtctgagaggctgttcataagggccagcaccaccatgatctcgctggccaccacgatatcaaacagcgtttgccaagaggagcctttctctgtgtttgcctgcctgatggttattttttgtagaaatcagttgtttgtatttttttaattaaatttttttatttccataggttattggggaacaagtggtgtttggttacatgagtaagttctttagtggtgatctgtgacaaaacggggcagcctgtggcactgatgatttgggggtgactggtgctttgacagttttgatgaaagatgcaatgaaatcaaatctgtgagattttggtgcacccatcacccgagcagtatactctgcacccaatttgtagtcttttatccctcatccccttcccaccctttctccctgagtccccaaagtccattgtgtcattcttatgcctttgcatcctcatagcttagtttccacatatcagtgagaacgtatgatgtttggttttccattcctgagttacttcactttgaataatagtctccaatctcatccaggttgctgagaatgccattaattcattcctttttatggccgagtagtattccatcatatatatattagtttctttacccacttgttgattgatgggcttttggttggttccacatttttgcaattgtgaattgtgctgctataaacatgtgtgtgcaagtatcttttttgtaaaatgacctcttttcctctgggtagatacccagtagtgggattgccagatcaaatggtagttctacttttagttctttaaggaatctccacagtgttttccatagtagttgtacttgtttacattcccaccggcagtgtagatcactgtatccatgccaacatctattttttttgtagaaatcggtcatttttattcaatactctctgccatgcgatggtggaagggtcggcgtcgaggcaggcaaatttactcatttcctcttctgtcagtgtgcttggatctgtcttatttattcccagtttttttttagtcaagtaatcagagaatttctgaaaattctgtgacaccattcattaaatgaatcagctgattatacagagccttgtctgtgcattttcatgcagaatccttgggtcgatgacagcagctggtgaattattggcaactgtgatggcatggatatctccagtcaagtgaaggttgaactcttccatgggatgaccagggcatatccactacccatgactccttctttccactccaaaagtcggtccttgggaaggttgcctcatacaggcaaaagaggtgacatgcagatgcatggtcagagcctgcacagcccagtcataactgtgctcttcccttctcctagaggagtgggcgtgatcccagtgactaagatgtattttccatctgcttgatcctttatcctttctagcacagacaaaaactttgtctttacttttgccattgattttaatttcatctgcaagcaatcccaactcattatgggtaaatggatcagtagaaaggtctgcttgactccatttggaactcctgcagtctggactgccagcctctcccatcccatcccatatggcccacctccctgtaatcaattgttgttgtggacctttaaatgtccactgtgagcctaggttcaatgtcaagcaatgtgagagtgtattgtggggctttataaatgaagaaaaaggtatatcagaatgtcatccaaggctcaccatggcctgaccacaattgacttttttctttcatatatttttaaatcacagtggttattgcattcatatgtatactttcattccaacaacagagaagtgcataaaaagtgaaagtctcccgagtctctttctcgaaaagccactacttgctacactttccattcttatttgatgatgattattagctgtgaatagtcagcttatatttgtgttttgcatttattagtattatcaagtggatcaacttacttttcttataagatgtaagtagcacacatagaatatctttctctacttcatgatatttgttgtttatttttatttagtataaatattaaaattttctagtcttatttcatatgacttcccttcatttaagttattttaattagaaactatttcagatattcagaaaacttcttcaatatatttgtctttgaggagagtgcatggaattttgaggatctggaataggatgtcaactttcaatatatgcaggaaaagaatttgtttgatatgtgtgagtgtactattttcaaaataaattttcaaacacaaaaaataaatttaatgatgtagctaaaagaaaggtaaaaatttgaaaagatatgacagaaagagaaagttaattggtggtgagaaacttaagaaaatgagtatagaaaactcttctgaagagattttctgtaaaggaaataagagaaaccaggtcatggatgcatggatggaggagaatgtggactaaggtggtgatttaagccaggggatgggatagcctgtttgtgctgcaccggaatgatccaatagaaagaagcaaagggagacgtggtcattatgcacagtgtttcagtgcagagaggggtgttttctttatcaaagtggtggtattttagcagctggtgttttctttatcaaggtaataatgcattcaggtgtatattttctttacaaatggcagagaagtgaattcaaggtcaaagtgtccttgaatcctattctccagaggccaccacttgccatagtttactttttttttattattatcagctctgaataatacacttatatttcattttaatttgtcagtatgaacaagtggaccaattgatttcttttacacaatgtaaagagttcagcactcttattttctttctctgtctatttaatgtcatttgttctttatatttgttagttgtgaattttcataattttatgtctttcctcttatgcttgcattcttctgcctcatgctacagccaaatcaagccacttgcattttaaataatacaatttgaattagattctatttcaaaaactgagaaaagttccttaatggattatttcagcaaatatgtaataaggactttgttacaggcagtattttgtctctacaatgttcatatgctaatgttctaacacctaagtcagaatgctgctgtataatatttgaaaacaggcacttcaaggatgtaagtaagttaaaaagaggctgttagcttgggccttaattcaacagaactggtggtcctataataggagattaggacacagacacacagaggtaagaccatgtgaagagacagggaagagaagatgccatccaaccctgcccacaccttaatctcagacttctagcctccaaagttgtgagaaaatgaagttgtgtggtttaagccacccagtttgtggtaccttgttgtggcagtcatagaaaactaatagagatgtaccatgtcttaggatttttttcaggcacttgagttgcagttgtgaataaaactataccatgggcttctggagtttatttccaaagggctgaatgaatgccctcagaaagtaaatacagactgaaaagagaagaggtctgaagtgtcttcatccatgaaacatctggagaagctggatccagcaaaccatccatagagaaacttaccaatggagaaaaagtcttagaattagacagaaatacatatgagaatgtggtatatgataaaggttgcatgtcaaaattttgaggaaaacatgtaaagaagcaattgtgggggagggaagaaagctaggaagtacagtgtttgataattttaagccatggagttattggttggtaatagtgtcagtagcggctgagcagttataaaattgacccttggtgagaagcatgggagtcattgctgatgtcaatgtggttgcagaggaagaatggcccaaacactaactggagaaggtgtacaagagaatggcaggtggtgtgatgggactcctggacaccacagactccagctgaaacactgtagagaaggagacagtgaaggcaggtagctgcatgccatgttactgtataaacaaccagcagcgtttctatatacaaaacaggcagtaggaagaaataaaagaaaatgaacctcaattacatcttctgaaaaagaagggtaatgagaatgcttaaaatctagtgtaagttttgaataagaacaacattccaatattgattcatatatggaaaagtagatcaataaaaacatcacaagattagacatgaatacgcattgaaatttagtataataaaggcgatatactgaataactgtgtaaaacatggactattcaatgaatgggactgggatactgagtggtcatctaaaataaaattaagttgaaaatatactttacgtatgattttgggataaatacagatacatgaaatacttttataatgaaaatataagaacctaaagaaacataggaagatgttttttttaagctcccagtggggaataactttcaaattacaggacaaactttagaagacattaaagaaaatattaataaagacaaaaacaaagacttcattggcatggcatgaatcatcataatgaaaattaagctgggaaaatattgataatgtatatcatagcttaactgctaaatttcccaatttataaaatgtttctgtaaaatgtcagttcaatatccaaaaagctaataagaaaatgactataggtcatgatttacaatttctagaaagtaaaaaggggtcttaaagacatggaaagatgagaataccaactcttaataaaagatatgcaaactgaattgatacagagttttattttacttaccaaaatgtaaaaagccaaatgtttggatagtgtatagcatgtggatgttatgagaccaggcactctccctcatttctgccgggggtgcaaatggataaaataacctccagggaagatgattttcaacatatagaaatatatataaagtatcatatttttctccctataattcttcatctaggaatttatcctagagatatacttgtgcatgttgaagatatatatatatatatatatatttatataactttgtgtgtatatatacacacacaaagttaataaatgcagcatttttgcaataaaaaatggtaacagccaaaatggccatcaatactgtataaattatggtctattcgtatagtagaatactctgcgacagtatcaaaagaacaacaggctgggcatgttgtttcacacctgtaattccagcactttgggaggccgaggtgggaggatcatttgcacccaggagttcgagactagcctgggcatcatagagagaacccttctctacaaaaatgaaaatattagctaggcatggtggcttgcacctgtagtttcagctacttgataggctgacgcaggaggattgcttaagcccaggagtttgaggctgcagtgagccgttattgggctactgcactctagctagggtgacagagtgagatgctgtctgagtaaatgaaataaaataaaaaaacaagaaacctgatatgaaaggggcttcatgatacatcaaataaagaaaaaagaatgcaggccaatgtgtattttgtatgagatagactatatatatatatatatatatatatatatatatatatataatatatatacatataaatatataaacaagtatatagttgttttagcattaagtgtctttagatagattaaaaattaaaaactataaaaatgtatatgtctttgataatacggtaaagaagcccgagtacttggaatgagaatgaccattttcaacgtatgcgtgaaaaaattttttgaaacctgtgactatattactattttaaaaagaaatttttaaaaaaatatttcaaattttattttaaaaataaattttaaaataaaggaaataaatgtacagtgataaatgcaatgatttagctaagaaagtgaaataggaatatgagaagaacacacataaagagataatgaaaaggttaattaggtgggaaagggagggggagagagagagttaattggaggtgagaaaatgaagataaggagtgtagaaaactcttctgaagtgattttctctaaaggaaaaaagagaaatcagattgtggatggagggaaatgttgacttgagtggtgttttaaggagataggatagcttatttatactgtgctgaatgacccaatagaagaggaagcattgaagaagctggagggagaggtggtcattatacacagtgtttcagggcaggaaggggaaccagcacacaaggggaaaggacggttaaggacaggagcgtgcagagcccattgcctgacttgggagggaagacagagaaatgagctcagagaaatgagctcagaggcgaactgacaggtaggtttgttgtgggggagatggggtaattctcggcagagcatcacaagagagcgataaaagagtgaggaggtggtttcaggagagaggaggtggtgtgaagagtttccttggagagtgggaagcaattatggaaatgttacatgattgttcaggagatacaagtgaatatttgaggctcaaggtcataaatgtgaagtgaaaccattaggcatggtagtgtgttgttctccagccacactcagatctgtgagaagagatatggagttaataggagagctggattcaacgaaggcaaaagacagatgcttcaccaaggagatatatgcatggcaaataaaggcataaaatgatgttcaacatcagtaacctttaggaaaatacaaattaataacacaaagagatactactacacaccttttaatatggctaaaatacaaaatattgatagtttcaaatattggtcacgatttggagaaattggatgttttataccctgccagtgagagagtaaaatggtagagctactctgaaaaactcttgcattaaaaaaaattaaacatagaatatttgacatacaactcagcaattcaattatgaaatttatcctagagactagaaaactatattcattaaaaaatctatacacatatgtttatagcagctttatatataaaagacatattagacaaaaatgcaatggccttccacttatgaatagtgaaacaaagcatcagaacaaagaaatactactcaaccatgaaaaaaatcaacaacaaattactaatacctgcaccaacttgggtcggttgaggacattatgctgagtgaaaaagccagactcaaaagattaattgttgtatgatttcatgtttgtaacagttttgaaatgacaaaattatagaggtgaagaatagattagtggttagaagggtttgggaagagacatggggtgggtgtgataatatgggtcacccaagggaattcttttgtggtgaagaaacactcccatatcttcaatgtggtggtggttaaatgaatctatatgtgtgacaaaatgttatagaattacttgcaaagacatatcccactcgtaaaaaaatgagtgcatgcaatcactggtgaaatcccataagatgtatattatagaaaattgttttgtaccaacatcaatttcctggttttgataataaactctatctatgtagcacgtcaccattggtatatattaggtgatgggtacacaggaactctcagtactatttttgtaactttttgttagattacaaataattcagaatgggaagataaagaactaaaagttcagttagttgggttgactacgtggatattgaagtcatcaagaatgaggaccagagttatgctcgagagaaacttgtaaactagacacacaagccataagataatataataaacattcacacacccaccactaaaatgatgtatatatcaacattttgtcatatttgcttccaatctctcctaaaaatgaatacataaaaatgtactgatacaactaaaggctcaaacctgcatctctcactgatcttttcgaaacttctgaagctaatatgcattattctctcacgtgtaataacatgttaaaacaggaattttaattgaaatatcaagatacaataaatatgtattataatggaggtgcaatgtgacatgttgaatttcggtacaaattttctgataataggttaccaacttgtaagcaatcatccatatcaaggctatgaaaaagtttagagttgaatttttatgtgacaaataaaatattgaacttaatttaaaggtgacctatcttccacactgtcaatttggaccttttgcggcaaaaatattatataagaggagtgtgtacatttcagtgtttctcactcctaccttaacttccacacttgtagttttttatcattgccttctgacccttaagtgttggctgtatccctgtgaggagggtcaggagagcaggacattgcctttttggcttgtcttgctgggctgacctggctggccctctctggaatttacaacattgtagagttctctcaaggtaatatagtaaaactaattccaagccctgtcacatgaagtccacaacagacattactcaatgttcagagtactctgccttatgatccttcttacacgggatcttgtaagcacaaccaaacacttggggtggcgcaaagaataaaacgcatgacatactaatcaccattccttaaaaaactccatgcttttattaacagtgccatcataaatgtcctcttctttcatttccatctgaccaaatcttactcacgtctccttgaccaacagaaaaatttatgtgactggcagaagtgacagaggatacatactgggtaaattgtagagtcatcagttcaaattctaaatatttcaagaagccctccctgatcgcacacacacttactaatgatatcttctccatctcttctctccctcctttgtgtttgcatcctgcaaggattcaggatagttttaccaatatgttgggcatgagtatggggctctcttctatactctatgtcactgctaaataacaagcaaatcccatctgtatctatggccagcattggtgcattggcaatatccctgcccagtccattccacacaatcataaaggaggagcatcccagcaatctcttcgaattctgggtaactgccatgtaggtgagaagaacatgtgcttattatgatcacagtcactatatagagacatgaactgttcaggatgcctggatcacaagagtagttattttcagttcacagatctgataatgtcaaaccttaccactgtatttttaaagcagagacttgagcacaaatggcataatgtcagtctggggcaatctcataacctcactatctgcttggattgcctggaatgagcatgtgccccatgttgatcatgcagtcggcttgagaatcccagttccacgaattcaggttcacagtgttcttttcattctagcacttgaagattctgcatcccttcaaatgctaggatttcttgatgctgagctgggcttggctgtaggcaagggctttatatgctggacacgtggtagtgggaatagttagtcttgcaacacccatccatgccctaagcacctgcagggactcttctgctgtcttctgtccatccctgtgtttgcatcctgcaaggattcaggacaattgtaccaatattatgggcatgagtatggagatctcttcttctgtactctgttgttactgctagataacaacaagcaaatcccttctgcatctatagccagcatttgtgcattgacaatatttctgtccagtccattccacacaatcataaagaaggagcatcacagcaatctctttgaattccaggttccacaaatacatgctcagtatgtttttatacagtgaacagagaatgagtgagtgagtgagtgagtgatattgctataaaaagtttacttaatgatacattgaggactgttaaggtggataggttaattaaaaatatctgttaaccagcaattataaaaagattacatttgtaagaaaaaaatttcatttttacctagaattaattcactagaaaaggactagactgaagggctttccattctgcaggtttcagcaaatagaattccactctgtctgtcttacagaaggcatagctatcaatcactttttaggatttccagtttaaatttgtgtaagtgtagattttttatctttgaaacttctatttatttatttttctttattctagaaaaagggggataatgtgtagaatgtgcaggtttgttacataggtacacaggtgccatggtggtttgctgcacctatttacccattctctaagttccctctcctaacccacatcccccaacaggccctggtaatgtgtttttcccctgcctgtgtccatgcattctcattgttcagttcccacttacgagtgagaacatgcggtgtttgcgtttcttttcctgtgttagttttctgaggatgatggcttccagcttcacatcctgcaaaggacatgatctcattcctttttatggctgcatagtattccatggtgtatatgtaccacattttctttatccaagctatcattgatgggcatttgggttggttctgtgtctttgctattgtgaatagtgctgcaataaatatacatgtacatgtgtctttatagtagaatgatttatattcctttaggtatatgcccagtaatgggattgctgggtcaaatggtatttctggttctagattcttgaggaatcaccacactgtcctccacaatggtcgaactaatttacatttccaacaacagtgtagaagtgttcctatttctccacagccttaccagcatctattgtttcctgactttttaataatcaccattctgactggcatgagatgatatctcatgaaaatggccatactgtccaaagtaacttatatattcaatgctattcccatcaaactaccattcacattcttcacagaattagaaaaaactattttaaatttcatatgaaatcgaagaagaccctgtatagccaagacaatcctaagcaaaaagaacaaagctggaggcatcacactatctgacttcaatactacaaggctatagtaaccaaaacagcatggtactggtaccaaaacagacatatagaccaatggagcagaacagagacctcagaaataataccacacatccacagccatctgatcttctacaaacctgacaaaaacaagcaatggggaaatgttctcctattcagtaagtggtgctgggaaaactggctagccttatgcagaaaactgaaactggactccttccttacaccttacacaaaagattaactcaagatggattaagacttaaatgtaaaatccaaaaccataaaaactctagaagaaaacctagtcgataccattcaggacataggcacaggcaaagacttcatgactaaaacacaaaaagcaatggcagcaaaagccaaaattgataaatgggatctaattaaactaaagagcttctgcacagcaaaagaaactatcatcagagtgaacagtcagcctacagaatgggagaacatttttgcaatctatccatctgacaaagggctaatatccagaatttacaaggaacttgaacatatttacaggagaaaaacaaccccatcaaaaagtgggtgaaggatatgaacagacacttctcaaaagaagacatttacatggccaataaacatatgaaaaaaagctcaacatcactgatcatcagagaaatgcaaattaagtgtagatcttaatatcagatatattgcattctgtctgagaatatgtttcaattgtgttcatctatgttcagtcttgtttagtagggaggcttacaactaatgcactaacagtaattttgggacttgcttttctcttcctttaagcatccacattactttttattgaaaccacaattgttctttaatactcatatttcattgatatgttgtgtttagataaattaggtaattacattggcaagtctaattggcataagcaggacaggaaacagatccaattggttcttgtgaagctgatgtctcagtgctcttgagcccaggtgtacaggagcatcagtgaatgaccatgagggctcagtatttactccgcatcaaccaatacattttctagatggaatggataggattggttatacagatagagtctgttagccagagatgtattggaaaggtttttacatgtatgtagaattaacacagtgcctgatgaattaggtttaaatgtttgttgaatgcatacataaaaaataatcatgaatggcagctcccaaaatgtgccatgagggactttcatatcatttctctcttcttggaggaaactcttggatgtcctgcatgctcttcttcaacacgtaaattagaggaaatgatatcattggccttggaaagaaggcagctcctgagcagactcctgcatctcctgtccccactttcttctctccggagtcagtgagcagacctgcaatgaaagggaagagctgttctcaaaacaaccaactccagaggacactctcttctcttgagtggaaggttcctgtaggagctccagtgagacctggtgactaacacatcctttgcaagatgctagacaaccctgtgattttcaggtgggagctgcttgagaaaaatagttgccgagcatcttgtaaattccacgcctagtctgttgcgctagaaattcaaggaagtgttttctgctcttaaagaccttacagtgtggttgaagagcaagacatgaggacaaatcattcaagtacactcttataagtgctatagtagagcaatgtgtggggccaaatgagtccagaatggccttcaggggctgaatataagctttcaggagcttaaagtattcttatagttaaaagaaaaaggaatgtcactgtcaacaaaataaccagtttcccagagagggccaacagtctttggttcaattgttaggtgaaatttctctccatggctcctcattatggacaaaattgttagctgaagctatacaattgatgataccacagactcaaggtggactctcctgataacccccagtctgaactaatgacatcacatcaaaaccccatgcctggagaattgactgtaaacactgtcttcctgcctccttgtacctataggaaccctcacatatagccaagtcctactatggtatttgtaaatcaagcatggacatataggatacagaatcagcaaagagcgaggcctggaagaggaatggatctggattcaagaggcctgagttctataggttgaacagtgttgtaagagccatcaaaaatattttttttgaaaagtggaaaataatgggcttttttgccactttttaagctactttatactgtctcctgagtactcaaattgcatttgtcagctctcctgtgtgagggtcaatctgagggacatcctcactgctgtgagcagctcagagcccactgtgatgtcccatcttctcttggtggtctcttctgtctgcttgagttacctgtggaagggttaaccactggcagagactagtcctgatttgtactgatcctaagttctcataattaaatgtttttatttgtggtaaagtttatataacatacattttactaatttaaccattttcagtgtacaatccagtggcattgagtacgttgacaatgagctataactattaccactccctcttttaagaacttttcattatcacaaacaaaaattttatgctgattaaatcctgtttacacattctccccattcctcaccatcaggttcctaatctattttctgtgttcatcagttttcctagtttggatacttcaaaaatttgaacttacaatattgttctttagtgtctggcttatttcacttagcacagtgttctcaatgttcatctgtgtcacagcatgtattagaattctctaacaatgctaagctattatcaagatactgtaattgacattatcatggaaaggtcagatatcttcaatcttgcttctcatggtgactagccatgaagctaactaaaagttacaaccagaacaacttatacaaaaacgggaagtacccagaattcctctacaactgaaggaatctgtcagcaaataataaatgatttcaagataattttcacattgaaaccaatactgaggttgcaaatggccaaattagaactgatagggcatatttatatactctacacttgttccttggtccagggatagctaaataagcacatactagttctcaaggggaaggggccatggttatcttcactggaaacctaggccaacctgtcaccatgctgtggacaaatgacagcgcaggacttttcataaaaccagtttcctggactgtttttatgaagacagagagtttgtctcttgacattattttcccttatatctgagaattcaatgaaatttagaggcaacagaacttacttatcaagagttgagcttcctacctgcagcaatgcctccaatcatggaagggaacatgattttccacggaacatagtctgagagataaataaggaatcttcctttttgacactgttaggtaaataaaaattatgaagcagaattttgcagttttgtgcaggaattctttccattctaatgaaaattgcaaaaaaaaatgttttcagtaaaaaaaattcagtggaagaaaacaggataaattgattgctaatgtgaagaagaatttaaacattgtaccttaaaattaatgctttctctgagtaaaactagaaatgtgagattaaaaataaaactatttgaagatactggggtgtcactggggcatttcagaggcacaaagatgagaaaaacgcatataattgtcaagagtggcagggtagtgttgctctcaaagtcccatctgactaacagggcagaggctcttcctcatggccccaatctgcttcccgacagcttcagggtttcctcaggaagctgccctccaccttcatccacctcaagcatgtcctgcagagccctctggagaaccagcttgagggtcttcctgttttgaagctgcctaaaggagcccatgaagaagtaaatgatggggttggcactgctgttaagagcagacaggaaaatggaaattaaacgaacaacacaaggtaagtcatccaaatccttctcgatccagtataataggaatcactgaatgctgaggggcaggctgcagaagaggaagaccagccctgtgagcaggatggtcacatacagcctggtcagcggcatcttctgggatccacatatgatcctgacaagcaggaccagggtgaacccacagagaaccacagattaaaaaaatcagccacacagcagtgaggaaatctaatatttgacaccaattatcagagtcaacatcactaaacaggaagctacagaacatccactccaggatgctctgcaacagggacagggcccagagcaggacacacatgaccgctgacaggtgtgtggggcagtggcagcagtaccagatgggccacaggacggacaggcggtgctcggtgctgatggtgctcagcatgctcaggcctgtaatacaggcggagaacaacaccgtggtgacaaatctagagaaatggatggagagagaactaacaaagtcactgaagaaattaatgaatgttataatctggaagcaggtgcagaggaagtcagccctggccaggttgaggatgtagagagagaaggtgttactgtgcatgcagaagcccaggagccagagcatgactgcatttcctgccagcccgaccaggtcaatgatgaggatcagcactatgaggaccaggacctccatgccacaacgatgaggatgggtctcctctgtatcactaattggtgcaatttctgtatccaaggctgggatggttggattcatgctcagaaaccctagtctggtgcccctgggaacacaaacaagatgtgatcagcagctgtatgatctctgattctcaccaccaccctgctacttgggaagtactgtccccattttacagaggagagaaacaagctcacagagaataagtaacctattaaaagttgaggagtcctcaactccagatttaaacccagttcttgctggctttaaagcctgggctctgtctattgcaaaacagttttctactgacatgggaataacattatgattgaaacacctccattcaaccagcgtggactgtggactgaagcattactctgtcctgggccggaaactttctctaaggtgcaggaattcggatagacaaagaggtggctgtgacaccctcatgatttagagtggtcctccatggatgaaaatgaagatcatgcattgtggacatgaggaaaatgtgacatcttgctagtacaagtgtgatgatggctgggcctggtgagctagaaatggcgcagtgtgtcagtcattgacgatagaaacctttttatatccccagtgcctggctccctgtgcagcacactgtgttcttcagaaatattcattcagtgaatgaatgcatgaatgaacagccgaatggtagtttagctttaagtaaaatggagaataaaaatgaaaacacaattcaagacattagaacacacacatataatgagataatgaaaatctcattcatcagaattttgtggacagctctgtcaaaaggaattactgatatgtgaccaagtacctgaggttgaccactaatgtgcctttgaaatgaggctcaatgtggctttgctgagcatctagaaaatttttgtatgcagtgtcggggtagggtgtggatctgaactgaatttctcagcaatatagaagaggaaagaataagtgagggtgagatcggagtgccaccgaagggggacttctaagtgttctgctgggtatacacaatgcagacccactcgattttgtcacacagaagatttttggtagagtttttttgttgatagaaacaatgtttgagaggagtccacaaggggaaataggagttcagggcttggagcgtaaagacagatgttgatgtagatgtcaactggtgaaagggggctagcttatatcttggttaagatgcaaaggagctggaggcctctaagtggaaagaagacacatcctccactgggagtacagaggagcatcaggagtgaatgcatccatcatgagctctcttggagagaaaagctgccacagtgttggttggcctgaaaaggaaatgggaggaaaactagaacctctgttatccacactcagggtacttaacagtttgaccatctaaatttagggtataatatgttcgtcttcctcatgaaacttgaagccccataaagactaagccatgcctgttcttgttcactgtagtatcaccaacattcagcttgtattcctcaaagaccatctattgtaataccctcatataatacgccaagtagctgaggcttaaagaatcaaaggattttcctgagattgcaccacgaagagcagatccagcacagcccctcatccctggagccctgcatgagcattctctattgctctctaccccatcattcattatttctgaggagtttctgaaaaatctttgggtgagaacagaatctgctagataatcaggggctttagaatctactagattgccccaatatctattctccttttcagtcatatcactattctggactcgaaaagcagcacaaggacccacatcccagttttctttgatgctggatgacatcgtatgatcaggttctggtcaatgggaggtgagccaatgtgatgtaagaaagtcctggctcacaggatcaatagaaggagcatagcctccccttcccctctaaatctaagttcttctccataaggctggaatgctgatgtaactgacaaccatgtaataccacaaggatgagggcacctctctagacattggggagcagcaatttttggagtcctaatgcctgatgccttggagcctccaactcaggtcttaaatacagtcactcctgcgtatcaacaggggattggttctagaacccctgcacacacaaaaatctgcagatgctcaattttcttatataaaatgacatagtatttggatataacatatgcactttctcctttatactttaaatcattagtagatcacttataatacctaataaaatataaatgctatgtaaataattgttatactgctcatttaggaaataataaaaaggaaaaaataagtctgtacctgttcagtacctatacaattcctgccatatgctgctcttttggaatgttttctatctctggtttgttaaatttgcagattcaggacctactgacatggagggacaactttgttttcttgtctaagatatttctactttgggtctctattagagaaaccaaacttacactctaaccaaaagaaatgttttctctttttgaaaattacacttcatttcctaggcatttttgatgaatgcatatatttctccataatactgaaacttgaacaagaatttttaaacagaaaaataactgtaatagagctgagatgagacatgatttaatgacgtttaaataaagaaaaccttaggaaggaggaggatatagaaaggtggaaggacagtcccatttattatgaggatttgctttccaatcttctctaccctgtttgacaacccaagagggtggcttctatgtacctcatcagtgagattcttttcattctggtgtctggttgaactgagacactgggagacaccagcaggagactggaaagcaggaggggagtcatttgagatctccacctgctggctgtctgcctgtgtggctgtgtgtttgtgatgcagggcttctccacttgcctggtcatcctctcccaaccctacagctacagctatcgttatgctttcaatggtacctgctcctttcctgttcttttaagcctagggaagaaagtcatgctccactattgctacttagggtgcatccccaggcattgtcactttcctttaatgctgcccatctttgtaaatagtctcctcatgaaacactcctcaattatatttcagaccacctattccttccttagacctttcctgataggcaaagaataatgttaaaaactaagtaaaaagagtaaacctccttttacagcagttcagctgttagaagtcatgcctgcaagtccccttgctccttaaatgaatgtaagagacaatattgtctccatgacagcagattgaataagtggaataaagggagtgatgtggaaaggtggatcagaagggagaaagttctgcctggctccatttggaattcacacagtctaggctgccagcactcagtttccagaaggaagcttcatgtcacccgccttttcctgaaacaggctcatgaccccctgcatgtagctccttaaggtggaaacacagggatgtgaacttatagcaaaaaacataacttactgtggaaagaagagagttcttggtacatacccttacctttcctccttcttctgtccagagttgaagaagtgctgcctcttgctaaagaggtagagcctttctgggattcagtgacttcagaggacccttttgtgttgtgtaatttaggagatatctagaggagctagaatgagagctggtgaccaatccaggcttatgaagataccgggcagccttgtgatttcctgtatgaagaatgcagacaaatcagaggccagagctgtttgagctaaaatccctatctgagatgtttcttggcctctgtcccattttaaatacatctcagccactccaatctcatcccatcttgttcaactctttgtaattaattgttgttttgaatctttataatcaattataggcctaagtatcaatatcaggcaatgtgaacttgtgctgcgaggcattgtaggtactcatccttttttacggctgcatagtattccatggtgtatatgtgtgatattttctttatccaatctatcattgatgggcttttgggttggttccaagtctttgctattgtgaacagtgctgcaataaacatatgtgtgcatgtgtccttatagtagaatgatttataatcctttgggtatatatccagtaatgggattgatgggtcaaatggtatttctggttctagatccttgaggaatctgtcttccacaatggttgaactaatttacactcccaacagtgtaaaagcatacctatttctccacatcctctccagtgtttgttgtttcctttttaatgattgtcatcttaactggcatgagatggtatctcattgtggttttgatttgtgtttctctaatgaccagtgatgatgagctttatttcatatgtttgttggctgcataaatgtcttttgagaggtgtctgttcatatccttcacccactttttgatggggttgtttgttttttcttgtaaatttgttgaagttccttgtagattctggatatttgtcctttctcagatgtatagattgcaaaaattttctcccattctgtaggttgactgttcactctgatgatagtttcttttactgtgcagaagttctttagtgtaattagatcccgtttgtcaatgttggcttttgttgccattgcgtttggtgtttcagtcatgaagtctttgcccatgcctatgtcctaaatggtattgtctaggttttcttccagggtttttacagttttaatgtaaaaagacttatgtttaagtctttaatccatcttgagttaatttttgtataagatgtaaggaaggggtccagtttctgttttctgcatatggatagccagttttcccaacatcatttattaaatagggaatcctttcttcattgcttgtttttgtcaggtttgtcaaagatcagatggtagtagatgtgtggcattatttctgaggcctctgttctgttccattggtctatatatctgttttggtaccagtaccatgttgttttggttactgtagccttatagtatagtttgaagtcaggtggtgtgatgtctccagctttgttctttttgcttaggattgtcttggctatacaggttcttttttgtttccaaatgaaatttaaaggagtttttttctaattcagtgaagaaagtcaatggtagcttgatggggatagcattgcatctgtaaattactttgggcagtatggccattttcacaatattgattcttcctatccatgagcatggaatgcttttccatttgtttgtgtcctctcttatttccttaagcagtggtttgcagttctctttgaagagttctccttgaagggagaatgtacaaattctcccttgtacgttgtattcctagatattttattctctttgtggaaattgtgaatgggagttcactcatgaattggctctctgtttgtctattattgatgtataggaatgcttgtgatttttgcacattgatcttgtatcctgagattttgctgaagttgcttatcagcttaaggagattttgagctaagacaatgggattttttaagtatacaatcatgtcatctgcaaacaaagacaatttgacttttcttcttcctatttgaatacactttttgccttattgccctggacagaacttccaatgctatgctgaataggagaggtgagacaggacatctgtgtctcgtgctggttttcagaaagaatgcttccatcttttgcccattcagtatgatattggctgtgggtttgtcataaatagctcttattattttttgatacattccatcaatacctagtttattgagagttgctagcatgaaggggtgttgaattttatcgaagacattctctccatctgttgagataatcatgtagtttttgtcattggttatatttatgtgatggattacgtttattgatttgggaatgttgagtcagcattgcatcccagggatgaagctgacttgattgtggtggataaggtttttcatgtgctgctggattcgatttgccagtattttcttgaggattttcgcactgatgttcatctgggatattggcctgaaatgttctttttttgttgtgtctctgccaggttttggtatcaggatgatgctggcctcatgaaatgagttagggaggattccctctttttctcttgtttggaatagtttcagaaggaatggtaccaactcctctttgtacctctggtagaattcagctgtgaatctgtctggtcctgagcttttttggttggtaggctgttaattactgcctgaatttcagaacttgtcattggtctattcagagatttgacttcttcctggtttagtcttgggagggtgtatgtgtccaagaatttatcaatttcttttagattttctagtctattttcatagtggtgtttttagtattatctgatggtagtttgtatttctgtgggatcggtggtaatacccctttttcattttttattttgtctatttgattcttctcttttttcttctttattagtccaactagtggtctgtctattttggtaatcatttcaaaaaaacacctcctggattcattgattttctgaagggttttttgtgtctcgatctccttcagttctgctctgatcttatttttttttttgtcttctgccagcttttgaatttgtttgatcttgcttctctagttcttttaactgtgatgttagggtgttgattttagatctttcctgctttctcctgtgggcatttagtggtatacattttcctctaaacacggctttagctgtgacccagagattctggtacattgtgtctttgttctcattgttttcaaagaacttatttatatgtgccttaattttgttatttacccagtagtcattcaggagcaggttgttcagtttccatgtagttgtggggttttgagtgagttttttaatcctgagttctaatttgattgcactgtggtctgagagactgttattatttctgttcttttgcatttgctaaggattgttttacttccaattatttggttaattttagaacaagtgtgttttggtgctgggaagaatgtatattctgttgatttgtaatggagagttctgcagatgtctattaggtccacttgggacagaggtgagttcaagtcctgaatattcttgttaattttctttctcgttgatctgtctaatattgacagtggggtgttaaagtctcccactattattgtgtggaaatctaagtctctttgtaggtctctaagaacttgctttatgaatctgggtgctcctgtgttgggtgcatatatatttaggatagttatctctttttgttgcactcatccttttaccattaggtattgcccttctttgtcttttttgatctttgttggttgaaagtctgttttatcagagactagaattgcaacccctgcttttttttttttttttttttccatttgcttggtaaatctttctttatccctttattttgagcctatgtgtgtctttgcacgtgagatgggtctcctgaacacagtacacctatgggtctgggttctttagctaacttgccagtctgtgtcttttagttggggtatttagcccatttacatttaaggttaatattgttatgtgtgaatttgatcctgttattatgatgctggctggttattttgcccatagttgatgcagtttcttcatagtgtcaatggtctttacaatttgttatgtttttgcggtggctggtaccagtcgttcctttccatatttagtgcttcctttaggagctcttgtaaggcaggcctggttgtaacaaaatctctcagcaagcatttgcttgtctgtaaaggattttatttctttttcgcttatgaagcttagtttggctggatatgaaattctggattgaaaattcttttcttaagaatgttgaatattggcccccactctcttctggcttgtagggtttctgcagagagatctactgttagtctgatggacttccctttgtggataaccctacctttgtctctggctgcccttaacattttttccttcatttcaaccttggtgaatctgacaattatgtgtcttggagttgctcttctcgaggagtatctttgtggtgttctctgtatttcctgaatttgaatgttggcctgtcttgctaggttggggaagttctcctggataatatcctgaagagtgttttccaacttggttccattctccctgtcactttcaggtacaccaatcaaatgtcggtttggtcttttcacatagtcctatatttcttggaggctttgttcattcctttttatccttttttctctaatcttgtcttcatgctttatttcataaaattgatcttcaatctctgatatcctttcttttgcttgatcaattcagctattgatacttgtgtatgcttcacgaagttctcctgctgtgtttttcagctccatcagttcatttatgttcttctctaaactggttattctagttagcaattcctctaactttttttttctttcaaagttcttagcttccttgcattgggttagaacatgctcctttagctcagaggagtttattacccaccttctgaagcctacttctgccaattcgtcaaactcattgtccagttttgttcccttgctggcgaggagttgtgatcctttggaggcaaagacgtgttctggattttggaattttcagcgtttttgcactggtttttcctcatcttcatggattgatctacctttggtctttgatgttggtgatcttcagatggggtttctgtgtggacatcctttttgttgatgttgatgtgatttatttctgtagtttagtttttcttctaacagtcaggcccctctactgcaggtctgctgtagtttgctggaggtccactccagagcctgttttcctgggtatcaccagtggaggctgcagaatagaaaagattgctgtctgttccttcctctggaagcttcttcccaaaaaagtacccactagatgccatccagaactctctttatgaggtgtctgtctaccgctgctgggaggtgtctctcagtcaggaggcacaggagtcaggggtccacttgaggaggcagtctgtcccttagcagagctcgagtgctgtgcagtgagatctgctgatctcttcagagccggcaggcaggagcgtttaagtctactgaagcaatgcccacagccacccctttccacaggtgctctgtcccagggagatgggaattttatctataagcccctgactgtggctgctgcctttctttcagagatgcccttctgagagaggaggaatctagagaggcagttttgctacagtgggtgtgctgagctgtggtgggctctacccagtcagaacttccaggtggctttgtttacactgtgaagggaaaaccacctactcaagacccagtaatggtggatgctagtggatcttagcttgctgggctccatgggggtggtatccactgagctagaccacctggctccctggcttcagcccccttctcaggggagtgaatgcttctgcctcactagcattccagacgccactagggtacaaaaaaaacctcctgaagctagctcagtttctgcctaaatggccgcccagttttgtgctcgaaacccagggacccggtggtgtaggcacccaagtgaatctcctggtctgcaggttgcaaagactgtgggaaaagcatagtatctgggctgagagcactgttcctcatggcatggtccctcacggcttcccttggctaggggagggatttccctcaccccttgtgcttccagggtgtggtgacaccccaccctgctttggcttgtcctccatgacctgcacccgctgtctaacaagtgccagtgagatgatccaggtacctcagttggaaaggcagaaatcgcttgccttctgcattgatcttgctgggaactgcagactggagctgttcctatttgtccatcttgccagccaccccaaccataatttcatattcagccaaactaagctccataagcaaaggagaaataaaataattccctgacaggcaaatgctgagggattttgtcaccactaggcctgctttacaagagctcctgaaggaagcactaaatatggaaacaaaaaaccggtaccacccactgcaaaaacacaccaaaatataaagacctatgacactatgaagaaactgaatcaactaatgtgcaaaataaccagctagcatcataaggacaggatcaaattcacacataacaatattaactttaaatgtgaatgggctaaatgccccaattaaaagacacagactggcaaattgaataaagtgtcaagacccataggtgtgctgtattcaggagacccatctcatatgcaaagacacacataggctcaaaataaagggataaaggaagatttaccaatcaaatggaaagaaaaaaaaaagcaggggttgcaattctagtctctgataaaacagactttcaaccaacaaagatcaaaaaagacaaagaagggcattacatagtggtaaagggatcaatgaaacaagaaggggctaactatcctaaatatatatgcacccaatacaggagcacccagattcataaagcaagttcttagagacctacaaagagacttagactcccacacaataatagcaggagaattttacaccccactgtcaatattagatcaacaagaaagaaaattaacaagaatattcaggatttgaactcagctctggaccaagtggacctaatagaaactgacagaactctccaccccaaatcaacagcatatactttcttcttagtgccacatagcacttattctaaaatcagccacataattggaagtaaaacactcctcagcaaatgcaaaataatggaaatcataacaagcagtctctcagaccacagtgcaatcaaattagaactcaggattaagaaactcactcaaaactacacaaccacaaggaaactaaacaacctgctcctgaatgactactggataaataatgaaattaaggcagtaataaaaaagttctttgaaaccaatgagaacaaacagacaatttaccagaatctctgggacacagttaagcaatgtttagagggaaatgtatagtactaaatgcccacaggagaaagcaggaaagatctaatatcaacaccctgacatcacaattaaagaactagagaagcaagaccaattaaaagacacagactttgtcttttaattcaagttcaaaatctaggagaagataagaaataactaagatcagaacagaactgaaaaagatagagacatgaaaaactcttcagaaaatcaatgaattcaggagctggctttttggaaagattaacagaacagatagaccactagctagactaataaagaaaaaaaggaagaagaatcaaatagataaaatgaaaaatgataaaggggatatcaccagggaacctacagaaatgcaaactaccaccagagaatactataaacacctctacgcaaataaactagaaaatctagaagaaatggataaattcctgaacacatatacattcccaagactaaaccaggaagaagtcaaatccctgggtagaccaataacaagttctgaaattgaggcagtaattcatagcctaccaaaaaaagcccaggaccagacggattcacagccaaattctaccagaggtacaaagaggagctggtaccattccttctgaaaccatttcaaaccactgaaaaggagggacttctccctaactcatttcatgaggccagcatcattctgataccaaaccaagcagagacaaaacaaaaaaagaaaacttcaggccaatatccctgatgaacatcaatgcaaaaatcctcaataaaatactggcaaactgaatccagcagcacatggaagtcttatccaccacgatcaagtcggcttcatccctgggatgcaaggctggctcaacatacgcaaatcagtaaatgtaacccatcacataaacagaactgatgacaaaaaccacccgattatctcaatagatccagaaaaggccttcggtaaaattcaacatcccttcatgctaaaaacttgtggggaaaagagagatcagactgttactgtgtctatgtagaaagaagtagacataagaaactccattttgttctgtactaagagaaattcttctgccttgagatgctgttaatctgtaaccctagccccaaccctgtgcttgcagagacatgtcctgtgttgactcaaggtttaatggatttagggctgtgcaggatgtgctttgttaaaaaagtgcttgaaggcagtatgcttggtaaaagtcatcgccactctctaatctcaagtacccagggacacaatacactgtggaagtccgcaaggacctctgcccaggaaagccaggtattgtccaaggtttctccccaagtgatagcctgagatatggcctcgtgggaagggaaagacctgaccatcccccagccgacacccataaagggtctgtgctgaggaggattagtgaaagagaaagccctctttgcaattgagataagaggaaggcatctgtctcctgctcgtccctgggaatggaatgtctcagtgtaaaagctgattgtatgttctatttactgagataggagaaaaccaccttaaggctggtggtgagacatgctggtggcaatactgctctttaatgcaccgagatgtttgtgtacgtgcacagcaaagcacaggacctttccttaaacttatttatgacacagtgacctttgctcacatgttttcctgctgaccctctccccactattaccctattgtcttgccacatccccctcaccgaggtagtagagatagtgatcaataaatactgagggaactcagagatcagtgccggcacgggtcctctgtatgctgagtgcctgtcccctgggcccactgttctttctctatactttgtctctgtgtcttatttcttttctcagtccctcgtcccacctgagagaaactcccacaggtgtggaggggctggcccccttcaaaactctcaataaactagatattgatggaacgtatctcaaaataataagagctattcatgacaaacccatagccaatatcatactgaatgggtgaaagctggaagcactccctttgaacagtggcacaagacaaggatgtcctcttctgccactgctattcatcacagtattgaaagttctggccagggaaatcagccaatacaaaacaattaagagtattcaaataggaagagaggaagtcaaattgtctctatttgcagatgacaatattgtatatttagaaaatcccatcctctcagtctcaaaattccttaagctgataagcaacttcagcaaagtctcagcatagaaaatcaatgtgcaataatcaccagcattcctatgcatcaataatagttaagcagagagacgaatcatgatgaactactgttcacaatttctacaaagagaataaaattcctaggaatacaacatcaaggaaataaaaaacgacacaaacaaaagaaaaaagtttcatgctcatggataggaagaatcaatatcgtgaaaatggccatactgcccaaagtaatttatagactcaatgctattcccataaagctaccattgactttcttcacagaatttaaaaaaaaaaaactactttaaatttcatgtagaacccaaaaagagcccatatagccaaggcaatcctaagcaaagaggacaaagcttgagggatcaccctgcctgacttcaaactatactacgaggctacagtaaccaaaacagcatggtagtggtaacaaaagtgatatgtagaccaatgaaacagaacagagtcctcagaaataacagcaccaggtatagaccaatgaaacagaacagagtcctcagaaataacaccacacaggtacaatcatctgatctttgagaaacctgacaaaaacaagcaatggggaaagaattccctatttagtgaatggtgctgggaaactggctagccaaatgcagaaaacagaaactggaccccttcctcacaccttatacaaaaattaactcgagaatgattaaagacttaaatgtaaaactgaaaacgataaaaaccctggaagaaaacctaggcaataccatttaggacataggcatgggcaatgacttcatgactggaacagcaaaagcaatggcaacaaaagccaaaattgacaaatgagatctaattaaactaaagagcttctgcacagcaaaggaaactatcatcagattgaacagatgtcctacgggatagcagaaaatttttgcgatctcatctaacaaaggtctaatatccagaatctacaaggaagttaaacaaattttttttttttttttaatttgagatggagtctcactctcttgcccagactggagtgcagtggcacaatcttaggtcacttgaacctccgcctcctgggttcaagcaattctcctgcctcagcctcctgagtagctgggattacaggcgcctatcaccatgcctggctaatttttttatttttagtagagatggggtttcaccatgttggccaggctggtctcaaacttctgacctcaggtgatccacccgcctcggcctcccaaagtactgggattacaagcatgagccaacacacctggccaaagttaaacaaatttataagaaaaaaacaaacaacctcatcaaaaagtgggcaaaggatatatataaacagacacttctcaaaagaagacattttttgtagcaaaaaaatatgaaaaaaagctcatcatcactgatcattagaaatacatataaaaacaatgagacaccatctcacaccagccacagtgaagattattaaaaagtcagggaccaacagatgctggtgagactgtggagaaatgggaacgcttttacactgttggtgggagtgtaaattagttcaaccattgtggaagacagtgtggagatttctcaaggatctagaaccggaaatatcatttgacccagcaatcccattactgggtatatacccaaaggattataaatcattctactataaagacacatgcacacacatgtttattgcagcagtatttacaatagcaaagacttggaaccaacccaaatgcccatcaatgatagactggataaagaaaatgtgacacatatacactatggaatactatgcagccataaaagagaacgagttcagtcctttggagggacatggatgaagctggaagccatcattctcagcaaactaacacaggaatagaaaaccaaacactgcatgttctcactcataagtgggagttgaacaatgagaaaacatgcaacagggagaggaacatcacacatgagggcctgtcgggggtggggggcaaggggaaagagagcattatgacaaatacctaatgcatgtgaggcttaaaacatagatgatgagttgataggtgcagaaaatcaccatggcacatgtatacctatgtaagaaacctgtacgttctgcacatgtatcccaaaacttaaagtaaaaattaaaaaaatgtacacatatgtttatagctgctttatttttaaatgttacattagaaaaaacagcaatatccttccacttaccaataatgaaacaaagcatagtacatccatacaatggaacactactcagtagtataaaaaattagcaataagttattgatacttgcaaaaacttgcatggatcttgaggacattatgctgaatgaaaaaagccaaagtcaaatgattagatactgtatgattctatttatgtaacacttttgaaatgacaaaattatagagatgaagaatagaacagtgattagaggggtttgggaagaagaatagtgtgggtgtggcagtagggggaacccaggggaaatcttctgtggtgaagaaacacttctatattcaatgtcgttctggttatatgatctacacatgtgacaaaatgttatggaatgaaacatagagaaatatctcactccaaaaatgagtgcatgcaaacactggtaaaatttggtaagatcgtactgtagatatttggtgaagtctcataagatttgtagtgtagataattggatggtaccaatgtcattttcctggttttgataatacattcaattaaaaagtcagtattactgtgggttggttgatgggcatacaggaactctctgtactattttagtaacttcttaatagtctacaattaattctgaatgaaaacttaaaaacaactgagagactggtttgttgtgtggactcactccaagaatattgaagtcaccaagaatgaggacatggggtatgctggaagggagtttgttaaccgagtacataggtagaaggtaatataatttgcattcaccaacccaacacgaaattaagcacatattaaatttttatcatatttatttccaataactcttaaaatgagtacatacacttttacagacacaaggctgaatcatgcatctctactctcaccaataattgtacatatctttgataagaaggcaagggtgcctgcacacctggaatgggaatgacaactttcttcaacttcagaaagtctgaggttgatatgtgttattctctcacatgtttaccaggatttaaaaatgtcaagtcactatagaaattacgttacaaagaggttctagacaacacagaatttgaataggaattttgggacatccatatcaaggctatgcagagtttagatttaaattttgatgtgacaattacaatggtgaatttaattcaaagattaactatctcccctactcccaatgtgggccttttgcaggtaaaaatgctgctccagagaaggggctgcattccattgcttctctcttctcccctaacccccacacttttttttgtatttttatccatgccttctgaccctggagggctggacatatccctgtgaggagggtgaggagagaagggaattgactttgtggcttgtcctgttggcctgacctgcctggccctctctggactttatattattatagagctcactcctatgaatatcacaaaactaacagcaagccctatcacttcaaggccacagaagatgatgctcattattcagagcactccagccttatgattctatataagaggaatattgccaccatgaccaaaatacatggagtgggagacacaaggaataaaactcatgtatgaattcttcaccattccctaaaaaactctctgctattattaacagtgccactgtaaattatttctttcccgatttctatctgtccaaatttacagcaaattttacagcaaatttacagcaaatttacagactggcaaaatttacagcaggtgcaattataataataataataatgctgggtcaattatagtcatcagttaaaattctacgtattacacaaagccttccatgatccactcacttctacgtagacacttagaaatgagatccactgtgtcttttctctccttccttgtgtttgcatcctgcaaggtttcagaacaattggaccaatatgatgggcatgagcattgagatttcttcttctatactctgctgtcactgctagaaacagcaaaccagttccgcctatatctatagccagcattgatacattgacaatagtggtgcccaaatgataccacaccatcatatagaacaagcatcatagcagtctctggattctagagcgctgccacataggtgagaagaatatatgcttactgtgattattgtcacggtgtagtgatgtgaatttctcaggtggcctgtggcctggatcacaacactagttatcttcagcctatggttatggtaaagtcatgctttacccacatattctgaaaagagatacctgagcacaaatgcacaaatggcacagtttcagactggggcaatcccataacctcactatctgcttggcttgcctggaatgagcacgtgactcatgttggccatgcagtcagcttgagaatcccaaatccctgaaaccaagtccagtgttcttcccattctagcacttacacattctgcttccctacctatcctgggatttctaggtgctgaattgggtttgcctgaagacaagggcttcttctgctggaacctagggtaataagcacctgcagggtctcttgaaaatactttcaggaactttgcattggtgtgctgttgtactatagaatgagggctgttgtaatgttcagccaattcagtcatcaattataaaaccattgctgatattgttttcttgcgtgagtagccacctggtgaatattcttttgtgtgtgtgtgtgtgttttgagatagagtctcactctgtcgcccaggctggagtgcagtggtgcgatctctgctcactgcaagctccgcctcctgggttcatgccattctcctgcctcagcctcccaagtagctgggactacagacacccaccaccacacccagctaattttttgtatttttagtagagacagggtttcatcgtgttagccaggatggtctcgatctcctgacctcgtgatctgcccccctcggcctcccaaagtgttgggattataggcgtgagccaccgcgcctggcgtgaatattctctaatttattaaaatcatgttgtcctgcttcagctgggtgcttgggtgtggcattgctcttcaggatggcagcaagataacttggaatttttagataccctctcctctgaacacccttgagccacaaacacaatccttggatagcatgtgtcacactgggaggcagtctttcctgtactagtgtccttccttcacaggctgtgcgctctgggaatgtgggtatgtttactttgactcccaagtgtctggcatgcaagctagagaatggaagatgctcagtatatatttatacaacaaacagtagaaaaagtgatagatattgctatgaaaagcccacttaatgatatattcaggagtgtaagtagatagattaattgaaaatgtctgttaatcagcatttaaacaaaaggatacatttgtaacatgaatatttcaattttacctagaattcattcactgtaatagaactagactgtagaacaatccttttgtagggttcagcaaatagaattctgctctgtctggctgaaagcgtatctatcaatcactgtctataatttgcagtttgaattagtttaagtgtagatcttagcatcagatgcatagcattctgtcttaggaaattgttcaatattgctcatttttgtttaatcttgtagagttggaagactcacacctactaaactaacaataattttggaacctgcttttattttccatttgatcattcatgttagtttttatggaaattgcaattcttctttcatactattttttcattgatctgtgctgtattttgataaattaggaaattatattcactagcctaattggcaaaagcagggcaagaaacagattcaattggttcttgtgaggctgatgactcagtgcccttgtgcccagtgtactagagcgtcagtgaatggccatgaagactcagcatttgcttggcatcagtcactgtatttgcttcatgaagtggaaaggattaattatacagatagaatgtattagtgagagacttatttgaaagatgtttgcttttatgtagaattagcacagcgcttgattaattacgattcaatgtttgttgaattcatgcctaaaatatagtcatgaatggcagctcccaaaaagtgccaagagagactttcatgtattttctcactttctggagaaaactcctggatgtactgcatgcttctcctccatatgaaaccaagaggaaatgatatcattggcctggtaaagaaggcagctcataagccgactcccgcatcccctccattcttcttcccagaggcagtgagcaaacctccaatgaaaggaaacagctgttctcagaatgaccaactgcagaggacactgttaagtggaaggtgcctataagagttccagtgagacctggtgactgagccagcctttgcaagatgctggatgaccctgtgattatcaggtgggagctgcttgagaaaaataccgagtattttctaaatttcacacctaggctgttgcactagaaattcaaagacatgaatccctgctcttaaagacctcagagtgtggtaggagagaaagatgtgtggacaaataattcaagtacactgttataagtgttgtagtagagcaacgtgtgaggccaagtgaattcagaacgggcttcagggacagtatctaagctttcatgaagctaaagttttcttctgtcaaagaaaaagaatgtcactaacatcaaaataagcagtttttcatgtgaggaacaaaattatttgagtcaattgctaggtgaaaattctctacagaattcctcatgatagacaacatctttagccaaaactgtacaattgatatcacagaattccagagtggactctcccaataaccctcagtctgaaaagctccttgcttggagaattggctgcaaacattgccttcctgcttcctccgacctttaggaaaccctcccctacagccacattctaatacagcatttgaaaattgagagtggatagataggattcagcatcagcagagtgctgggcctggaagaggaatggatctggactgaggggacctgagttcaacattgtgaacagtgtgataggagccaccaataaatttgtttggacaaattgaaaactatatacctctttattgctttcatagctcctttgtaatgtctctcctgcattcaaatggcatgtgtcagctcccctcagtgagggtcaatctgaggggcagcctcactgttggtgagaagcacagagccagctgtgatgtcacatcttctcttgatgtctcttctgtctgcttgagttatctggggaagaaattaccactggtagaaaatagttctgagttttgtactgattccatttctaaaattacgtttttaattgtggtaaaatttacataacatacattttacaactataaccatttaaagtgtacaattcagtgtcagtaagtacattcaaaataaattgtaactgttacgactgtgccctttaagaacttttaattattccacacagaaattctgtgctctttaaataatggctactcattctctccattatccagcaccaggctcctcctaatttattttctgtattcatgaatttcctagtttcaatacttcataaaatttgaacttacaatattgttctttggtgtctggcttataatgctgagcatgatgtttccaggttcatctatgtcacagcatgtattagaattttgtacgaactggaagttattatccagatactataattgacatgagcaaggaaaggtcagatgttttcagtgttgcttctcatgttaacagccataaaactaactgaaagttaagccagaacaatttatacaaaccctggaagtatggagaattctcctgtaactgaaacaatgtgtaagcaaatacatgatttttgagataatttccactttgaaaccaatactgaggcttccaatggccaaattgaactgatggagcatatttatgagctcctcactggttcattagtccaggaagagctaaataagaacttaccggttcttaaggggaaggggccatggttatctttgctagaaaccaaggccaacatgtcaccattctgtagacaaatgacagcggaggactttccataaaaccaattccctagactgtttttatgaagagacattgtatctaatgtatacataa

SEQ ID NO: 403 - DNA, 20001 bp, Homo sapiens
catttgcttggcatcagtcactgtatttgcttcatgaagtggaaaggattaattatacagatagaatgtattagtgagagacttatttgaaagatgtttgcttttatgtagaattagcacagcgcttgattaattacgattcaatgtttgttgaattcatgcctaaaatatagtcatgaatggcagctcccaaaaagtgccaagagagactttcatgtattttctcactttctggagaaaactcctggatgtactgcatgcttctcctccatatgaaaccaagaggaaatgatatcattggcctggtaaagaaggcagctcataagccgactcccgcatcccctccattcttcttcccagaggcagtgagcaaacctccaatgaaaggaaacagctgttctcagaatgaccaactgcagaggacactgttaagtggaaggtgcctataagagttccagtgagacctggtgactgagccagcctttgcaagatgctggatgaccctgtgattatcaggtgggagctgcttgagaaaaataccgagtattttctaaatttcacacctaggctgttgcactagaaattcaaagacatgaatccctgctcttaaagacctcagagtgtggtaggagagaaagatgtgtggacaaataattcaagtacactgttataagtgttgtagtagagcaacgtgtgaggccaagtgaattcagaacgggcttcagggacagtatctaagctttcatgaagctaaagttttcttctgtcaaagaaaaagaatgtcactaacatcaaaataagcagtttttcatgtgaggaacaaaattatttgagtcaattgctaggtgaaaattctctacagaattcctcatgatagacaacatctttagccaaaactgtacaattgatatcacagaattccagagtggactctcccaataaccctcagtctgaaaagctccttgcttggagaattggctgcaaacattgccttcctgcttcctccgacctttaggaaaccctcccctacagccacattctaatacagcatttgaaaattgagagtggatagataggattcagcatcagcagagtgctgggcctggaagaggaatggatctggactgaggggacctgagttcaacattgtgaacagtgtgataggagccaccaataaatttgtttggacaaattgaaaactatatacctctttattgctttcatagctcctttgtaatgtctctcctgcattcaaatggcatgtgtcagctcccctcagtgagggtcaatctgaggggcagcctcactgttggtgagaagcacagagccagctgtgatgtcacatcttctcttgatgtctcttctgtctgcttgagttatctggggaagaaattaccactggtagaaaatagttctgagttttgtactgattccatttctaaaattacgtttttaattgtggtaaaatttacataacatacattttacaactataaccatttaaagtgtacaattcagtgtcagtaagtacattcaaaataaattgtaactgttacgactgtgccctttaagaacttttaattattccacacagaaattctgtgctctttaaataatggctactcattctctccattatccagcaccaggctcctcctaatttattttctgtattcatgaatttcctagtttcaatacttcataaaatttgaacttacaatattgttctttggtgtctggcttataatgctgagcatgatgtttccaggttcatctatgtcacagcatgtattagaattttgtacgaactggaagttattatccagatactataattgacatgagcaaggaaaggtcagatgttttcagtgttgcttctcatgttaacagccataaaactaactgaaagttaagccagaacaatttatacaaaccctggaagtatggagaattctcctgtaactgaaacaatgtgtaagcaaatacatgatttttgagataatttccactttgaaaccaatactgaggcttccaatggccaaattgaactgatggagcatatttatgagctcctcactggttcattagtccaggaagagctaaataagaacttaccggttcttaaggggaaggggccatggttatctttgctagaaaccaaggccaacatgtcaccattctgtagacaaatgacagcggaggactttccataaaaccaattccctagactgtttttatgaagagacattgtatctaatgtatacataatgtataaaataatgtatcgaagtacgttattttgctctatatatgagaattcaatggaacttagagacagcagaactcacttattcagaatctagttaccagctgcagtaatgcctccagtcataaaagggaacatgatttttaggggaacataatctgagagattaaaaaggaatcttcctttttgatacaatcaggttcaaacaagcataaagaagagttttaaggtttcggacagaaactccatgcattacaatgaaaattacagaaaaagtgttctgtaggaaagattcagtgtaagacaacagagaaaatgtgttggtaatatcaggagaatctaaatattgtactgtcagactaatgctttccacaggtgaaaaccgcaattgtcaggttagataaacatctattcgaagaccttgaggaaccactgagacatttctgaggcggaaggctaagaaaaatgcatataattgtcaagggtggcagggcagtgttgctctcaaagtcccatctgactgacagggtagaggctcttcctcactgcctgaatctgcttcccgacagctccagggtttcctgaggaaggcaccatccaccttcatccacctcaggcgtgtcctgcagatccctctggagaaccagcttcaggttctgccaattttgatgctgcctaacgaaacccatgaagaagtaaatgatggggttggcactgctgttaagagacgacaggaaaatggaaggcagatgaacatgagaatataagacttcccagtccatgtggatcctggaaaacagggcccactgaatgccaatgggcaggccgcagaggaggaagaccagcactgtgagcagatggtcatgtacagcctggtcagcggcatcttctgggatccacagaggatcctgaccactaggaccaggctggacacacagagaaccacaaataaaaaaatcagccacgtaactgtgatgaatctgatgtttgacaccaaacagaatcagcatcactaaacagggagtcacagaacatccactccaggatgctctacagcagggacagggcccagagcaggacacacacgaccgttgacaggtgtgtggggtggcggcagcgttaccagatgggccacaggattgacaggcagcgcttggtgctcatggcactcagaatattcaggcctgccaagtagggaaaggtcatcacaggctagaggattagagagatgggatggacgttattgatgaggtgtaacagggatgtataatgtggctgctgaggaggaggaagttggccgcgaccaggttgaggatgtagatggagacagcgttcctgcacatgcggaagcccaggagccagagcacaaccgcgtttcctgtcagcgcgacaagggaaacgatgcacgtcagcaccgtgaagctcagggtctgattgtagcaaggagtctcctcagttccgttgattggtgtcagttctgtacccaagactgggatggttggatccatgctcagaaaccccagtctggtgcccctgggaacacaaaccagatgtgatcaccagctgtatcatctctgattctccccaccaccctgccatgtgggatttactgtccttactttaaggagagagaaaaagaggctcgcagagaataaatcacctatcaaaaggtgggggtcctcaaatagagtttgaaatccagttcttattgattctgaagtctgacctcactctgctgccacacaagttctgtacggacatgggagtaacttatgatcaaaacaccctcactcatccagccagggctgtggacccgatgattactctatcctgggcctgacattttctctcaggtggaggaattcagatccacaaagaggtggttgtgacaccctcatgactaggactgatcatccatggacaggaaagaagaccatgcattatgaaccagaggaaaatgtgactttcactaggatacgtgtggaaatggctgggcctggtgggtgagaaataactcagtgtgtcagtcattgcagacaggaacacattttacattttatacttccagtgcctatttccatgagcagcatactgtgctcttcataaatattcattcaatgaatgaatgcatgcatgaggagcctaatggtactggtagattttggtgaaatggaaaataaaaatgaaagcactatgtacatcattagaacacataagtgtaattagatgaagaaaatttcatccatcagaattctatttgtggacagctctatctgtgttgagaagaattattgatgagtgcccaaaacctgaaattgtccactgatgtgcctttaaaatgaggacttgatgtggttatgctgaacacctagaagcattttgtatacaatgtttgtgtagggtgtgggtctgagctgaattgctcagccatatagcagaggaaagagtaagtgagggcgaggtctgagtgccactgaaaaaggtaattgaagtgttggaatatctatgggggagtgttaagtgttctgctgggtatatacaatgtaaaccaatttcattttttctttcaggagatctttgttagcatttctttgttgctgtaaacatttgtatgagagaagtccatgatgggaaataggagatgttagggcttggagtatagagagatgttcatgcagatttcaactggagaatgaggattaggtctaatctgggagaataacagctgctgattgagagttttaaggtattgtctcttttaatcatctgaagagcctaggaggtaagaatgagtattattcccatatggcagataatgcattggaacacacaaaaaaagtgaactattcattctgggactcatatagtgtgaatttgagcccagtagggctgactcacgatccagtcttggagcagccctttagacccgcaccactctgtcaattatacatgttagaggggggtaaagcagaggagggattctcaagttaaatccaagttggcaggtaaaattgtgggttgaaaaaaaaactaacctaaacaaatttcagatagagaaagagaagcaaatcaaaaagggaacaaaatagaggagagtgaaagccatttaggaacaaattcaggagctcctttttgctatcagaggccacctttgctctggaatcccgagaatgcacatgggcaggagctctccaggtggaaagaagatgcatcctcctctgggagtatagaggagcatctggagtgagtgcatccatcatgagctctcttaaagagacaagctgccacagctctgattggcccgaaaaggaaatgggaggaaaaggagaacctctgttatccacactcagagcactaaatactttgtccatttatatttagggtaatggtgtacttgtcttcctcatgaaacctgaagcttcataacaactaagtcatgactgtctttttcactgtggtatgaccaacatttggcatgtgttccttaaagatcatctatggtattattttcttataacgtaagatgaagccaagacctagagaattaaagcgttttcctgagatcacaacacaaacagcaggtccagtaccagtccctggttcctggagccctcatgagacttctctgccccatcattcattatttcagaggagttcctgataaaccttgatgggagcacagaatcagagacagtcagaggcagagaagactgctatgttgccctaatattcattttcctctttggtcacataacaattctcagagtttaaaagcagcacaaggacccacattccagttttccttgatgcagggagccatcatatgaccaggtgctgttcaatgaaagatgcacaaaagtgatataagcaagtcctggctcagaggatcaatcaaagaagcaaagcctctccttttcttcattttttcctatcatgctggaatgctagtgtggctggaaaccatgtaagatcacaaggatgagtgcaactctctagggactgcagagtagtaattttcggaattctgatatacaataccttggagcatccagcacagatctcaaagatagtcatttctgggtattcacagaggcttgtatctggaaccacagcacacaccaaaatctgcagacgctcaatttccttatataaaatgaggtgatatttgtacaaaacctgtgcactttctcccagacacattaaatcatttttaagttacttagaataactggcaaaatgcaaatgccatgaaaattcttgttttactgtattttttggaagtaatgacaaggaaaaacaagtttctgcctgttcagtacatacacaactccgccataccattatttttaaaatagttttcacctgtggtttgttgaatctgcagattgaggacctagcgacccagaggcacaactgtactttcttgtttaagatatttctactttgtgtatttgtgaaagtagccaaacttatactcttaacaaaagaaatatgttctgtctttaacattataatttattttctatgcatttttgatgaatgcaaacatttctgcatagaagtgacagtagagaacgacatgccaaatgttaaagtagtctgatagagctgaaatgagacaggtatcaatcacctttagacagaggaagccccaggaattaggaggatataagaaggagagaaggatagtcccatttgctatgacgatttgctttccactcttctttatcttgtttgacatcccaagagagtggcttctatgtaccacatcagtgggaatcttttttaattccagtttctggtggaattgtgacactgggacacaccagcaggagactggaagacagcaggagagcactttgggatttccacctcctggctctctgcctgtgtattagttcattctcaaattgctataaagaaatacctgagaccgggagatttgtgaagaaaacaggtttaattggctcatggctctgaaggctatacaggaagcatagcagcttctgcttctggggaggcttcaggaagcttccaatcctggtgaaaggcaaagggggagtgaggcatctcacacggtgagagcaagagtaagagagagagggaggacgtgctacacgcttttaaataactagatttcatgagaactcactcgctatcactacagcaataccaaagggggatggtgttaagccattcatgagaaaccatccccaccatctaatcaccacccaccaggccctccttccaacaccgggaattacaatcaacatgagatttgggtggggacacagatccaaagcatatcagcctgtgtggctgtgtgttggtcgtgcaaggcttctctacctgcctgctcatgctctcccacccttatggctacagctatggctatggtgtcaatggtaactgctccttccctctccctttcagcctaagggaggaagtagtgctcccttaggtattgctgcttagggtgctcatccatgcattgtcgctatcccttaacactgcacatctttgtaaatacttccctcatgaaacactcctcagtcatttcagttgggacctcctgtttcttccatgaacctttacagacaggcaaggatgaataatttagaaaagtaagtaaaacaacaaaacttgcttctacagcagttcaactctgcgaagcaatgcctgcatgtcctctaactccttaaatgaatgtgagagacagcattctctccatgaggacagattcagtgattggaataaaggaggtgatatggggagataaatcagaagtggggatcccagttgaaggtcaacacactctgagttggcagcactcagtttccagaaggaaacatcatgtctcctgtcttttcctgaaacaagctcatgatcccctgcctgtagcacctaggtggaaacacagaaacgatcttatagcaaaaaccataactgactgtggaagaagacagttcttggtacttattcttctcttttgtccagtggtgaagacttcccttgtgctaaagctggagggcctttctgggattcagtgacttcagagaacccttctgtgttgcttaattcaggagatgcctacaggagctggagtcaaagctggtgagcaatccagacttatgaagatgcaggattgccttgttatttcctgtataaggactatggacaaatgagcggccagaggtattgaagacacaaaccctgagatgattcttggcctctgtctcatatccagtacatataagcctctcccatcacactccatcttgttcaacttccttgataaaaacagtggcaaggtttgagagaattgactttcattttaaaagaagttctactgtgtataaaatgctatcaaatagcattccatgctacattaaaatctttcataaaaggatgagtcaatcaacgtggcaaactttactgttgtcttgttttttttcttgtttattttattttattttattattattatactttaagttttagggtacatgtgcactatgtgcaggttagttacatatgtatacatgtgccatgctggtgtgctgcacccattaacttgtcatttaacattaggtatatctcctaatgctatccctcccctctccccccaccccacaacagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctaaaaaggacatgaactcaacattttttatggctgcatagtattccatggtgtatatgtgccacattttcttaatccattctatcattgttggacatttgggttcgttccaaatctttgctattgtgaatagtgccgcaataaacatacgtgcgcatgtgtctttatagcagcatgatttatagtcctttgggtatatacccagtaatgggatggctgggtcaaatggtatttctagttctagatcgctgaggaattgccacactgacttccacaatggttgaactagtttacagtcccaccaacagtgtaaaagtgttcctatttctccacatcctctccagcacctgttgtttcctgactttttaatgatcgccattcaaactggtgtgagatggtatctcattgtggttttgattttcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattctgtaggttgcctgttcactctgatggtagttgctgtgcagaagctcttttagtttaattagatcccatttgtcaattttgacttttgttgccattgctttggtgttttagacatgaatgaagtccttgcccatacctatgtcctgaatggtattgcctaggttttcttctagggtttttatggttttaggtctaacatttaagtctttaatccatcttgaattaatttttgtataaggtgtaaggacagcctgtcttgccttcagcagccacctcaacagccatcaatatcaggcaagaccttccagcaggaaaatgtttggcttgataaaggttctgatgatggttaccatttcctagtaaaaatatttcttaagtaatacatgtatattgctttagacataaggccactgcaactcaatagactacagtatagtgtaagcataacttttacatgtactggtacaccaaaaattcatgtgattcactttattgtaatatttgctttattgtagtgttttaagcagacttccaatatcttcaacatattcctatatatgataaagtttgtatatcaaagtagtgtgtaaaacaggcactattgaatgaatgggattgggacaactgagtttctgtgtgaaataagtaaaggtggaagcatactttacatatgatttgaggataaatccaaatacactacttaaaattttataatgaaaatacaattacctggaggagccatagcaaaatagttttcaaatcgaagtgggaaatgactttcaattatagaatagaaaacagaagatattaaagaaaatattagtaaagacaaaaagaatgccagctgtgattgcccactcatatatattaataaagacaaaaagaacaccagctgtgatggtccactaatataattccagcactttgggaggccaaggtgagtggataacttgagctcacgagtttgagaccatcctgggcaacatggtgaaaacctgtctctacaaaaaatacaaaaattagccaggtgtggtggtgcatgtctgtagtcccagttactcgggacattgtggtgggaagacggcttgagcccaggctgcggaggttacagtgaaccaacatcacagcactgcattccagcctgggtgatagagccagaccttgccaaaaagaaaaaaaaaaaaaaaaaaaaaaaaaaagggaaagaaaagaaaaagaaaaaaaaaagaaaaagctatttttagcgtgacatgaaccatcataatcaaaatataaataaactgtggctagccatgatggctcactcctgtaatcccagcactttgggaggctgaggcaggcagattacctgaggtcacgagtatgagatcagctagtctctactgaaaatacaaaaagtagttgggtgtggtggcacaggcctgtaatcccaactactggataggatgagtaagagaatctattgaacccagtagagaaaagttgcagtgagccaagaatgcacctctgcactccagcctgggtgacggagactccgtctcaaaaaattaattaataaataaaataaataaactgggagatatttcgtaatgtatattatagccaaagtataaattttctctactgatacaaatttttctaaaatgatattaataattcaaaattcaaaaagctaataagaaaataaccttaagttacgattcacaacttctagaaaataaaaatggctcctaaacatatggaaagaggagaaatgcaactcttaataaaagacatgccaattaaaattacagagttatattttacttaccaaaatctaaaaaaccattaagttttatagcatacaacatggggatggcgtgggatcaggcaccctcacccatttctgctgaggatgcagttgcttagaacttacagtgaaggcaattttcaacttatgtaagcatgtataaagtatcattcttttttctctgtaattactcatctaggaatttatcttggagatgtatttgtgcatggccaaaagatctatgtactaagttaataaatgcagtgttatttacagtaaaagactggtaacagccaaaatggccatcaatactgtataaattatggtctatctgtgcagtagaatactctatagctacacagaaagagcaacaaacctaatataaaaggccctccagaatttgttagatttttaaaaaagaatgcagaccaatgtatatattgtatgacgaagctatatagttgctttatcactaaatatttgcaaattaatgcaaaattattaataagtataatatgatatgtctttgttaacaaggcaaggatgcctgaggatctaaaatgggaatgacagtttgcagtgcatgtatttaaagattatttttgaaagttctgactttattactatgtcacaaataaattatcaagcaaaaaaataaatataatgatctagctaagagacagagatagacacatgagaagatatgaggaagggtgagaatatgaagataatgagtacagaaaactctttggaagatatatatacatgtatatttttctaaaggattgtagagaaatcaggctgtggatggagaggaatgggggcttggttggtattttaggccaagaataggatagtgtgtttcaattgcaatggaaggatccatgagagaaggaaacattgaagatgcaggagagagaagtaataatgctataaaatgtttctcgggagggaaaaggggaaactgcacaaattgaaagggtggtttcaaacaggaatttgcagagcccatttcctggcatgagagaaaatgcagagagatgcgctcagaggcacatggggaggtaggttccctctggggagattgagtaattctcagaggagcatcacctgacagtgatttaaaaaaaaatgaagagtaggcggtttcaggagagagaaaatgtcgtgaagattttcctttggagagtgagaggcaattatggaaatgtcacgtgagtgttcaggagatataaatggacctttcaggttcaaggttataaatgtacagtgaaaccgctgggcatggttgtgtgttgtgctgcagccaccctcagttctatgggaacaggcatggagttagtggagagctggattcaagcagggtaaaagacgaactgatacttcagcaaggacatatatgcatgacaaataaacacataaaaagatgctcaacatcactaatgtttaggacaacaaataaaagtcacgagataccactctaccctctcaatatggctaaaatataaaatactgatagtttcaaatattggctgagatttgaaggaattggaggtctcatacactgccaatgagaaagtaaaatagtagagctactctgggaaatcttcttgcattttcatataatccagcaatccagcgtatcctagaacctggaaaatgtatcctagaaactgggaaactgtgttcacttaaaaatctgtacaggaggggggccaagatggccaaataaaaacagttctggtctgcagctcccagcgggaccaacgcagaagactggtgatttctgcatttccaactcaggtacccagttcatctcattgagactggttaggcagtgtgtacaacccacggagagcaaggagaagcagggtggggcatcgcttcatctgcgaagtacaaggagccaggggacacctgtcccccaatcaagggaagctgtgaggaaccctgctaccagcccagtactacgcttttgaaatggtttttgcgatccgcagatcaggagattccctcgtgtgcctacaccaccagggctctgggtttcaagcacaatattgggcagctgtttgggcagagaccgacctagatgcaggagtttttttcataccccagtggtgcctggaactccagtgagacagatccgttcactcccctggaaagggggctgaagccagggagacaagtggtcccctgcctcaatgggtcccactcccacagagcccagcaagcaaagaaccactggcttgaaattctcactgccggcgcagcagtctgaagtcgacctggggcgattgagctttgtggagagaggggtatccgccattcctgaggctttagtaggcggttttcccctgacagtgctaagaaggctgggaggtttggactgggcggaattcaccacagcgcggctaagcagctatggccagactacttctctagattcctcctcactgggcaggacatctctgaaggacagacagcaggcgcagtcaggggtttacagataaaattcctatctccctgggatggagcacgtgggggaaggggaggctgtgggcgcaaccgcagcagatttaatctttcctgcctgctgcctctgaagatagcagctgatcctgacaaggggggttctcccagcacagtgcaccagctctgctaagggacagattgcctcctcaagtgggtccctgacccccgtgcctcccaactgggagagacctcctaacaggggtggacagacacctcatacaggagagctctagttggcatcaggccagtgcccctctggaatgaagcttccagagaaaggatcaggcagccatcttttgctgttctgcagcctccactggtgatacccaggtgaacagggtctggattggacctccagcaaactgcagccgacctgcagaagagaggcctgactgttagaagaccaactagcaaacagaaagcaataacatcaacatcaactaaaaagacccccacacaaaaaccccacccaaaggttatcggcctaaaagatcaaatgtagataaatccagaaatatgaagaataagcagtgcaaaaatattgaaaattccaaaaaccagaatgccttttctcctccaaatgttagaagctcctctccagcaaagacacaaaactgcatggagaatgagactgatgaattgacagaagtaggcttcaaaagatgggtaataacaaactcctctgagctaaaggagcatattctaacccaatgcaagaaagctaagaaccttgataaaaggttacaggaactgctaactagaataaccagtacagagaggaacataagtgacctgatggagctgaaaaacacagcacaaggactttgtgaagtatacacaagtatcaatagctgaatcaatcaagcagaagaaagaatatcagaggttggagatcaacttactgaaataaggcatgaagactagattagagaaaaaagaatgaaaaggaatgaacaaaacttccaagaaatatgggactatgtgaaaagaccaaacctacaattgattggtgcaactgaaagtgatggggagaatggaaccaagttcgaaaatacacttcaggatattatccaggagaacttcaccatcctagcaggacaggccaacattcaaatttaggaaatagagagaacaccactaagatacccctcaagaagagcaaccctaagacacagaattgtcagattcttcaaagttaagttgaagtaaaaaatattaagagcagccagagagaaacgttaggctatctaaaaagagaagctcatcagaataacagtagatctctctatagaaaccctacaagtcagaagagaatgggggccaatattcaacagtcaaaaaaaaaaaagtattttcaacccagagtttcatatccagccaaactaagctcaacaaacaaaggagaaataaaatcctttcctgacaggcaaatgctgagggattttgtcacccccaggcctgccttacaagagctcctaaaggaagcactaaatatggaaacaaaaaaccagtaccagcctctacaaaaacacaccaaaatataaagaccaatgacactatgaagaaactgagtcaactaatgtgcaaaataaccagctagcatcataaggacaggatcaaattcacacataacaatattaaccttaaatgtaaatgggctaaatgcccccaattaaaagacaaggatgggcaaattaggtaaagggtccagacccgtaggtgtgctgtattcaggagacccacctcacgtgcaaaggcacttgggctcaaaataaagggatggagcaatatttaccaagcaaatggaaagcaaagaaaaaacaaaacaaaaacaaaacaaaaaaaaccagtggttgcaatcctactctctaataaaacaggctataaaccaacacagaaaaaaaagcaaaggagggcattacatagtggtaaagggatcaatgcaacaagaagagctaactatcctaaatatatttgcacccaatacaggagcacacatattcataaaacaagttgttacagacctacaaatagacttagactccagcataataatagcaggagacttttacaccccactgtcagatagatcaacaagacagaaaattaacaaggatattcaggacttgaactgagctctggaccaagtgaacctaatagacatcaaaagaactctccactccaaattagagaatacacattcttctcagtgccacgtagcacttcttctaaaattgaccacataattggaagtaaaacacttctcagcaaatgcaaaatattggaaattataagaaacaatctctctgaccacagtgcattcaaatgagaactcaggattaagaaactcactcaaaaccacacaactacatggaagttgaacaagctactcctgaatgactactgggtaaataaaaaaatgaaggcacaaataaagaagttctttgaaactaatgagaacaaagagacaacataccagtatctgggacacagctaataaagaagttctttgaaactgataagaacaaagagacaatgtaccagaatctctgggacacagctaaagcactgttaagagggaaattaatagcaccaaatgtccacatcagaacgctgaaaaggcttgaaatcaacaccctaacatcacaattaaaaaaactacagaagcaaaagcaagcaaattcaaaagctaatggaagacaagaaataactaagatcagagcagaactgaaggagatagagacaccaaaaacccttccaaaaaatcagtgaatctaggagctagccatagccatactgtttttttgaaaacattaacaagatagatagaccactagctagactagtaaagaaaaaaagagagaagaatcaaatagacacaataaaatgatagaggggatatcaccactgatcccacagaaatacaaactaccatcacagaatactataaacacctcaaagcaaataaactagaaaatctagaagaaatggaaaaattcttggacacatacaccctcccaagactaaaccaggaagaagttgaatgcctgaatagaccaataacaagtttggaaattgaggcagtaattaatagcataccaatgaacaaaagcccaagacccgatagattgacagacaaattctaccagaggtacaaaaggagctggtactcttccttctgaaactattccaaacaatagaaaatgagggactcctccctaattcattttataaggccagcctcatcctgataccaaaacctggcagagacacaacaacaacaaaaaaaattgcaggccaatatccttgaggaacatcagtgcaaaaatcctcaataaagtaatggcaaaccgaatccagcagcacgtcaaaaaacttatccatcatgaccaagtcggcttcatccctgtgatgcaagactggttcaacatacacaaatcaacaagtgtactccatcacataaacagaaccgataacaaacaccacgtgattatctcgatagatgcagaaaaggcctttgataaaattcaacatcccttcatgttaaaaactctcaatcaactaggtattgatggaatatactcaaattaataagaagtatttatgacaaacacatagccaatatgatactgaatgggcaaaaactggaagcacttcctttaaaaaccggaaacaagacaaaaataccctgtctcaccgctcatattcaacatagcattggaagttctggccagggaaatcaggcaagaaaaacaaatgaagggtattcaaataggaagagaggaagtcaaattgtctctgtttgcagatgacatgattctatatttagaaaaccccatcgtctcagccccaaactccttaagctggtaagcaacttcagcagtctcaggatacaaaatcaatttgtaaaaatcacaagcatttctatacaccaataatagacaagcagagagccaagtcatgagtaaactcccactcacaattgctacaaagagaataaaaggcctaggaatacaatgtacaagggttgtgaaagacctcttcaaggagaaccacaaaccactgctcaaggaagtaagagaggacacaaacaaatggaaaaaaattccattctcatgggtatgaagaatcagtatcgtgaaaatggccatactacccaaagtaatttatagtttcagtgctattcccatcaagctacccttgactttctacacagaattagaaaaaactactttaaattttaaaaccaaaaaagagcccgtatagccaagacaatcctaagcaaaaggaacaaagctggaggcatcatgctacctgacttcaaactatatcacaaggctacagtaaccaaaacaggatggtactgttaccaaaacagatatatatagaccagtggaacagaacagagacctcagaaataacaccacacatctacaaccatctgatcttcgacaaacctgacaaaaataagcaatggtgaaaggattccctatttaataagtggtgctgggataactggctagctatatgcagaaaacagaaactggaccccttccttacaccatatacaaaaattaactgaagatggattaaacacttaaatgtaaaggccaaaaccataaaaaccctagaagaaaatctaggcaataccattcaggacataggcatgggcaatgacttcatgatgaaaatgccaagagcaattgcaacaaaagccaaaattgacaaatgggatctaattaaactaaagagcttctgcacagcaaaagaaactatcatcggagtgaacaggcaacctaaagaatggtagaaaatttttgcaatctcatcatttgacaaaggtctaatatccagaatttacaaggaagttagaagcacttaaaagaggaaaacaatcaaccccatcaaaaagtgggcgaaggatatgaacagacacttctcaaaagaagacatttatgcagccaacaaatgtatgaaaacaagctcatcatcactggtcattagagaaatgcaaatcaaaaccacagtgggacaccatctcgtgtcagtcagaatggtaatttaaattaggaaacaagagatactgctgaggctgtggagaaataggaacgctttcacactgttggtaggtgtgtaaattagttcaaccattgtggaagacagtgaggagatttctcaaggatgtagaaccagagataccatttgacccagcaatccgattactgggtatacatccaaaggattataaatcattctaatataaagacacttgcatacgtatgtttattgcagcactatttacaatagtgggttaggttggaaccaacccaaatgcccatcaatgatagactggatgaagaaaatgtagtacatatacactatggaatactatgcagtcataaaaaagaatgagttcgtgtccttagcagggacatggatgaagctggaggccataattctcagcaaactaacacaagaatagaaaaccaaacaacatatgttctcaatcataattgggagtagaaaaatgagaaccgttgaacacagggaggggaacattacacacaggggcctgtcaggaggtgggcaggaaggggagggagagcattatgacaaatacctaatgcacgtggggctaaaaacctagatgatgggttgatagttgcagcaaaccaccatggcagatgtatacctatgttagaaacctgcagattatacacatgtatcccagaacttaaagtaaaataaaaaagtctgtacacatacgtgtatagctgctttatttataaatgccacgttagaaaaaacagcaatgtctttccacttgtgaatagtgaaacaaagcatagtacatccatacaatggaacactactcagtagtataaaaaaaagtcagcaataagctatggatacctgcaaaaagttgggtggatcctgaggacattatgctgaatgaaaaaagccaaagtcaaaagattagatactatatgattccatttata

SEQ ID NO: 404 - DNA, 20001 bp, Homo sapiens
tgcttgactgctgacaacttctaagcaagccccttgcctccctttcctattatgctcattatctggaaaaactgatatgaaaaccgaggtgttccttcctttggcagtgatagcaacttccaacttcaaaccacatgcaggccccacccctaattaccataaaaaacctgatgctataaaaaaccctgctcactcaagccacttttggaccagcttggaagtcctgccttgctttcctcagaaagccttattatttgagttaaatatccgttcaccccctcttggagtgtgtggtgtgtgtgtgtgtgtgtgtgtgtgtgtgtgtgtgtgtgtgatgtcatcagtctcaacagctaaacgaaattttgtgtggctgtccatcttgcctctggaaggtggtcatgacaatcagcactgtgagcctgctagatgtctagatgatgactgcttccaccggagtcttttctttcttgctttggcttccagtctggctctgctgtcttgctctgggttgctgtgtgctgactagggggctctttgagttgtgttgctgcctgctggcaaacttgccctttgagctgtgttgctttgggctgcatttgctgagttctgctgagcctctgttacagatttaattgacccaagtcagaagtttcaaaaactgggatttaaggacaggagtatgggattgggggccctcttagggaggccctgaatcgtgttcctcagcccagacctgtctgtatataccgtattgaattgtatttcttgattccagcataaactgggactgatgctaagctaaggggaatggctcttaccccgtgactactggttgtgtgtctcaagcgggtgccggccctcattctacggagttttcagggaaaagactgatatgtggtcccttctggtggtcactcatgtggaagaagagcagttactacgtggcatgctgaagccacgctcctaaaaacagatggcagccaggcgcggtggctcacgcctgtaatcccagcactttgggagcccacggcaggtggatcacctgaggtcagtaatttgagaccagcctgaccaacatggagaaaccccgtctctactaaaaacacaaaattagccgggcatggtggcgcatgcctttaatcccagctcctgggaaggctgaggcaggagaatcacttgaacctgggaggaggaggttgtggtgagccaagcttgcgccattactctccagcctgggcaacaatagcaaaactctgtaggaaaaaaaaaaaaaacaaaaaaccagagtgcttactaactagagtcctgtaaaatgtcttggctgctgttgctgctgttgctcctgttgccaccgctgccgctgcctatgcctctgttaccagaaaagatcctcatcctccgggttataggagaaaacacacatggcacagccaaagggttaattcaactatttccatgggggaggcctcgagccctgacaatacagatttgagactccttggaggaataaatatataaatatgggcagagtagagagaattcctctcctgccaaattatattcagaaaccacaagaaagatagagagagagagagaaacctgaaaacagggagaagaaacaaaaaattaaaacaaagatccataatttgatacaattggaaatccaaaattggctaaaataatttatacatctaaaagataaaaaggtgtgcaggctgtcttggtgtctccaccacataaattctgaatttactttcacatttgctgacatacaataattgacaattcttcatggtcttaatccatactgaagctcaaataatacttatacctggggatcctattaaatttaaacaaggtacccctgtaatcttggggaagttaatgaacaaaaaatagagaacaaacaggcatgcctcactttaattagcagaactactgacttgcttaaatttcccacgatcatagcatcctctaacgtttcccacaatgggcatggacagtctaacccaataagtcataaattaaaattaaatcaagtccttggcatttataaattggtttggcaaaatgggacaccatgggcctccccaagccctagttaaaatagttaatatgccccagtgtaaattaaaacaggacctttaaggagtgaagcccattaaacaggatctatttagagaagggttgtttatatccattatttttccatcaacaacctaatttggcctatttttaaacttgggaaaaatgaatggtgcctcacagtggattaccacaaccataatgtcatggtcatgcctactaaggctccatacccaatattactgaaattattgacttatccaattggcagctggtagatatttccttcttatggatttggctgtcaaatattctgttgaatgcccgttgcaacagcttctcagtcacaactcgcttcaccaccaaggcggcatgacacagctttcccagatactcagggattgcctcagcagccctgccatgacatgcaatttttgcagtcaagctcttaaatgcatctgactttctccaggagtacagatatgatttacattgctgaatcctcctccaaagagatgcatttgatacacgcgttcaggacatatagataccaaggagctcagaaaaaaagggtttgccgttgtcccacaggtcatgcaaagtcctgccacattaaatttcagaaattatttggtaaaccaagagctactccatccctgacactgtcaaaaaatagctattgagcatcttagcgcccacaatattacaataggaccaacatcttttaggtcttttgaggtcctgaaggcaacatattcttcatttacaaactttacttaagcccaaatatgctgctacttgcaaatcatctcaccttgcatagggccctctttaacaaaaggctctaaaatctgtctaaattgtagtacaatgcacatgcccgttaatgccctccagagactccttcattgcagagactttataatctctgtgcttcttggagtctctgggccacccccaatagccactttcccttaaatgttatcccattctccctgtgaatcatcaaaagaaccaatcacatctgggtagactgaccctcatggtatctctaggctgattgtaaacctagaaaaaaaaaacaattctgcacaccagcttatattataaaagcattttattgaacacattctggaggtagttagaaccaaaacaaaatttgggattggggtggggattctgttttgatgatttagatttgggaaaactttgggttctcgtgtcagcaggggccatgctgtgggaaacctgaaggctgatttgaagcagaatatagaactgcggcacgggagaccaggggctgggaatggggctctcctgggaaccaaagaatgtggttctgcaattggcttggtctagactactctccagaaaaggataaaacatggcttgagcaactgcctagaagaggcaatctccatgggctgggttgctgcacttggaaggcagtgacttgcagcaggttcttagctcttgaagctcttccgggaggaggaggtggtggagacaaatttgacgctggagctgctacccccgccactgccaaagcccacccccagccctcggccactgcttgcactgaagccagagccccccacactgagcccaccacctaggccgacacccccactgctgctggagtagtagcttccactgctacctccggcaagacctccaccgaggccgccgccaagacctccaccgaggccaccgccatagccactgccactgccatatccagaggaaacactgcttgtgacaacagctgcagggaaaggagggaggactcagtgagaccatctgccaggctgatcctgcatggcccatttatttgatctgctggtgttggagcactctactggaccccctttacagagtagcaaacaaggcccggaagaactgtcatttaattaaggtccctaaaaaagtgggtgagtgtaagaggcaaggtgctaggtactgagaggagctaggtactgaggggagctaggtactacagggagctaggtactgaggggagctaggtactgaggggaggagctaggtactggggggagctaggtactagggacaaggcaggggacagggtccaagaagcataggatgcatggcttaccctttaagagatgagacataagccacattgcttcctgtcccaatctgtccttcccctccaccacccacaacttactaagtgtattattataaataaccatatgctgggatgggaaaagtttggatctagaaacagcagaattctgagttggcactaaatatatcccatattattgtcgttgttaatgtctgttcaaagctacttacagatgttgactggtccaactccttctccactgagtctgaaaggggaaaaattgaattaagggttaacagctcccaaaaagacagcattagtctatgtggctaactcccatcctcatgattcgagttcattccataagccaggagtctgtacacccaaaagctgcttaagttaaaggaagggagaactctccagagggattttccaatgaagagggattgacctagaaacaagttgttaggaaagaattataattcacattcttctccacccactatggggaaagtataagagatttggaaaatgtgattatgtcgaaagcagtttttgccttgtaggagttacattctgtgagagaacttggcacggacagaaattcctccaacagaaagtaggcaatgggcaatgtcagaggttgaagcaaacagtagtttgacaatccaaaggtagctgagtttaactcagctggagtaaacatgaaagccttcctgaaggaaggggtactggaggacaagggtggatggaggtgggcatgacatggatattgaggttgagcaaaggacgtgagcaaaagcagaaaaggcacaagtgtcaagaagattgctgagttgctcaggtgcttggaggacagccagtgcccaggaacaccggtgggggaaaagagaccagaaaagtgagttgaggtcagctatatggccatgagtcagactgaaatagtgttgatgatgtgtcattatcacgcacaagtcactgatctcatgtatgtgtgttgtacaccccacagtagagcagcttcgctttatcagctgaaggccatcttgagttcatgctgtctactcacctgcattcctcgccctccagcagcttgcggtaagtggcgatctccacgtccagggccagcttggtgttcatgagctcctggtactcacgcagcagccgggccatgtcctgcttggccttctgcagggcctcctccagctcggccagcttgttcctggcatccttgagggccagctccccacgctgctcggcatccgcaatggcgttctgcagattggcgcactacagatagaaaggaggagagtggggttgcttgggacctgaggtgtctccttctgagtttctgggtcagacaaaccaaactatcatgaatcccagagagaaaccagtacatcgtgggtggcaggacactgaaacactggtactggatctagctgcgtgtgtttagcaaaagtaaaacaaaataaaacaaagtaggtgtttcttttagaactcaggccccttccttgccctctttcaatctcaccctacctgtttcttgacattgtcaatctcggctctcagcctctggatcatccggttcatctcagagatctcatgcttggtgttgcggaggtcatcgccatgccggccagctgtctgctgcagctcctcatactgatgcagccaggaaagaggaaagattctgtttatatgagaatgggaagaactttcccaaagttcacaggcagtgagtactaagtggtggcaaatagtgtggggctggttcaggcttttccaaggctgagctagtctagtgcctttgctctcctggagacactggtgtgagattcagagtgagattatttctcaggtccttgggtttagatggaaattgtctacacagccattcctataaagcatcccaatgggcttcagcaggttccaggagccccattcttagtgtcgtcatggcctagaatcctagacatgggtgtgtcccctcactcaggagacagtcatcagagcacccaccttggtctgataccaggactcggcttctgtccggctgcggttggcaatctcctcatactgggccttgacctcagcgatgatgctatccaggtccaggttgcggttgttgtccatggagaggaccactgaggtgtcagagacatgcgtctgcatctgggacagctcctgcagggagatttggagtcggtcatctggttctgtgttgtgttatttaatgtcagttccattcaaatctttcactcattgtgatatgacaacttgaggaaaaaaaacccacccatgtgaaaaatttagataagtttcttaccgcatcaaagaacatcttcatgaagttaatctcatccatcagtgcatcaaccttggcctccagctccaccttgttcatgtaggcagcatctacatcctggggaaacagggatgattggcactgcacacaccgtcaccctactcaagtgagctccacgcttagagagcatagctgcaggctgctggttctctcccacccacacgcaccttcttcagcatcacaaactcattctcagcagtggtacgcttgttgatttcatcctcatacctggtggtgaaagggatgggaagtgtttgtcagaggatgagcaacaggtaaggggtctttattatgcagtcaactgtaagcctacttttgcagtgggaaggggcttctcctcataggcagagagggaggggacactggtagcatgaacctctggccaaggtccctccccatttaaatactgctttctctgtaactgcctaccatataataattctattattgctctaattcagttgtttcaagcagattcctgcagaaaagctgtgctgtttctccccaactgcattacctagtcaatttctctagtgttcttttttgagctttcagaggctttaaaaaaaaaaagaaaagaaacaaaattaaatctagcatcctagttgctggttcataagactaaagaaattacttgagccaccaagctgggttatgtcaccagctcctgctttgagacaaatctatccaaaggcccatgtaccggggaggaaagtcccagagagcaagccttacatcagggcagatttcaccaggtagtgccaagggcacagagcatgttgctctggctgttgactaagttccttgcagagggcctgagcctggggctggaactttctaaacatgagcctggcttgtgtatttgtttgtttgttttagtactggaggtgtccatggaaggtatatcctcccagccccaaaggaaggcatggtagtagactagtaacaaagcccatctggtaccaagaagacaccaccctcccctgtgtccaccctccaccccaactcacttgttcttgaagtcttccaccaggtcctgcatgtttctcagctctgagtccaggcggccccgttcccccacgatgctgtccagctgcctcctgaggttgttgatgtactgctcgaacaacggctccaggttctgcctcacagtcttggtgccctgctcctgcagcagggtccacttggtgtccagaaccttgttctgctgctccaggaaccgcacctggaggggagcagggtttgaagatagagaaacttggatttcatgttctatgatcaactcactaaggtgcctcccacctctttccgtccctctaaagcttttctgtgcactgtgcctggccctgggccccaggaggggaggtgcagactgaggcacccaaactcacttttccagggggagataggacacctatccagggcacagaaagcactaggagtgctgcttggagtgtgtcccggctcaggggtggctgcaaaggcactcaggctgctgcccatgcacttgtctaccttcctgtacagtcagcccctttatatatggcatgaaattcatctctctgtccaacagttgttaagaggcccttgtgagctaacctctgaatgggaagaaataattctcccttcccagctgccagtctaattcagaacgtgtccacaaatccagggcacagaaacaaacggaaacacagaactgtacaactataaaagtatttgcacaaagccaaaacatcttccttctttctctctctttggcatttatttcagacccacagtgattttttacaaaagatcgtagctcaccttgtcgatgaaggaggcaaacttattgttgagggtcttgatctgctcgcgctcctcggtcctcaccctctggatgctggggtcgatttgcaggttgaggggagtcaggagactctggttgacagtgacctcttggatacctccaggagggcagacaggaaagccagggccaccgaagccacctccaaagccagctccgccaccgagcccaaagccaccaccagctccaccgccgaaaccaaatccactaccggcaccacctccaaagccatagccgcctccagcaccagcaccaaaccggttcctgaagctgccaccactagtgctgatggatatcctcttggagccccccaggttgtagaggctccggctgccatagccacccactccacaagcacccgcaaggctgaccctgccgaagccaccaccaccgccacccccggaccgggacacggaggtgaagctggtgcgggagacagacggggtgatggcagaggcggtgctgaagctacgactgcccccgctccggaaggacacacttgactggcgagacatggtggcttgttcctggtggagcaagagaaccaggcactagtgggttgggaggtgctggagagaacagagctcagcaggacgcagaaggtggctctgttacccaggaacggtgatgccccctttttatcccttccagaactgggctgggcgagagagctgtcgagctgtgaatgattaagtgggctgggcatgcctggggggcagctgtgagctcaccggtcacacctgcacagtggtgtggggtgcaaacgctttcttcctggcaggctctgctcagttagaaataaccttgccttgcagcactgatctcttggcagcaagttggtgacgctgctagcaagtatgtcttcaccatagaggctgggggctgtgagcagcccaaaaaggatgccaggaactgagggggcattggcatggccagtgtcctggggactcttacaggaccaggagtattgacaaccatcccagtacggtacatgctgagcacctgcccttccagcttggggaagctgtccatcagcggggggcaaacgattccccagtgatctgctcttacacttttccaggcagcaggttgctgcagggttttcccctctgggaaaggcaatctgtagccttatattcttggttatgtgctagagggaaaatagagtttcatccttttctgcacaatttttttcttagggaaggcacagctatcccagagcccactgggcagatctgcctgcaaggtttaggccagagaatgtgggaagccctcagcgccccctataaaccactttgacctctttaaggccaggtttatccttccatagctcctcctaactcagcattttttctgccctttgaccttttccttgctctttggcctgggcaggactctgtggggggtttaggaaacccggggatcccatgcaatcccttaaaaaaaaaccctgagactcatgggctatagcgtctctctttgggggtagctactctgccggttccccagccccccaggtgtgttccagcaagctctattccactagggaagaaatgagtcatcgtatgtgttgatacaggctgaaggccgccacaaacacatacctgcaggagcttctaatctcatcaggaacatgttgagagtctgacggcctgttataacggcgaaccaccctgttccaagcagcgggacttgctctgctttctctatgctgtagcccacagcctccttcagggccaaggcaatggaaaacgggattctaagtctatggattgtcctgccagaaaggctagccagagcaggcctgtgggcccaggcagctggcatgacaatctgccagctgctttagggagggccctttgagatcccctctgcaaaacttgtctggggggttgtggcaccaggtggaggaaagggggtttctgatgaggttttaacacacgtctgttctaaaccacacccactctttttggcagcagatctgagtggggccacctctctgccgtcccccaaatagaagcagggctctcaggcaggacagtgcttgggctgttcagagtttcgggggcgccctgtggcccgaggctggaggtaggaatgcaatggggatggcttcaaagcctcagggaggaggggctatattctcaagagtagaagaacaggaccagacccaggctcaggaatctctcaccagggcctgcggttggccacaaggaagccaaggcagtgggaaaatgactccctggtgctgaggatcagctgaaacagtgacttctcaccagagggctgcgatgagcaagcagctgacaggtcaatctcggcagacagaccaatggccggagccggtcttacaggtcttgagcaaaatggtttgggtggcctccctggctggagcatttctgagaccctcagagatgaattgtgctgagctcaccattttcacatttggttgctttctggagaacagatgtgagtgtcctggaggcctgagacataccaggggaccctcggctcctgatagaacagaacagatccaagcctgaagcaagtgtctgaggactcgtagtgggatgctcctgctccactcaaagatcgatatcggggtatatccccaccaccacatacactcacaggtcccgggtacagacctcactgccctcagggaagccccacccctcctgagacactgggacattctcttctccccattcattctcctcccagctgtgttgtgaagaaagaggacttggcagagcaggaatgcgttctggctagtctgaggattgctagagtgtgccaagctcagatccatgtgccagggaccaacggtgagtgtgtggtgctccatgggagcagggagcatgtgggtgctccatgggagaagcagcagcactcttctatccgagcttcgtgggaatcctcccatgagcaggcagggcagcccctccctcaatgccagacctggacaggtataaataatggagccgctcctggtggggagccaggcaccagcaccactgcagctcgggagagtcccaccccagcctggaatttcactgtggcaggaagggagggattgtgttaggctcaccagggagctttcctgctgggcaccccacagaggcagttcccaggcttggtgggacatgttgctcagcttctcctctgggtgctgctttccttgtcagcagaagacagtgcagggcccgccctgctgctctccccatcagagaaaggacagtaagctggctgccctgacctctctcgcagagctgtgcagggaatgtaggacctggtcagcatttcatacatggagaagcccttcacagacaccagggagagggtggtatccattcgtggaacaagggttaggcaaatcctgccatcccagcccaggattccttctcctcagagcctccactccaatctgtagggctttagtagaagatacatttaatagagcatgataaatagaacatgttccataaaacagcatttgtacatatcctctaagtcccccccagcagggcagtctccaaggttagggaacatctctgcatggcccacaccctcagcccagccttgggcactggaagtgttctgcagatattttttggagtgaattgacagacagaaaatcctcttcctccgctccttccccagattgttatgtgaagcccacaatggcaagaacctcaattgcttttgcaccaacctatatctacaccaacctatgtataacagaatgtatatacattatatatattcacatatatttctgtgaatcctccagccctatgctgagtctcagagtcttgtccatctgattttgtctctcagtccgtgtctacaggatgagtctgttgtccccttcacactgggtatgctctgtgtttaggatttaggatttaatctagcatttaggattctttattccttaggcttccctccatccttcttcttccctcacccttattctgagggtgttctgcatctgagcccactaacaagtagcctgcacgtgccaccccagcccccaggcccctccaggagagaaagaaagctttagtggcctcaactttgcagcccttccacctcacgcttgttcagcacaaaaagtggggagcaatagttgaggtgtgagtcaccctattcattgggctatggttggcagccccatcagggagcctgcagccagattcgcaggatggggaagggcagatggaacagcgggccagcccaagatagctcttcacaaagccctagcctcagggggaattgagggaagaattttcctgcctccacccaaagccagcggaatcttgcccccatcccaacctgggtcccagctctggtcctagctagattctcagaatcacagggccctgaggggagtggccactctggatctgcagagctggacacaccaccccctccctcctacagcccaatgtctctagggctttcagaccccagtctgaaaaccggactaggtagaaaggcaaatgtccagacataaagcaactgctcagccttggctcagagggcctttggaggtgagtccctgctgccattattgaggtcatagtgacaagttaccccctggagttgagtttttcttgtgcacgggcttcgcacacattgtgggtcacagcataggtgcaaaagcatgtggcaccactccagaccatgtgttggtcctgacccagtccttggatgggtctgggaccctgagcaagttgcctaacctctcactgcatagttttgtccagtgcagctgggagagaagggaggggcctgggctcattggaggggccatgcaagctggaattttaattttgagctggctggggctgagcaggaagggaggggcaggcctgcagggggctgtggggagcagccttggcccccatcccttagattcagcagccgattggccctggcaggagagggtgcagagcagagccctccgcttccctccagcaggcccctgcaagtctgaggaatgttcttccctcgtatgaaaggtgttttgctcatggcacaccaaactctttgaaaatcccccttggttgattgaaactatgggctggaaatcaacaaatactttaattagtcagagggactaaaaaaggatatacagcaaaatcctctgcgctttgctttctcatagagggtggttttattttttaaataaacacttacgtaggagtgaccatgtgccaggcactgccctgcacactttacatatatgaatatgaaactagagcatgcaaagaagggctcttagcacttcctcagcttggctgtccaatgtaggtgtcagtgtgtcccatactctggggatttgcagcctccctcttcagtggagaggcagagacatgactcatttacaccaggttgtatccctgcagcatcagaggtgcagaaggaagcttgctgacatccccaactcacccactgttccatttctccctgctactttctgttctctcaccagtagccacaactgggaacggggaggcagaggagacgctacagctgcccccctccccaagtttgtgtttggctcagggcttcctggtcctgggagggagggcaagtgccggagacagagccttattccatctggctttcctgctttgggtgagcactgatcatgggtggggggaaggtggggtgagtcaggtgagctctgatcatgggtggagggcaggtggggtgaatcagtacagaaggtggtaatatggtgagggagaaaagaaagtaaatgacagcattgaggctggagctgttgcctctcccagggccaccctcaggaaatgcactcggcatctgcacagtcctcaaggccatgggacaccttgctggccccagtcccaccgtctatgtgagactgtgaccctgtgtccttccccatttcctccctcagactccaggacacactcgcagctcccatcttcatgttccgtgagcacatgtgaacactgacctgctcactgtccacttggaccaacgatcactgttgagggtttgtgaaaacaggttaaggcttcttccaagggagacgcagtgcaaaaagcaactgagacaagagagcgtgcaggagtgtttcaattcatgccagtcattgaatcaggtcctgttccacatgtgtgacttggccaaggcagatgccatgcactggacttctggactctggttgtgtgaccctgtacccttccccatttcctccctcagactccaggactgcgaacagggctgggtctcctctaggatctccttaccagacccaggatggtggcccacaccacttgacagtgacgggtcactgtgcaagggccgggttagggaagctggcctgacttggtttcagagaaaaaaaccagcccagtgatccatccatagaggaacaggctgagttcagggaggtggagcctaacgccaagcccttggcaaggtgaggtgagagccaagcctgggtcctggtcctgtcccacacgctgttgttgccctgcactgcccatctgggcctcagcaagagcctacttgtctcccagtccaaggctgcacgtctcagtcctcttcagagagccatttcccgagggctgtgtgcatgacagggctgacaggtgactgtgatgggtgagggtgtttttactgctccccacccctcccctgtccagagccctcatgtccaggtgctggtctgggtctttccagggagcagactggccttcaagcctaagttagcaccgaagcctgttcctccaaggcatttgtctgctctaggccatgaggtcccaccagtctgcagacgctgatcgcctctactccagtggctgataataaggagttagaattcacacatgactccctctgcccgtgcccagagcctcacagtacttagctgggcctccagtcaaacccacatcctctgtaacagttgtcaaggactcccactatttcttgctcattcacaagtccctggtccccagggcctttcggcctcacctccactctccagccaggtggatcccttcacagcctcaaccccatgtcggccggttcccgatttaatgttagagggtcagtgctcagtgctggttctgcctgctccctccctccctacactgtgcctccccactcccatcttctctggcacaaaacgtgaaacaaggacccagatgccttctctggcagtctcttgcaaatgggggagatgtggagatgtatctgacgatttctaggcagcttgtctctctgaagttctggactttcatgatccccaaaaagctcacagcatgggatgagcctgagccctcgatgtgctctgtggcttggtgaaagatgacagcaatcaccacacttgagtggcactgactgtgagccaggcatggttctggatgtatcaactcatttactcctcacagcctcgtggggtgggcctaatatgatccctgttttgcagatgaggaaactgatgccctgagagggtaagcaactggcaagtgacagagcctaggtaagagcccaggcaagggtgtctccaaaagcccttgtcatcaccattgtgggcacttggattttcagtgcaggacttgtgatttgactctgaagaggatgacttcagcagaggcctcaacctccggatagtctgtgaaggcagcaaacagagagggccccagataccactcagcagtcagtataccataacatcttccagcagccccaagagagagggacccctgccctggagtatagacaggggaggtgcccttggagaccccctcccttctctgaactgccagaacccagggcaggaccactaagactctggggcaagactcaggggattggggttccctataaaatcctatacaatgtcctcaagggggaagcctggggatcgcctgacacccatctccctcctaccctggcactaggcccagggcaaagcccagatgcttcctggggcagtccttccagatgcatgagacgtggctaacaactgctgatacttcctaataccttgggagtagcccagtgtcttggcccaagcttcagcgattcgctctattcctcccctctccaaaccccacaaccgcttatggccaagacactcaaacagggccctgcaacactttgttcaggatgagcagaggccatgatcaggagagtatgaaatggaataacccagcctgagcattatttggcattttggatcctttgggatgggccaaaccaccctgtggcctcttagagactgaccagctccttgcatgaggctgccccacttagaaaagaaattagcaccattcactgagatatgtagcctcgttgcttttggtgatactggacctgatttcctccagcccttctttgaagtgaatggatactgagtgcttactgtgtgcctgacattgtgccaaaatgtagcatgcgttatcttacttactattcatccatattcatccacaggtgatcagcactactatttgtcccgttttctgagcctcagaaaggaacatgtcttacctaagctcatatggataatatttgtcaaaactggaatttgaccccaggtctggctgctcctagagcttatgctctcaatcagcacataaggggaattgctgaggggaccctgaagagccagtatccccgtcagcaacatcagcagcccatatactgaagtcacgcaaatagacatgccacttaaacaaaatggtatgctcctctgcaaaccagctttgacacagacctgccatgccaccgcccctcctaaccagatcgccacctctaagccccaagccctacccaggaagaaattctgggggtaccactagggtcatcaatgccacaatgccccctgcaagatgtagctgcgagctctctgggtctgtgaggcccaaatgctctccatctctacccatcagccttcccaggcagggctgtgccaaggagtgaacaaaagctccattcaccatgaccctctccccgcccccaccatgccctgcttccctcctctccctgcttctctcctcagccacctgccccaggagtcccagccagtttctcaatctgctctgaggccttgacccagccatcagcctcctcatccccaggccatcctggaagggagggcctcagtgtccagggctagggagacactcagcagccactgacgccacgcagcagatgccatgacctgtctaggcctctcgggcagctgacctgggcatccctgagggctgggccccctcactctggcgtcagtcatggcctcctgcaggttggcacgccaccctcagcaaagaacaataacacgttatggtctgcaagtcctcaggtacaacatggctccattgttctgagtctggaaaatgatctcactctcaccctgagaaccaaggttagccccagtccttcggtgaagcagggccttcctttgcccaggaatgcacagtagcttcttattggccttatgctcaacaattcgttcttctgggtcccccttcctcatcatccctcctaccatctatgataggtggaataatgatccccaaagaagaccccatcttaatccccagaaactgtacatctgttatgttacatggcaaagagacattaaggctgaagatagcatgaaggttgctaaccacctgaccttaaaatagggagattattctggatcatctgggtgggcctaatataatcccaaatgtccttaaatgtggaagagggaagcaggagattggagtgacaccgtctggggtgaacttgatcccctgttgctggctttgatgaagggaggagggccatgagccagggaatgtgggcaacttctagaagctggacatgcagggaagcagactctaccccagagtctccaggagaagtcagcactgccagcatcttgatttttgcccagagagactgtgacctctagatccatcacatctcaaatctgtgccgtcttaccagagtttagggtaactttactacagcaagaacaagaaacaatgtctagacacaccatctctatctagattcggctgcagccaagagagtcttctttttctctgccacactctggagaccctcttccaccttcatggtctcctcccctggccctgcctcccagccctgcctgcccttccttcatcgtgaattctgctcctggaagctccctccaaaaggtggcctcctcctgaggaccgcttttcaccacacttacttgcccaccccacagacctcgctgagcaccactgtgtagccgcaggcattggactaggtctatggaataagtgagcaggcagccttcaccatccgctggagaatctgccaggaccctctgcgggacgtgtgctttactgacccagcgtctctatgtgtttgagggttttgtccaccggtctcagatagaaagctcactgtggatttggtccctgagtctaccttcctcagtaccgacttcctctccccatccctccacattgctttgccccaaggcttagcaggagctgtgccctgtgctgactgccaggcttaggtgctcactctctggctgaggggaggaagaactggtgctggaattagacccaccctttggctactctttgatagcagtgagccctcaaatccatgcctgctgcacccagaggtctgatgaagcacatcccaccttcccagccttctcctggtttgtggaggggattggtctcccagcacctcagtggcctcatttcccaggcaactggctccgcccattgctgcttttgtccacttttggttcttcccccattgctggctgctaggtacaggttctcactctggaaagaccaaggaaggcaagatggcagcttgcagggaatagtctggttggtgaggcatatgtctgtcctagaatatgacaccataactgggatttctctgaggtcgttgccctggcagacaaatgtagacatttcctgagaggcccagctcctgtggggaggcagtgaaaaccagcctgatgcacaccttccccccagatagtcccagaggactcagcctgaaagaaatggaccctgtccatcttcccaaggccccatagccttcttagttggcagagaactgtggcaccctttgtgtagaatcttgacagagtctactgattgaggagaagaggggcatgccacataggtttatctcatcatgacctcagcagggagcacaatctaaagacaaagtatttgatctgaaaatagctttgggctgctcagcaactctgtcctgcacttcaccctacaccctcgtgagggctcccacagcctgcaccctctccactcccctccaagaaatgagcatggcgggtcctaatgctgggggacagctctagatgaaagtggaagggaaagagtagacaagaccttgagtttcctccctgaggaagccaatccaacatgggagttctaacccccaatcctggggttcacattaccaaattgagccccaccttgtgagtcagtggggcaggtgcctcccaaggcctccagcgccatggattacctgcctcggtcaggttctagagcccagcttggccttgggctgggcagcaagttg

SEQ ID NO: 405 - DNA, 20001 bp, Homo sapiens
gaatacccttagctggtcacattattccctcaaggatataggactggctaattacaaaattctcaaaggattcataaataacccccttttctgttcagttacatctcatgaaatccagccattcattacttgttaaataatgtttaacaatgagatacaagggttttgttcagtacataacctaggctgaattcttattcatcattgatcccatacagattcctaattgttccttgagttaatgttgtaaggtggatttaatgaaagatcaaattctctggtgtgtctgatgctagaggaaaagactacacaactagtcattaacattgtcttctaatgacactcatcaggttttgaaaatttgtatccattatcttttcaaatattacttttctttattatctatcactttacgttattggattccaattaccagtattttggacttttcactgatttccacaatttattctcctctctcagtctcttctcttgcatgtcttgcttataatgttatggacactcctctcactgaaaagtgacacatagcttcatcttggattgaatgttagttaatttgtaatttcttagtcccctagaatatggcaaaagggatatatgtgccatacaaaggatattgcttctttcctgctcactctaagaatacaaacccttggaatccaagcaccatcctgttagggagggggcatggtgagttcacaggtaggggcccaggtagaaagtaaatgaggcccttcattcccactgcaagccagcattcttttgaagaaatgagaaccaaataattttagcctccaggcttggagtcatccctcttaggccccaggtatcatggagcagggaaaaaccatcctcattatgacctatttgaattcttaacctgtgtaatccagcaccataataactgtttgatgatgagttcatttgctcacaatttcaaagtatgttttgaagtaattcgctatatagccaaagaaactaccatagggcaaggtaaggaaattaagggctggctccctcaactgagtgaatctgtctttcatttgaatatgagaagtagtgaatgaggaatatttttgggaaagttttatatgattcagtgggaattggttcatgtgttgggtaagtcatgagatcacaaaattctctctcttctaagtcacaaatatgtgccattaccttgccggatgcaatcaaaccagctctggacagtatttgtttttctggcagagggagatgttttgctcaaatatttcaacactaatattgtattaaactcagtagaaatcttggtgaaggtataaaccttcattaaagaaagatttttaacatattaattccaatatgctctggtatgtttaaaggacatgactgggaatgctgaagggtcagaagagtgaggtcagtttttgagactcctgtggtctgtgtatataatgcaaactcatcactgtcaattgtggggcttacctctgcttcctgttagccactgtgccagtgaaggaaaagaaacccatatttcctctggtacaattggttggaagagtcagatgaatataaatgccatgttgaatgaatgcaagatgaatgaatgattttccctagtgatacttggaaacttgagccaaagaacatgtgttctttgtgacttgccccaagtcataaagttatgccccaagataggaaggaccgtagattttgctgagtagtgatctctaaggattctaagtcataaaatgtagagtatataagaaaagagcactttctctccaagaatatataaacgataacattaagtaattcaaaaatgaatatctgtggcttttttcccccaaataaggtataaaacaattacattagtattaacaattacattactattaactaatggttgctgtgttaatctctacatgaatactttttcaatagctatgtgtataatacaaattattttggtttatatgtatagttaaataaaaattaaagtctacagaaaacaatccctaagagaaaaatattttgaatagttgatgtaaaattcaaactaatataatatacatggagactaatagaaagaaagaaatttagctttgagaaagttacacacacagttaaatgcttctattaacatctgtagaaagtttcaagtaatggtaggtaaaattgtgtgacaaatagtccaggtagtaaagtactatgagtaagcattggggttatggttatgtttaatgtgttccaggagggaattcctaatagtcttaacgtatcaagtattgaagatgtttccccaaagtattattttttaaaatgtctgtgtaaactgtagcaagcattccagagactaagatggaggtaaatccaaagaaaagggttagaagattttaagatttttattataaccttagagatacctaaagatttttgcatttttggatactccatataacttttactcatagggttactcaagattgactaaacatgtttcatttaagacaaatgagaatctgaacagagtgtgaaaccaagcacctgtaactgcttgttgagactgagtaataaataaccgggactgatgagatgcagcttacctggagaatggaagctaatctcattgtcctgagtaattattttcctgagttggaaatgtaattaagccaaagcaatcccataattgatacctttctggagctgaggttgtcaacaaacacatagtgaatacacatgactgggacatcagatgctatgcatgaaaatcaggagatcattgctatgctgttagtgaatgttttttgctgtttcctttcttcaaattcagtaaatgtggttttttctttttctttttctttttttttttgagagggagtctccctctgtcccccaggctggagtgcagtggcgtgatctcggctaactgcaagctctaccgccagggttcaagcgattctccctgcgtcagcctcccgagccgctgggactacacgggcccgccaccacacccagctaattttttgtatttagtggaggcagggtttcaccctattagccaggatggtctcgatctcctgacctcctgatcctcccccctcggcctcccaaagtgctgggattacaggtgtgagccaccgtgcccggcccataaatgtggtttcaggtgaagctattgtttttacaaactgcatagtcaagctgaattcaagaccactgccgctactagaaaagaatgggtgagggctgggcgcggtgatcactaggtcaggatatcgagaccatcctggctaacacgttgaaacgccgtctctactaaaaatacaaaaaattagccgggcatgatggtgggcgcctgtagtcccagctactcaggaggctgaggcaggagaatggcgtaaacctgggaggcagagcttgcagagagccaagatcgtgtcactgcactccagcctgggtgacagagcaagacttcgtcacaaaaaaaaaaaaaaagaaaagaaaagaaaagaaaagaatgggtgatacggagatcaacccatagaatcaaaattatctactagccataaataacatagttacaaaagtatcaaggcatattatagtaggacaactataaataaaacagataatcttaaaactacctggagaaaaatacacacattagtgtcatggtagctgtgagatgactaacaactgagttttcaacataaataagctagaagaggtgggatagaatttttagagtgctgaaagaaaataacttccaaactaaacttttaaattctgttaatatgccattcaaaattaagagttcataaacattttatctgacaaaagtttaaacgtccatttcaatcagacttctaagagaaatacattaaaaatttgttaagctagaatataatcacagatggaaagatggaatgacatgaaaaaggaagagcaatagaatgtttagatatagggataaatgaaaataaatgttgactacatatttactatacagtataaaaatgataacatatgaaatttaaaatgtatgtagtgctaatgtgatatcagcaatgttaaaggtgaaagacaaaagtagtcaaattgtcttaagctatcccaaaagtggtaaaggatataatttaaattacattgtaagaaatcaatcataaatttagatacttctatggtaattactatcagaatggtaaaagattatataaataatacactaacagaggggaaattagaataatcaattaaaactaaaacaaaaaggtagataaaaaggacataaaatagacatattacactaaataagtaagattgtagatataaacaaaaataagtctaaaattaaaatgaatgagaggctattactccaacaacgttattattcttgatgtaaaatagtgtagtagtgctttcactaaatcaaaatccaggcaataattaattacaaataagttttggcagttagcataaatgaataattctgtctttatcttcttccttccagttacctttgcccatgaagccataaaaatatataaatcccaagaatgacatttcttaacgaattatcaacattcacaacatttctatgaggtcagtttcaatactttgctaatagaatcacatttttatgagtttatttgtaatgcataactttttacagtgaaatcatcctgaaaggcaaattatctgggtgatcatttttgcattagagtaatcttatattcctttaaatactaaacaccacctgtgtattccaggaagtcttttggacactgtgtacacagtggtacacaaagcatttatgttttcttttgccaatctgaagtttacagagtattagagaagataaatattaaatatgatatttgaggatgtgaaaaatggacagattgttataaaagagaaaaagagtaatcaaattattaacggttgttcaaaaagtcctttctgtagaaatttcatgtaagctaagacctaaaggatgaattgcattagtaagataagatattaggtgtgtttaatgaggcataggatgtggcatgtttaaaatgcatcgacacaaatgatcctgatgttttagagaacgtaacaactgagcagtcaggacaaactgtgcattatttataaacaaatgcctataaaagtagagtttgaaagagtaggagatgtctatattgcataaatggtataagtagggagaccacaagaatcatacaaagccgagacaatcttgagaacataataaatcaccctgaataaacatgctaggttcataaatgtaaaccaagactgacaagatcaaatcacaaccctatgtaaaatctattatttaaatttcaattttattaaagccgagtatttccctttacacttcatatgtaaggttttgaggttgactacaaatatctaaagtaatgtgaagaaaattgacactataccagaaacaagaggataaaaaccaaaaacaatgaattggtagcaggaatgtttaaaaagcagacaatcacactcatttaatgtgggtaaggcatgccagtggcttaaaaattactacgatgagcagttgcaaaactcaaatgcaaaataaagaaattatgattacttataattctatattcactgaactacctttcttacctcagcccccttatgtctttgatttttatattttcttgatattttttaaaaaataaatccatgcattagattgagaatgaggaagactgagcaaatgtgaaaatctgttaatctatgaatataaataccccccccaaaaatatggtgacagtattgttgaatgtcttgaaaataataaatctggttatattgaaaagagaaataactaaattcctacaaaattttaacatttgtggaaattcccacaaaatgcttcatataattatggagtataagctctgcaatgtgtcagatatacagaaaataatcagaaaattagtaaaacaaaattccaatttaagtgttcaaagtttatatactaaatggttggtgttacttttaagcaagtacacagtatttgacattcaaatattaatagtatgagtctgtcagagagaatttgcctcaggaaacagaaaccaccctatgtaatttaagaagaaaattgctacagataactaaatgcttagaaaactgttggaaaggctgacgagtaggttctcactaagcctaatagaatgattataagaacaatatagaacagacctaccagggaagccactatctctgaagtcactaatgaaacaatgagttcaagaatacttgacttcttgttctccttttcctggtgacagaaagctgtgatgtaggaatcagaaaactgagatgatgaaacttcactgctgaagtcaacaggccttcaccttcacatcttatgggctaaagaataaacaatgaattcatgttctgaaaatatctgggtctgggcttcccttctgaaaagatgtttatgtacttattaaattgatttatttattatatgactattcagacaaattccacttggtcatggacattataaaactttttatatattgctggatttcatttaccaatatttgttatgcctttttgggttgatgttcctgaaggatatttgtgtggtgtgttcttcttatcttgtaatgtcaatatcatatttttgtatttgggtaattctgccttcctatagcaagttgttgaggctctcattctcttctattttctgaaagtatgtatgtatattaaggtgatgttatttatgaaggaaaagtgtgatagaattcttccaggaacatcatctgtgcctgaagatttatttgtgggaactttttttagtagaaatttatttttttattataaagaatgttatttatattttccatctttcttctgtgttagtaagagaagttattttagaattttttccatttaatctaagttgtcattttttacatatagttcatgttgtaagaactatactattgttgatttgctttttctcctttattttcctaatcgacattgctttggattgatttatcaattgtattaatctttctgaagaacaaaattttggcttttttaacgttctgaaatgttcatctatatatgattgttattttgtttttattgtttattttcttttactttctaaataattttatacagtttgtatttctaatataggtatttaaggccatacattttcatcaaaacactgcattattttcatctcacatattttgatatgctgtagctttattaatattgtttgaaatattctacaactttttattttaatttattttttgacatgagttatttagaaatgttatacttcattctcaaacatttggtaattttgtaggtacatactttttgatttctaatttaatgcaattttagtgagaaaactcagttagtatatttgaaatccttgacatttatcatgagtgtttattagacaagaatttgtgttttaacttgaacatttaacttggtaaatgttcctgctgcactcaaaataacatatattcttgagttgtttatttaatagatatcaaatattaaattttgttaagcatattgtccaaatatttaacatccttagtgattttctgtttatcattctatcaattactaagaaaggagtgttcaaacattggcagggtttatatgggatttatatgctattctttcaatgtttatgtatgttaacaatttttgtaataaaatgtttgagtaaaaaggaacgtttcatttcctaaaatatctaaatatgttaatttataagttcattgatttccacacttcttaaaatagcaaaactttgaaaaataaagaaacaaaaatcaccagtacataacaagtaaagatagagctgaaaaacacaagataaagcaatgtcatggtggtgcctgggagattttcaattcattagtggtagatcaacaaatgattgacttgtggtgcaatttcccagagcctttcttgtaacactatatgattaaaaaaaaactatataatgatgaaaactgtccatatgctaccaaatatggtagtcatcagctacatgtggctgttgtaatgtggctagtttgacatcagaactaaatttttaatttaatttgatttaattaactgatgtttaaactgaaatagctatttgtatctaatggctatcatatgtgtctactagctatcatatttgacattagagcttatagagcttttatagcatactctttgcaatcactgcacaaaattatagaggtaatttgagtattttattagccagttgttattttattgtatttaattaatgaatattgtgattacaaaactgtgatccaaatcattattatttctaaattttagttattctacatagaatagctgaagttaaaacttacattatttttactaaaaaacatattattattacctaatataacaatgagaaactgtttattctaaatatctgaagttctcatacaggctttcatattattttatgatgattatcaaataaaacctgtgtatttaatttacataatttaatttgtgattttcaaaaggaagtgtgtaggtgggagatcctatgagcttctgttactaatacatcccttgaatatcattaactgagatttattttctgttaatgtcttcagagtttggaagaagctaggtatagtgttgcaatagattttcatctaaaatgtaataaatacttttatcctatatgtaatacaatgcaaagagcaaaaatggcaaaatcatataatgtactttaaccttttctgcctaacttcctgagtgtcataaatgcttatatttaaaacatttttataatcaaaatttattggagtatagcattatagtatttttaaatggtcaattaatttttttctgcatatattctttcttatatttaaccttgttttgcgtctcttacacattgttatttcaaaatgctattctttctttgaaaagggagtatttattaatatgaacaagggctttgtcaattattatatataaaaaagaatggatttcttagaaataaactgtagacttcaggactcttcattgcatgaacaatttctttgctttatttatattatattctctgtatacagaattttgtatttgaaattttacattctttcacttaaacagtttacacagattttatagtctccagtctcataaaaccctagtacataaactaaagaataattaatagctcatctttttaattattaagaatatatttctgaaatatccactatctatttttatcatcaggttcaaagacatgaaatgagtacatttaatttaaagaaaattcacacccattttgtttaattatagagaatgatttctagagataaaagtctaagtgtgtaagtaagtttgttactttcctaaaccctttcttttcctcattctgttgtttttcttctggtgaaaattataggctaacataaaaacaatttgacacctgttagcgagaacgagaacactgtcaaggtgaaaataattttctcatttttttcttagaagataatcaaagcttaggagaatcatatattcatagttctatagaaagaaagaaatttcagatataaatcactaaacactaaaaataaaaatattaccttccccaaatgaggcacaattattatcaaatttaaaataaaaaaattaaataatattaaacaccccagtgattttgtaaatatggtattcttttggtgttgaaaatcatatggctatatattttttcttatgtgattatgttttcacacacacgttaataaatgtaagtatacatatgcatttagtttatacagaaaattaaatcaatattctctatttatattattagcaatgattaaaaaaaagaaagtagactagctgggaaagtagactagtaagtaagaagataaaaaaggaagatagattctgccaaatcatttttatagagtcatgaataaaattcacgtaattatgaaaatgtatctgcagtttattcaaataaaatcagctaaatgggagaagctcttcttattttgtaaatgtactgaggcaacaggagtttaccgttatgtattttcagttgttggaagtagatgtacactggtcattatgacttttatctcagaaacgttttagtctaatgttactgaaacccaggaaatgttgtacattttgggcctttcaactattgtactgatgaaagcagctcactcacattagcatttttaatttgacagggattacaaaaacactgggtgctctttaacttttgtcacagccatctattacattaagaacaagttgattttaatatttgtcaaattaaagagcattgtatcaagctaaccttgggtgttcatttacataattggctctctgcttgctgtgtattatgtgacaccctcatttgattactgttcatttttctgaaattccgaagcagcatctaacataacctgcatattaatatttcattttcatcaggccttactttatgcagtcaagttacagcaaatgctaccttttcattagtaagcttgttataagtctcttgtttcagagcttttaaaaaacaaagttcgattcacatgtttaacctgttccataatagaaaaacataactggactctaactgtttgtttaagtaaataaaggatcctcctgctgggttggccttgagaaaaatctctgaacttgagcaagaaaaatgtagtgcttattggcccctatatcagtcaacattttgtaatataaataaaataaaaataaaataaaatcttagtgacttacaataacaaactttttttttttttttgagacagtgtcttacactgtcacccaggctggagtgcagtggtgcgatctcggctcactgcaacctctgcctcccaggttcaagtgattctcctgtctcagcctctggagtagctgggattacaggcgaccaccaccacgcccagctaattttttgtatttttagtaaagatggggtttcaccatgttggccagactggtctcgaattcctgacttcgtgatctgcccacctcggcctcccaaactgctggaaatataggcgtgagccaccccacctggctgaataacaaactcttaattctttttcttaaatctgcaggttggctgtggctttccactgggctatggatttacagtgaatacttataatattatgttgcctgggcatctattttgagtatcagattgtcttgtaccaggagcagaacacagacatcactcaccaaatttccagttctcagctctctcccagttactgaatgtggtgagtccagatatctgccctcaataaggacttctttgtgacctccctatgggacatacagacagagtcttctggactaggcccattgatcaccaccgcgctccccccaccccaccccctgcatggactgaagaccattgctcagtcacagcagtgtgacactggcagacagcctattgtccacgtatccaacatgattcccacactgctgtaactgaacaatggtctccagtccacgcagggagcgggagaaggggcggtgatcaataggcctagtgaatcccatgttggacacttgaggaataggctttctgccagggtaaaggagtacactgtgaaaggcacactgtaacatccacaaccaaatcctctgaagtcctgtcagggcaggccgagcgttcatacacactgtcaagagagagacctcaagcacaaattacagagaaagaaaacaatctggcttaaatctgctccatctgtctctctttttaggctccagactataaagcggtgagtgagtatttgggcactgtgatgattaattttatatgtcaatttccatgcgccatggggtgtcccccaaataagacatgtataggtgtgcctgtgaaggtgattcctgatgaaattagcgtttgaattcgtggactcaaggaacttcactctccccaggggaggggtggggatcatccagcccattgagagcctcaatagaacaaaaaggtgaaggaaggataaatttgctatttttgtcttctgcctgtttgcctcataaggacataggttttcacctgcttttagtctgggatttacacttttgcctaccatggttctcaggccttcctgcttgtactaaattgaaccacactgactttcctgggagtcccaattgcagatgacagattgtgggacttagcctccataactgcatgattaaattattcaaaataaatattttttggttctctttctctggagaacctcaactaatatagatatgttccttttgtggtgaaggacagggtactgaaagcgtaatccaaaacatcttaagcacatttgaagcctctactcagatattaattaagtcaaagcagctaacatccattgccaaagtactcatggtcaaggatgaaatgcagacttttcattgacaagaaaagggagactgaatatttattgaaaaataatataacttgtcccaatccttcaaggaaatgtttcaatttgctaggcaattcacacctgcaaactcacttgatcctcaaagcaacactgatagacagatttttgtttgttcatttatttttcttatacaggttatgaaagtaagtaaagcacaccaacaagagtgaacatttataagactgaattgtttactgagcaaaggttggaatgtagacctatttaatccaaaagccttttaggattatagcctagaatggctttcttccatctaccccactcattacattactatctctcattatataagctcaatttttaaaaattgaaacactgctatagacaaagtattatttttttgtgtttctgcctttcttcctgcaattcaagccacaattttctctacaatgcatatttacttgttctgaatgaagtatttctaagaaaatatctagttactttagttctaggagaattcatagtaataacatttttgctctcaaataatgtctctacgaagccaaagtgggatggagatgtgagaaaagaagataaacttatagcaagtctatatgaaaaatgtggaataaaatgactccctacaacattcaaatgtcaagattgtctataaatttctatgtcttgttaattaccaaatcccaagatcagcaccaaagcattgtgatgctttgtaaatatctgaaattaacacataccagggaaaactctttcctctgagagaacagctgaggaaatcaggttgacaagacgctgaaggcaagagaatacctaattctacaaagctgctaaaaaataaatacttcagttttgtatatgtattgaattttcagtgtccaatctaaactcttatttttaaaaaacattgattatagtgacaaataatattctgtagacatttgaaaaataaaaacatatccatctgaacttgggtatacataccaccaccactttagtatgcattcacacacattatttccatgaacattttccctttttcttcacattatctctccccaataatctcaggatagaaggctgatgtagcaaacagtactagatatgcccatataaatttaataaagaagatctataaatttatgtctcattgatttgaattataggcttgttgtttttaatagattactacattcataaatataaacacttggtaattttcttcatagtgttttttgtgctttagatgatacattgtggttcatcacaaaatgcaactgttttaaatgggataaattatttgttgtatgtaaaagaagctgattccgccagataaagcagaaaaggagccaagagttcagaatagcaagaaatgctaggtttgagcctaggcttccccaactgctctaaaaaaaatagctctggtttggatagaaaagaactgctgcttctaagaaactctagatgacactctctgccactcaaaagtctgtagtcaactccaacctacaggtcgttactactgtccctgaaacaattatcttctttttttgattagtaactcttaattcaataaaagaagctatgcatatatttctggtacaagggaggcagagttagtgatcaccaccatttctagctcttctggcagggggcggggggtgtcagccaagcagcactcgtaaagatggtagttccacaacataatcgttaaataaatgacaaatttttgttacatcatagtaggtctagccagtcatcattgatcagtaatttttaaagatttttttcacctgtatgagttaaaaaataaaaaggttcattcagtttgattaagcacaaatattttgtctgcaatgtgtatagatgttacccattaagataatttgttagcattcaagctatttaaaaaatgaataaaacccatggaaaattattccattggttgtaattaaacatggtgcatataggtagactaaaataagttttctacatatgtgtagaaaggttttttgtgttcttggaaaagatatagcacacacgtggctacagtgaaagtttaacttacaagtgctgaatttacatactgaaggcccaaatatctacatggaagcggcaaataaaatactatattacttgaaataaaactcaagctattggcaaaataatgtaatggtagaatctgaaatttagtgacaaaatcaattgtaataaaattcaaaattgtcagcatttgcagaactatagtggtaaacataattgtatttttccttatataaagttttggtgctgcaaaagaaatagcacttgaatataaaattttctttttaattctcaggaaggcaaggtacttctatggaagggtgtgctctcacagatggagcaatggtgagtgcacacttggacaagggagggggaggggttcttatctgcaacacatgtggcccctgctgctgtgtcattcccctattggctagggtaaaaccccacaggctaaactctaattctgtttggctaatttaaaaagagtgactggggtgggtgctttggtggggaaaaaataattggttatgcagggtggagaatgagtcagggtggagcaggtagcaggtaatctgaatgagtcagggtggagcaggtgatccgaatgagtcagggtggagcaggtgatcagaatgagtcagggtggagcaggtgatcagaaagattcagggtggagtaggtaatcagaatgagtcagggtggagtaggtaatcgaaaaaggttgctttgcgagggagttaagtttaaaagtagacggcaaagaattgaacacactgacatattgattctttgaagagaaattcagaacttacatctaacaatccctcctcttgcattttcctacagatttttctcttcaaactttttaaacatgtcttggcttagttcttctgcttgattttccaaaagaacaagcttctttggataaggtgaaggatagttaagggaggttttagtaagtgccattcctatgagcctctgtaccaacccatggatgcatgatgtgacatagcacctgataagaataagtacacccattacgactgcaagggaagtaagaattgaggctattattcttttccgtttaccgaaccacttttctagccattctgtaaaagggatcatttacccctgagttgttggctaactcattggacagagcagctagaccttgcaatgcctttgttatacttccattaggggcggtgttgtttgggatgagggtgcaacattgagttttaatcatgatgcaaactcctcctctttctgctaatatcatgtttaaggctgtcctattttcccaagccctctggctagtagccctaattgttcagctattcctttaacagcatctccagtgtagttaataaatcactgttggttgtagtagatgtggtttattccatctatatttttattaattttcacctaccaaaatattgactcaaatcctgcagctatttgattttgggctttaaattgatatggtattccccgtgggactccaattgcgtctaaatagagatgagagtcgaaagacccataaggggcttctctcactttatgatgtcttatttttccttcctctggttgatgaaatgccagggtgagaggcaagggatagccaattggactaaaacacaagtgccacgccagttatttggcagagtgtccagtaaaggtccaccacaataccaccacacatccactcagggatgaacaagggctgactgattgataagatctagaaaattcttaagctcactgcatcccttcaggtctccaaggaatgctaagtttcctccctgtcatgagagagatacgaagtgaacttagtgtcgggagacagaagctggatggccctcaggggctgacccgcagggtgccggacttcaagatatagcagacagagagtgtggcacgacttgttaccccaggctgtagaatcctggaaaacagttaccatgcaatccacccccaatcgactggaggacaaccctagtggaaaggggactatctgggcctctggcctgccatgcgcacaagcataacaattgcttttgtttaacatgcagatggaatatttgatccattccaaccaggcgcttgcatcttggtgtcctgtcttaattgccaaaggtttgttttaagtctttaacttctaagatatttatcttggtcttgtcgttagatggatgaggagcaattgtttcattgtgagaggttttggaagaaggcatagaggaagttgcagctggtgggggaatcaaagaaatgcatttcaaagcatctaatagggtttgtccctgaaacctcagcccctacaccataaagctggcttaaagaagggaactgccttagaaaaggggaagaacttcgagggtttgagataataacctgtgtagaattacactggtttagctgacagttagtggggatggctgtccctttagtaaaatgaatgaatggttttaggaaattacaaaaactggttggggaagtccattcttgccctttagtggtccacagaacgttggaccaattacagcataaaagctctacttcgggggtgccaagactcctggctgacactggggtctttatcgaaatctccctggttaaatggtcccaattcactaatgcccagtctgaggagagtcaggagggacagaggggcttttctgaagtagagagctgtctttgacttggcaagtccctacagggtgtaacaaggcaaccattaaatgcaatagtttgaggcaaaattgacttggttatgttaataactaggtggtcagcaatagagcaaggaaagaagaaagtaatagaatcggtgaaagagttaaatttttcttagctttagtttggtaggattttcccctgggactatgacccacgactctggagggggtggcactttcttgacttgggtgtgatgagtccctccccttcccctgtataaacagcagtctcagtggttagcagcacaaggtagggtccttctcaggctggctcgagttttccttcttttcaccctttgatgagaacatgatccttaggctggtgctggtttaccagaaaatcaagtggtagtacctgtgctaaaagacttttagttttgagggaaaggaaagtggaggataaaccaagtatatgatttctaagaaattgaccttttgttttaaatgtggggacatcagcagtgaactttatagtccttggtgccttcttactgagaaatttcctttagaacctattattattagtttttagaccaaagaaagccaaacaccattttatatttgacaatgcttcttgtatgatttttatacgaaataagctaaatttcacctttatattagtgggtcattaatgttaaacttaattttaataaaaccttgtagatatatttatccaatttttaatgtctgaccataaggtaagatttttatagactttttttaaccttttataattttcattaaagagaagattagtgctttaagaaaaatctgttgtgcttttaacgttcagttcgcagaaaaactggatgatacccctttaaatgtagccaatatgtttacacacagaatttccttcacaattaacgttttaaaacttgcttaaaactttaaaacaaaatatatattttaaccttttaatgtatgtaaaaatccacatatgcctccttataatccttttaccaaaactatattttactttccttacacatcttgcacataaactgtttcttcaatagttttaccttcaggatgcctaattacttttaaattatacaacatttcttgcataaatttccttttataacttttttttcacgactttcacagacaattcttcgacatgcctcaactttctgacttgttgcaaacgtcccttttttaaaacaacgagttaatttattttaggacaagaatttaccatataacatccctttttatctaaattctgccccccccttttttttccaagataattaccattcttttccaaactgaacttccttcatgtctgtggactagactgtctaaggccacgagattagaagttaggataatacgtgttacactgttaacttttagcaaactttagttttgttgaaaaccttgtaagttttggatttcaatttttctttactactaataagaccttgtttagtccaaattaacttagaattggtatagatggtttcttcctggttctgtaagtactttaaagcttggctgagtgaacatagctcgcacgtttgagcagaccagttatcaggcaattttcctaactctgcttcttcaagagtttccttatcacttactgaatacccattgtgtctttttcccctcaatcacccgggaggaaccatctattgtcctatcctgaagggagttcctcctaggtctggtccaacctttgtatagtaattaagatttagatcccctgttaggaaacctgctgggttaagggaatttttattggttaatgttgaatcatttttttttttaacagaatagcctcatactttcttctgttagcaaagcagttgttgctacagattgaatgtacttgggtcatctgcaggttactgggttaaggatttttgatagtaagggtacaggttgtcagtggcctaagagctttggggctacacccttgtttacactgacaacaaggtggtattggagtgttatagggtcacagacaagaccttcaattatcaattataggtttaaaatttaccctggcttttaaaggaatagggtacacttttttttctttactacttctctctttctctttctttctctgacttcatgtctctctgtcttgttgacttcctcttttctgtctcttcctctctctctttcctttctccctctttaccctctctctttttcctttctctctctctcttctgtctgtctctctctctctctttttcctttctgcttgtctttccctgcctctgtcagtctcattacactgttctcccctctccttccccttttaccctggaaactaaaaattcctctgaggaggagaaacattagatgaggggaaacaaacagagtgagcagcccctgaattgactaaaaaggtgataagctcatgttttctttttttaaggctgactgttggggtgatcagactcaacactaggtcgtgggggcaacgaagtctggtggagtcaaagaattgagaaaagacagagagagagaagtgaggccaggggaccatcatgattgtggaggctgcaaaggccctgagctctaggagcccacgctatttattggtaatccaacaaagaaacaggtggtgagaatgtggaggtcaaaagggtgcattgcattaagcacatgatttacagctgtgatggtttagcatttgctcttctacttgagataatggaaagcaggttctt

SEQ ID NO: 406 - DNA, 20001 bp, Homo sapiens
aactcatctacattggtaacagttgtagttcattcactctcattgttatatactattcatttgtttggctgtaccaacacttacacattcatgctcttttattttttctttttcttttttctttctttctttctttttttttttttgagacaggctcactccgtcacccaggctggagcacagtggcatgaacatggctcactgcagccttgacctcgaaggctcaagtgattctctcacctcagcccctcaagtagctgggaccagaggtgcatgccactatgcctggaaaattttgtattttttggtagagacagcgttacgccatgttggccaggcaggtctcaaacttctgagctcaggcaatctgccagcttcagcctcccaaagtgttgggattacagttattctccttttgataaacatgagttgtatttcatgcggggctattacaaacagtgctgctgtgaacatttctgtacacatcatttggtgaacttacatactcattttctttaggatgtacccagattggggaatgctgggccacagggtattttggtttagcttcagttgaaactatccttggttgattttttaaaaagaaaacattttaaaacttgatttttttaaaaactgaaaataaaatttaaaatgatcaatgttttgtcaaagcggcacttttcctctgtgattgaacaattaggtttttaaaaataattggaggagaacttaaatatgtgtagtctggtatttttcaaccattgggttaaaatccacaattagttggtttaaaaaaaaaaactgttttgggccaggcaaggtggctcatgcctgtaatcccagtactttgggaggccaaagcaggaggatcccttgagctcaggagtttgagaccagcctgggcaacacagtgagaccccatctctacaaataatttaaaaattggctgagtgtggtggtgcatgcctgtagtcctagctactcaggaggctgaggctggaagattgcttgagcctgggagatggaggctgcagtgagccatgactgccactgcactccagcctgggtgacagacagagcaggaccctgtctcaagaaaaaaaaattgttttaattgtgataaaatatacataaaatttactactttaataatttattgtgggtttcgagatcattttagtgggccatgatcagaactttttaaaaatgagatagaagagaaaaggaaacagaacagaaaagaaaatacatcgtaataaggacaaatactgtttcataagacttctgtttccgttgtgtgtgctctgtgttttaaaagtttgtaaaacacgggtctagtccaactcttttaatttacagagagggaaatatactcagagacagaagtgatatcccaaacagagcttgaactagaacatggcatcaggcttccaattcagagtctgatattttccaactcccatctcaccatctttgctgttgatctctccaaactcacgtgctagatcaggctagaccttcatggccccatattttcttggtggaaaagggtctcctgttccctgccccttgagttagtcccagacaggctgcagagaggagccaggactcagccagcaccttctgaacgccactgtgataacccaaggatgccccatttgaccttgtctactctggggtcaaccaggaatagtacaaacctagatcttaacggaagagaggggaaaggacctgtggtttgacatttttcagaatttttctcttctgtgtgtttcaagagcacttttctcgcggagctcaagagaggaagcgctataaatagagggcctggaggaggggcggccgcgggaggaagaagttctcagaacacctgcttgtctcaaaatcaaggcccagtggggtttttcagggggcagttcccaagcaggcccctacccaatcccccggccagaaacttttccaggctcttctccagctcatcgaaaccagggcttagccctctggcctggatccctacaccccaaatgcagccacaaccccaagtccaccccagagccctgggaggggtgaccttgcccctctggatctaaggtccctggtcactcagctcagagtcacgagctgctcccagcccatagttgacctaaatgaggtcagggcagaccccagtccacacctcagcaacgccttcccgtgtctgaggacaagacccaccaacggcagattggtcatctctgacccgcaggcgggatggggaacgggctctcttgaggctgtccctgcagcagctactgtttttacttggagtgtgtttctctgggggctgcctttggtgggagaggaaaaggccatgcagattgcttggggaggggccagactcccccctcattcctccactcccttctcccctgccctctccacacccagccctgcacccctctcctgccactgggtggcctatggcctttctgctgccatgctgcccgctctcctcttctctcctcacctgggggcccctcttgccttgcaagtctccacctcagtatccccttggccaagagcatttcaaggacctcgctgtaaattacaccccgggttacatggcaggctcgtccttcagacaccatatgtgttcaactcaggcttggatgtgtgtcatcatgaggttaatctgtctctccctcagcgagctgcgagctctgaaggcgaggccaagttggttttgctccctgcttctaccaccttccagcacaaggtccagcaggagtcatgcccagcacattcctccagccagcagggaggggaagggaggggaagggaggggaggatgcaggagagatgaggggaaggtgggaggggaagagagaagggaggagagaagagaggatgcaggggagaggggagacggtggaggagaggatggaagagaggagggaggagagggtggaagggacgagggaggggagaatgaaggggaggagggaggagagaggggagggtggaagggaggagaggggagggtggaggggaggagggaggagagggtggaaggggggagtagggtgaagggaggagggtggaagggaggacggagggtagggtgggagggagggcagggtgggagggaggagagagggcaggatggaggagagggtgaaagggaggagggaggggaggatagagaagaggagggagaagagatggaagggaggatggaggggagggtgggggggaggatagagaagaggagggagaagacaatggaagggaggacggaggggagggtgaaggggggaagatagagaagaggagggagaagaggatggaagggaggatggaggggaggatgaaagggaggagcgagggcagggagtcagttttcagcaggaattgaacagctctctcccttctggtcactccatgaaaaatagtttgagagttttcccctgtgctagccaatcatggggctgtttcagcatggagccccacttcctctcagggcacactctttcttcttggaaaccgccaggaagcagccggagccagcaagtggtgtgcctcagcctccctctggagaacaagcgtcacaggttttgcatctgccatccctgggcattgcacagccctggggaggccaggagcccataggactcatccttttcaagtgaaggtgaaaagagtgagtcctatgtaccacaggactcaccttttccagtgtgattcaataatttctagttaattccgagttgtgcagcattaccacaatccagttctagaactttccagtcactgaaaaagagccctgtgtccttttgcagttattctcggttccaccctagccccaatcaacctctgatccactttctctctctatggatttgccttttctggacacctcctattatggactcatacaatacgtggtctctggtgtctggcttctttcgctgagcacgatgttttcacggtttacattggagcatgctcctatgagtagtttgtttctttttattttgctgaatggtattcccaggacttggttttttatcaatggggggaagatatttttagtcatatagaagccatttcttcctacaaggacacaactaaaaggaagattggctcgggtgaggcttccatgtctaggaaacccagagatgcatctccttatggatatagacctcggaaagacgtccctacagaagcatggctgtcctagcccgaatgcactggatggcaaaacggatcagatcagaaagatcccagtgggagagaatgatgagcagaaaccagttgggtcaaatattctttacaattctcctatttggtttcaaatatcaattgcaaaagttgcaatcgacacaccggatagcactctgggggttcaggagagcggtccttagagcatcgcccagagaacttttaagaatcccaatgccagggccactcttggagcaaataaatgagaatctccatgtgcaggccaggcatcagtagtgtttaaccctcccaggtgattccaatgtgcagccaacatcaaagtcaaggacgaccgtgctaaatggttattaggcacctaaagtaactgactggcttgtgccacgaggcagaatcccatgccttcctttccagggagtggaatatctggtcctgccccaagcggtctcaccagacctcctcttctggaagcccacccgggaggtcacagctatggtccctcacatcctccacactaacactgatcccaaggagatgggctggagcaaacaccatggtgcggtgccatctgaaacccttagccaccctgctggagacagagacaaggccagcttgtcacagcactaagaagcctgggtcttactattttatttaaaaagaaaataattgacaagtactacatgaatacattgtcatagaaaatttcttttttttttgagacggagtctggctctgtcgcccaggctggagtgcagtggcgcaatctcagctcactgcaagctccgcctcccaggttcacgccattctcctgcttcagcctcccgagtagctgggaccacaggcgcccgccaccacgcccggctaatttgttgtatttttagtagagatggggtttcaccgtattagccaggatgggctcgatctcctgaccttgtgatccacccgcctcggcctcccaaagtgctaggattacaggcatgagccaccgcacccggccattctcatagaaaatttctaaaggaaatggcccccagaactaaccacaataatggtttgacatgtatctttccaggcatttttctatgcaattacctctatccataaatatatcaacatatagttttttttatgcttgaggaattatattagaacttgcttttcaatataccaccgagatcattccatgtcagaactcacagcaatgcttcctttctaaataaaacactgcaaatgtgatataacattattcatttaaccattctcctgttgataaaaactcgcattggcctcaatgtttttgcccttgcaaatgttatttctgagcctctttgtacgtatacctttgtgcacatgtccactttttaaaaacggcagattcttaggagtggagtggctgagaattctggactctccactcagctttgttcttttatttgcccgttctaatcacaaaaactctatattctggtttcattcttggttatagtacggatcttgttgctgttgtgagtagcttcctttcccgcttcattttctcattaaaaatgagtgattttcagccaggggtggtggcatgtgccagtagtcccagctacttgggaggctgagcggggaggatcgtttgagctcaggagtttgaagctgcagcgaaccgtgatcgtgatcgctccactgcacttcagcctgggcgacggagcaagagcctgtctcaaaacaaaaatggtttttgaaaaatcattgatgtttgtattgtggtaaaatacatataatgtaaaatttaccatttaaacatgattacatagcattaaatacattcacattgttgtgtaaccatcaccaccatccatctccagaactttatcttcctcccaaacagaaactctgtacccacgaaacactgactccccatttcccctcccccagcccctggcaccccccattctactttctaagaatttgatgactctagggacctcatacaagaggattcatatagtgtttatcctttcatgattggcttatttcacttggcataacatcctcaagggtcatcctgttgtagaatatgtcaggatttccctctttttgaaggccgaatcatattctgatgtaagcatatatcacgttttctttatccatccatctgttgatgaacacttgggttgcgtccacctttcagctaaggtgaataatgctgccgtgaacatgattgtgtaaatctctcttcaagtccctgctttcaattcttttagatacatacccagaagtggaattgccaggtcctaaggtgattctagacttaattttctgaggagccaccatagtgttttccatagaggccgcactgttttacattcgcacgaacagcgcacaggggttctgatttctgcccctcctcaccaacacttgtgattttgttttgacaatagccatcctaacggatgtgagagccattgatttttgtatggcaatcttgtatccaaccatgtcaccaagctctcagattaggttttcatttgatgtcttggattttctaggcatattgtcacatcatctggaatggtgacaattttggttttgttcactttagtattcgtgcccgtttttctgactttactacattgacaatgacccacattacaaggttggagagaagcagtgatggcaggcacccctgttctcttagatttcgctgttatatgtcttaatctctgagagtctctgtagccacccttaccaagttaggaatgaggtgttctgagcctggattgctaggagtttcatcaacaatattcacattcgccaaatgctttttggggtgtctattgagatgcctgtacgactcagtgcagtgaattacattatcaattccctaatgattcctcctgcttgcgtttgtcagaaaaacctgtttgtcataaactactcgtgtcccacccagcgtcccgatgagataaggactccacagggactctgggctgccctaggttgccccaaatgaacaggtgtccagtgattgcagaaaaagaggagatggtgatagatatggatcatgtctttgcccccaaagagggcacatccgtgggaaaaaagtcccaaaggagcaagattcttcaaagaaccgttgaccctgttgtaacaagatggagaaaattgtattcatcaaaactaaccttgaggagaggtctggatgcattcaggagaagtccgttgattaatagcttgaaatgattgagctgactacccaaggagaccctcgtgttgggctgagaacctgaaggctgggctgagcgagccaggacaggagcttggacagagcctccttgtctgtggagtgatgggagaggaagcaaagaaggaaggcacaaagccagaaagcacagcagtagttgggaaaaaggagaaaaagaaaagatgcggccgggcgcggtggctcacgcctgtaatcccagcactttgggaggccgaggcgggcggatcacaaggtcaggagatcgagaccatcctggctaacacggtgaaaccctgtctctactaaaaatacaaaaaattagccgggcgtagtggcgggcgcctgtagtcccagctactcaggaggcggaggcaggagaatggtgtgaacctgggaggcggagcttgcagtgagctgagatcgcaccactgcactccagcctgggcgacagagcgagactccgtctcaaaaaaaaaaaaaaaaaaaagaaagaaaagaaaagatgcaaaccctggcattgaggcccccccaaagccaccaaggagggcccctgggagagcgcgaactctgctccggctgcgggtggttgctgtggtctgtgcctgtcactccctgcttgctgaggctttcgtgcctcgggtccactggggagcaggagaaagtgcccagttctgtctgtagagaggacgtcactcagggagaggggcaggagctgagggcacgtgacttacaccaaggctaaggtgcaacgcgaaggccctgacacctgagcccctgggagttgaaaggtgacaggctaacttgggggatgagcggtagagtccggaggttctaaatggagcacaagtggaccctcgagcgacctgagaatacaacccagagggctcatgaactgacatgggaaaacaatgacatctgttttcactcacctctggttgaaactgagcagttccttgtattatgaacataggtggcaaccacttagtgttagccagcagaaataacgggaagtttcattccacactttcgttgttgccagtatctcaaaatgttattcaggctcattgctatttcaaaatcccatggtcagagacccatcctcccgggtatcagaaagcatgggagccctgaccctgacggccaccaggctgcaggcagaggggcatggcccacttggacctgagggtgtgtcattcaatccagcaaacattcattgagcacattctctgtgctggccaccaggtccaaagatgaacaaggccgagaccccgccaggaggaactcagggaatgcgacaggcacagatgagcaagacaatagtgacaacgcagcatgattcatgctgagagtgccggggagggcgggaggccaggcagggtttctcacgggaagtcacatttgaactggctttctcacacttgtgaaagtgcgcccaaggacgcaggactttcctgaaccagaaaaatccctgctcgcgagtgtgcacatctccgcttagagtgcagaggagcaaacagcagaaacttcccccggctgtggagccgaaacaggaaaccacccaggagccctgtgcagaagcggccggggattcccagttccccaggacccagtgggcgttttcacaggaagcctctctgggtgaagcccctgctgtacccgtcccgctagggatggaggctccatgaggtcacaggttgttttctgtttcgttggctaatgaatctcaagcatctatgcctggcacggatttgctttctacaaatatgtgttaaatgaatgaagaaacacaactggatccttccaaaattgacaggggcccagcacagtgtctcatacctgtaatcccaggactttgggaggccgaggcaggaggactgcttgaggccaggagtttgagaccagcctggacattgtattgagaccctgtcttgacaaagaaattgtttttaattagctgggcatggtgatgcacatctgtagtcccagctactctggaggctgaagtaggaggatcacctgagcccagaagcgcaaggctgtagtgagcagtgattgcaccactgcactctagcctgggcaatagagtgagaccctgtctaattttttaaaaaatgctgggggcagctggataaggcaggccgtggctctgtctctgtgtgtggcacttgtatctccaaatcgccatggtgccctgcatgtaggtgacctaggaagacacctcctccaggtccagcagatgtggaactgtttcatgccattgagcaggtggagtgctgttgaggtatggcttactctgccctctcccgggaccacagggtgcgctctcgcgggggtctggagaatcctagcaggtgtctgagctgcctggattagggatctctttcctcagagtgtgatctgagctggaaggatgggttccaggctagtgggggagggctgggactatcttctctgggagcctccatctttggctcacagtgggtgggcacaggcacctcacaaggcctgacagaggccagtccccgatcagtgtagggagagcagagcattggaaaccattgaccaacttcacctccatcacttccagcgaagtcaggggcatactgcacccccacatatttgtaggttgaagtcctaacctccagtacctcagaatgggactgtatttggagacaggatctttaaagaggtgattatgattaaaaaaggtcccatgactcgtgtccctacaagaagaggtgattagaacacagacgcacacagagggaagaccacgtgaagcccctggtggaagacactgtggagaggctcaggggaaagcagccctgcccgcaccttgaaccaggtcctcccagcttccagacggcgaggaaatacatttctgtcgtcagaggccccaagtctgctacggtggcctgagtctgttactgcagccctgagtctgttacagcggccccggagacccggccgagtcttctcactcaatgaacttcttcaatgggctcctcaaggtgacacccacattgtcaccacaaagaagaaataaacagagctgccctccagagtcataggtcagaaaggcctcgtgactcaggagtgggttatctgggtgaccttactgctcactcagtaagaaaaacagcctttcaggcctgcacttcccagcagcatagcctgctccttcctggctgatgtcagagggcccgagttccgataagccgctgtttgctaacgtaggtctacacaggtataaccgcgggccctgagtcaggtgaaaggcctgatgtctgcgggaagcttagtgggtttttatgtgaaaaaagaaaagtcttacgccattggctgtctttcagcagggctgttagaaacgcacctggctcaacagcaccaagaggatgatgaaagtaagtccagtctgggagttccgtgagggattggcagccagtcttcacattttaaatacattttacttattaactggaaatgccttggggaactctggcaagcatgcagggaccccattctctccacccctctcagctcactgtttcttcattgctgggcctgtctctgcctccagctgggctccactttttttatttttatttttatttttattttgagacagggtctcaatctgttgcccaggctggagtgcagtggcaggaccatggttcactgcagcctcaacctcctgggctcaagcccagctcagtcactgggacaacaggtgcgcgccaccatgtgggctccagtttaacacgtccaaacctccctgtacctttgggaaagtccaggcaatttcttggtttcccaaataagagtcactgacggccaaaactcctttatccttcccattggggcatttcccctaccatggtccacactgcctgcctgacattgttaatgaatccttcgtgggcctaagcctggcagagcagggcaggtagggattccggaggtgcaggttttgctcttacctggcagagtagcttcccattctgggcttcagtttgctcctctgcaggatgaggatcataataacagctcctcagaggtcctttgtgaatattaagggagtcacatgtgtataaactgtgtctggggtacaataaatgctaaaggtcccttcccttccatccctttcctcccccttgatggcaggactgtggctccgcctcctgtctcccctcctcaccaagcgcagtgctatgcacacactgagatctgaatacaaacgtgctgatgaatggattccctgacctcagcatgcaccccatcgtgtatcactcacctgtatctgcctcagctgggactggctttgatgaatgtgaatctttaaactataataattcatgctcttgtagaaagcatggcacatgtttgcaaacacaaagaagaaaataaatatagtcaagaccacagagtctgtgttcctcaactgccttgagctctccatgataattgtcccagagcattttagagtaaccgcttggcttctcaaggctccaagaaaaagaatttctttatagcagagctacatttaatagctttttatcttacaacagatgaagtacctgtatataccaggtcctgtctcacacttctgccctgtgaacaataaaaatctcctcctgcaccagaaacactattgtgaaagctgcctggatacttcggcctctcagctgacaatgagtaccttttaacccaggttgataattcagagaaaagaatttctcaaggctgggtgcggtgactcacacctgtaatcccacactttgggaggctgaggcaggaggatcactggagcccaggaattcaagaccagtctgggctacaaaactagaccttgtctctactaaataaataaattagccaggcttagtggcatgtgactgtagtccctgctactcaggaggctgcggtggaaagattgcttgggcccaggaggttgaggctgcagtgagctgtgatcacgccactgcactccagcctgggcgacagaatgagactgtctcaataaataaataagtaaataaagtattttggtcctgagaatatctgcttctctgtgcaatttttcttcatcgtgtttatgctgtgcactccactctgaaatatactaaatacctagaatatattatatgggcatatgtacatatgatgtgtgtctgtatatatgcatgtatgtacccacaggtgcttgcatgcacacatgtgtgcacacacacacagacacacacaaacatgcacactcacacacagacacacacaaacacacacagagccacgcacagacacacaaacacacagacacacagtcacacgcacacacatagatacacacatagacacacacacacacacacacagacccacagacacacgcacacacacacagagcttcactcagagcccagcagatatgcaataaattacagctatttttattattgatgcttccgatgacagtctggactttagaaccctgttcctggggctccaggaaggcggaccccaagacgcctaggagcgccgcctgctgcggacgcaaaacctgcgccccccagcggacgctctgggttcttgctcataaaataaatcaaactcgtgcctgcgcctccttgtggtgggaagggagcatgacgcggtgactggcccgggcgctgacagtttccttgctgtgatgtcagcccccgccgcagatgtggttacccccacgctttctgctggctgactggtattcatgagcataatataacattagctatatagcgggcgctgtgctaaggaagccctttccaaaccccatctcatgaaatatttatgacaacgctattgtgtaactattgttagcattgccatgtaaagagcagagagccacagctcagagaggttgagttgccggtccagagtcacgcagcacagaggaaatgggtataggacttaaccccaggccaggcccactctctgagccacttaccctctgcacgagtaccaccaggtatggttagagtggcctgtcttaaacgcaagatccatgcaggcccctttgaaagaaaatactttcttgtgaattaaaaaaaataaaaataaaaaaataaaaggagacttcagtttgagaaactgcattaaaaataaaaccctgcaagggcaggagatcggcaggcacatcccaccatcaacacaacacgggcctgaccctgcaagcatcgtgcttccctagaacgcaccatccagttggtccaaaaaaagacctactcattttttaagattatcatggacttgaaaacatcaccaaatttaattcccgaaggacatgtgacaaggcaccaccttcctccctccactctgccaagcatttttaatgggccttggtgtaataaaccctagtctagaatatgggaaaagaataaagtcataggtgtcactttgtccagttaatagtgatcataatcacacttctggttggctagtcctttaatcttccatttataaaaattcccttaatatccacatgcagaagaatgaaatgcctcttatctcacaccatatacaaaaatcaactcaaaatggattaaagactgaaacataagacctggaagctgtaaaagtactagaagaaaatatagggggaaatctttatgatgttagtctgggcaatgatttcttggatataaccccaaaagcacaggaaacaacagtggaaatagataaacaaaactgcatccaattaaaaggcttctgtggaggaaaggaaacaacagagagaagagatagcctacagaataggaaaaaatattgtaaacccatgcatctgataaggggttaacatccaaaatatattcggaacccaaacaactcaatagtaagaaaagaaataatatgatttgaaaaatgggccaaggacctgaataaacatttatcaaaagaaagcatacaaatggccaacaggtctatgaaaaattgttcaacatcactaatcattagagcaatgcaaattaaagccacagggagcaccacctcacacctgttagaaaggctattaccaaagagatgaaagatgtgttggtgaggatgtggacaaaaagggaacccttgcacactcttggtggaaacgtaaatttgtacagccataatggaaagcagtatggaggttcccaaaaaatgaaaaatagaatggatatgatctggcaatctcactactaggtatatatccaaggacaacaaaatcagtatcttgaaaagatacctgcattcccatatttattgcagatacttgttgccctcttccaagggctctaggggaggatccttcctgacctcctccagctaagcttgtggccacgtgggcttgtcactctgacctctacctcatcttcacatcaccttctcctctgtgtgtcctcacatcttcctctgcctctctcttaaaacaactcttgtgatgacatccagggcttatctggcaataagacgggacgctctcctcatccaaaggtccttagtcacatctgcaaagaccttttcccgaaataaggccacatttacaggatccatggactatgatgtggacttacctttggggagccatttttcagcctaccacgtgtgggacgcaacagacaagctgcgctcgcttgagctgagacttgttggagctgttcaccctccccagggctggaatcagaggtgaggctgacagcacgaggacaagaggcttttgacaggacaaagtgggacagaactgtgcacctttggccaaaacagcagaactggcatgataaccatgcaagcaagtctctgcaatgtgaaggactgcgcaaatgttcctactcaagtgcacctactcaagtgtggcactggcttgattcatttctgcaggagagagccagttaccacttaccagttctgtccagggaggcataattaagataacctgggattgacagctgctacagcttcttctacacgggtttgcttttcactcacctttgacgttactggaataattgcagcaggtgcctgcctggtcgtcaaatcttgtccccaaagggcaaatctgcccgtgctccatcgtatcggggacatcagtggctcccagtgcccaccgtccttctacagtgctacagggtagcgcttctttacactggcaaccccttagtttcttagtcccctgcttatgggaagtggggatttgaagacacgaggggcagaaagacagactttcatagcatcgtaacacactgctgttgaaagtcagtgaatattagacagaggagggtttatggtgcgagattctccactctgggacaccggaagctctgaagacttcggaccagagcagcccttccgtgatggtgctggatcgacccctgttctgtgctggctacgtaaccactggctgaatggataaatgtatcaaagacaagctagtaacagcattcgtaattcaaaagtactaccaaattgtgatcagcttactgcatatggttatgcattgatgtcgtccaaaattcggaaggtgcagaaggatgcacgcccctcccccaggtcttggtagtggcaaccagtgtcaccagcatcacgtgtatcctcgcaggatatcttctgcatctatgagcaaaaacgtgcacgcaccgctgcttttttcattcttgatagcttagaaatcattccgtaggagggaggggcattcaggatgctaccccaaaacatgtaccttggcatagtgaatattttaagctgaaggaatttgagaactggtaagtagagaaagggttccctgactttcccctgaagcaggtcaggagaccctcatgtgagagggagacagggggaccccaggaacaatctgaatgcacagaccttgctaactttcccccagtttactactcttagctcataccttttctgtcctaccacatttttctatgactcagcattctatcaaatcaaggctagaaacactcaggtttaagcatttcttcaggtccctatttccttatgaaggctcccatgtcaggtaacatttaaataaatttgtattcttttctcttgttcatctgtcttttgttacaagggccccagctgagaacctagaagggtagaaggaacatatttttcccccacctacagtagtgttttaaaggaattcctttattctttttttcttttacagttgcctattgtttcactgtatagctgtgctatgtggacattttgtttccagccttttgcaagccaaagagcaattaattaccttttcaaaataatattcattcatgcaagggtatctgcaacaaaaagaagtggattttcaaaaggtttcaaaaggtatgtgtatttgcaattttgataaatattgccagaatgactgccaaagaggttataccaatttacaccctccccctgcaagaaataagagttgccaacagagtatattatcaaatgttttaatctttgccaatctaatagataaaaatgacatgagtataattttaatttgtacttttcttatgagtaagattgcacatctctttatatgtttaagacccttttgtaccttgtatctgtgagtaggtaggtcatttcctttgaccattttgttgttgttctttttttcttattggtttgtatctagagctccttatctactagggaaattaagcctttgctggaatatttgtagaatgaagtagaaattacacaatgtttaagcatttaaaatgtttcttctctcattttgtgtatagttaattgtaatagcataattgattatgcaaggtcgttttcttatttatttctggagattagatcaatccattgattttaaatgtggtacactttcccaagtttcatttttgcatgagttaaatctttttgtggtgcttaacttgcgttctctgagattttattaatattttggctcatgctgtttccaccacctgacatatgtcctgatgggacccatcctcccagcatcctaaacccaaaccaagccccccggccttcctaaaacgtgccccactgctcccatccacacagtctctcccttctctgggcctctggagggatgaaacactgaaattcatgccacaaagtctcacactgctgggtagtgttcttggttgttttgcatgtataaatctcatcctactttgacagaaaacttctaccaagaaaggaagcgcatctttcatgtcttcacattccttgagattctcctggggacagagtatgaacatgagaaatacttattaacttaaaataacttctagaggatcttaatctatgctccagggatacaattcagggtgtcctgaattatattattatattacatttttgtgatattaatttatatgctattactgctggtgtcctcataagaagagagagacacagagtgaagacggccatagaaagacggaggcagagattggagggttgccgccacaagccaaggaatgcctggggccgccgcaagctggaagaggcaagaaagcctcctcttctgcaggctgcagaggaagcatggtcctgctgacatgttgtacttagacttccagcctccagaacggtcagaccatacacttctattatgttaagccacctagtttgtggaactttttaggcaaccctagggaacccacagacacactgagtataagtttatcaccaatagaaatcacggatgttttcatgcaagattatggttgctgcagatatctgcaaatgttgtttaagctcatcactactttgaaattatagtggttattagacccaaagcgaaatattttaacttaattgggtaataaataacttataaatttgtttttaaatattttgatattttcataactttattcaatataatgattttccttatgattctctttatcttatgcattttaaagcataattccgggaggaggtctgcaggcttcaccagaatgccaaaggggttccattaagttcggcctgagatgcagtactccaacatatccagaagagggcactagagcacctaggcaaagtttcccagaaattaacactgatcattttactgtatttccctatattgcagatacagaaatgtgctttaaattcatattgtctttagaatattatgtgatcagaatatggaaatactttcaggcctgccttcctatttgtttgttaacttaaattttccataccattttttccttattttttttttatcgaggtaaaatatacatacataatttaccgtctttaccacttttaagtgtgcaattcagtggtaataaatacatttatatcttttttcataccattaaaaaatgctgacatgaacagttggtgttgaagttatttttaaactgtagcccatagctggaactactttgtaattcccacgtcttaatgaaaatacgaaacgagcataaaatggaaattaaaataaagaatagaccggtcgcggtggctcacgcttgtaatcccagcactttgggaggccaaggcggatggatcatttgaggtcaggagtcggagaccagcctggccaatatggtgaaaccccgtctctactaaaaatacaaaaattagtcggtcatgctggcgggcgcctgtaatcccagctacttgggaggctgagacgggagaatcgcttgaacctgggaggcagaggttgcagtgagccaagatggcgccattgcactccagtctgggcgacaagagtgaaactctgtctcaaaaaataaataaataaataaaataataataataataaaagaatagcctgagcatgttacagatgtacacaaaatacgcactagtgtgcatccatagtgatgatggcagtgtgggtgccctgcaggagagaaggaccttctaggttcctgtcgagcccaaatagaacattctccagagacgcccttagtgtatgcaatgtactgcagccctttttttcttttaaaacaaaaaaaaacaaaacaaaacctttcaaatagcgttttctgagagtctgatggctttgatatttgctcagttatcccaaagaactgacttgctgagctattcacctgcttatggtatgcagcgattttgacctggaggccagttcgaaggcaggacatttttttccccttctctttctcccatcatctatcccagaacccacggccctccagagacagcaaattcgcagctttctgtctggaagaacaagattggagaaggaggaccaggcactcctagggggagccccacctaattctggcattcagcatgctgggcgaggcctctgaattaacagcaaagtttcctaagcatcgcagaagtgcgtcccagcccccggctatccctgcggtcaggatataggggagaaatcgtccccaaaccccgaaactctacatagagcagggctccctcctcaccgaactggatggcataattttggttttaatggatacgacttcaaatcctaatgtaaatcctaaatgatattggtgttggggctcagaaaacgatgcgccaaagtatggcgctttggcaggccgaga

SEQ ID NO: 407 - DNA, 40001 bp, Homo sapiens
agagatttatccatgcatgtatccccactacctgccacattgtaggtgctcataaacctgtggttagaatcagcatttcaaggaaggaagaggcccaatagattgtcaaggctctctgtgcacctaatttttgaatctcttctgtaagagttgattcagacttggcttggaccctttcagagatgagcaactcattgctcctttagcttttccattccattccaacagcactgaacatttgaaagctctttcttatctctagttgctatagcctccaccacctgtatggcttccagcccttggagacacacagaatagctctaattacactcctagtgtttgaagacagggcttttgcctttaaggatcttcttttctaaaggctaaaacatctccagttttttttttaagcattctcctacaaggggttttaattctttcttccaggtcattgttctctgaaaaatgacacattttattttttgcatcctttccaaagaaggatgcccacaccacatacagtattatgagtatgattgggatcagttcagttcattatagagtggtctcaggactccccctttttttttttgagatggagtcttgctctgttgcccaggctggagtgcagtggcgcaatctcagctcactgcaacctctgcctcccaagttcaagcgattctcctgcctcagcctcctgagtagctgggattacaggcacccactaccacacctggctaactttcgtatttttagtagagacagtgttttgccatgttggccaagctggtcttaaactcctgccctcaggtgatccacccgcctcggcttccaaaagtgctgggattacaggtgtgagccactgcacctggcctggactccctttttctagattagatatctattaatgacagcaccaaacaccttagccttaataaaaaaagattatagtattaattgaacttaatgtcagtgaaagtctttactattgtaatgtcagtggaagtctttactatttttgtgcccatttctctccctttcctggacttgtgcagttggtttatttaactaaagcttgggatcattctttgactttgttaaatccagctttggattttaaaaatccatcacaccatgatctatgtgggtgcagtgcttttatctagcacatcagctgtcccttctagcttcatgtcattcatcaatgaagaactattttagggaagttcatgacagctggagagcaaagactttctttcctttggaatgattcttttctaaaagtcattactgctgctcctttggcccctagagtgatggcataactacctttgtctctctgtcttccacagcattaatgcatgaggaagcctcaccactccttccccactaagagatggaatagcttgggaatatgctggagacattctttcccctacactgtagttaggccatacagaagctgttggttactcatgggcatgataggaagaaaccctttctgttcagtccagccaccttgccataagaacaatattggtctagtggcaaacagtgagtgggctggtatgattacatggtacaaaaggctaggtggtgaggactgaacatggtagtatcatggaagggcaaaacccagaggctggaatctgggcaacccctatcttggagaattagcagcaggatctctctcttctgagtctctggaaatcatcatcatcatcagtccagcaattcgatccattctcagtgctgtgtaaagcttgcataaaagccaaaatcctgtatgtaaatcctatatgattatcctgagtgttagctcataattgctgttaggtgattatttgaagctttgtatagcttggctgtagtggtgacaggctattgttgaagtctgccattctgattatgggtagcattctcaggggatttcagccatttaaaccaccatttttataggtcaaaacaagtcacctatcagcagtttaatacagtcctgcccaatatgttgcttggtgtctttggagatcatcagaattcatagaggcaaagaatcttagagttgggaggactttctggtaattatctcctacaacctcattctgactcttttttatggcatttctggcaaataaaatttcccttattattttactctctgttcatgccaaatgtgcttgtttttttttttccatcatgcatgtacaactttaaaaacgctcgatgggggccaggcgtggtggctcacacctgtaatcccagcactttgggaggccgaggtgggcagatcacgaggtcaagagatcaagaccgtcctggccaacatggttaaaccccgtctctactaaaaatacagaaattagctgggcgtggtggcagacacctataatcccagccactgggaaggctggggcaggagaatcgcttgaacctgggaggcagaggttgcagtgagctgagattgtgccactgcactccagcctggcaacagagtgagactccatctcaaaaagaaacaaaacaaaacaaaactgctcaatggtagctctcatgttcttacatgagttttttacaaagttagctgcacatagtagttccttgagctgttctgcatgttgacatgttttgggtccctcatggtcctaggtattctcctttggaattaatactccacttgactaatgcctcccctaatgtatggcaacatacactgaaccaaaaccctatatctggtatagacaatgctgagaaaaggtgagacttttgaacatttttattctggtaggtagaggattgcacttaagtgccaaaatttacatttagcccttaaaattaaatttcacttttgcctgttctcatccttttggaccctaattcttatatctaacaaattagttattttcaggttgaggtcatcacaacatcaagacagcatgccatgaatgtcttcagacacatcattgatccaaatgtggagcaggcctaggctctgctgtaaggaactagtgaaccctgggcagaaaaagtagattcaggttcacagtgaaggtcagggaattactcagggaagggctggtctgagacaaaattatggatttcacctgtaatcgcaactactcaggaggctgaggtgggaggttcacttgagcccaggagtttagggctgcagtgagccacgatccacgattgtgccactgcactctagcctgggcaacagagtgagaccttgtctcaaaaaaaaagggggacttaggtagaaggttttttctaacccttcccctttcctgtaaacattcttctcaatcccacgctgtctcctgtgccctgcctcctgcccatggtggcagacttcttcagtctgcatgtctcttgagtttctccattcaaaagctcctgtgcatgcccctgtcttggatgagagacctttaacctggctggcctgatgatctcatacatgacagtatccgtgactgaggagtctgagtgggtctcatgtttaaatttgcgttttaaagagagaagtggctttatgccactagataacttgggaaaggaagaatttcatgttttagtagattctgtggatgaggattgaggaaagggagaagacagccatttaaaagggcttcccagggccctttaaaccatgctgagccagggtcataaatgaagctgatgtctaggcatgattttctgcttctggattctctgagatatgtctcctttcttctccattagcactgaactagagggggtaactggtgtcatggttaccatcacaggctggaaagtccatctgctggtgcagagtcctcacttcacccctcactaaggtagtgtgactttagctctcagcttcggttttctcacgtgtaaaattaatggtatagcaatgtctttcccatagagctgtatttaatgagataacacatagccatgtctcgtctgtgataaacaaccagcagatattagctgttattgtaattctctttaccaagttaactgaattccgtctctttagtgcttaaaatgctaagatgtgtatttcaactggaagatgaaattcttcctttcccaggtcatttttgggagggttatcaagccactttcctctttaaaatgcaaattgaacaacatgactttttttcccttttctctcttttccaaattcctggtcaccctacagacacttttggcttctgcaaatttgggggcccaccctcttcccccttcagtatctactgagttcttccagaaacatcaggtgaatgtttctatgaccttctgattttgcgtaattactcttttaaaaagtccttgtggcttcataagaattcatcgttggcacttggcacttgcagcaattagtgacatttaatttctctacttcgctatgaaaaaaagagatgatatatgtggatttttcactgagataaaagttactctgaaagcgagtgaaataaaagtcttggcagagataacttttttttcgtcttttctgaatctttttctttttttctccccttgtgagtgacttccttccttccccgaaatgcttttgccaattacccagccagggtgaaggaaagaagaatggatttgaaaaccatctgaggtgggtgggatattatagatttaagggggagacaatattagcttaaatgatggaggccttcaacttctggcctggttcctgaacattacatcttcctcttgcctgtttcagtaaatggtttctattctctgtattagtcattctcatgacaggcttcatgatggccacagccgcttacaaatgactttgctttcatagccatttccattttcccgagctgcaaaagcagctatagctatctccatggggattttcccaaagggtgtaacatagtttagagggccttacgtgtactttgcatataatttacatatgatttgcagtctattctaaggcaatttcaactttgtatgccttatctcctggtgatctttttctcctcttattcctctatgtaccctgagaacctgtgcgccacagataggcaggtacaagaagggtggaatatattaacaggactagaaagagggaggtggaagggtcaaaagtatcagacatcctgttgggatccagctggagtagcactttttcagggtgtgacatcaaacgggagacacttccgttgctttcttatatttttgtaattattttttaaaaaaggaattgtagttccataagaatttgacattggcaattcttaatttccttagctgaactttaatggtgctgcattttgagtcatagctgaagatctgttcaaagccagagccgatggtgagactgttttggaaaggtgtggtcccctctgcttccatgagcccccgttttagcctgtgccttttcttttggcagccctggaatatcaaacccagaataaatgccaaactccaaaaccagccagggtgcttgtcctagggctggcagtgtgacctgggagattgctgctgatgggcatgcattttgaccccgtttctgaggtcgactagaaggtccatcttcatttttaccccttcctcatctacaacatacagaatgcatgcctagcatagactctgtttcctttgttgctaattatatcctactcagttaagattttttgagcattattttctataatttatgttggaaagccatatagttccttttcctttttttttgaatgtaaaattatttcaacatttatatcttaatgttgaatatgcttggaaaaaagaacctccaggatatcttaatatttccccactcctcccaggttaagactcagggctccaaccccttttcctttgaggtgtcattcactgacacaggtgctgaccctctcatctatgaatggggttgtgagaagcccttatattaatatttgtcctgactctctctcagactgtagtcttacattgttaagggcacactggatcttttgcttgactgattcctcctttcagctctttatgtgtcatacagaacttattatccccaccaccttgaatccatccccctactccatcccaccttcctatttctgttactgtttcccccagtctcccatccaccactctcctaaaggatctcatccatcactgaagcctgttcaatcctcttttttcttttctttcccactgccatgatactaatgtaggtccttcccctgtaactgaactctgtgcctccgtctctttccccctgatccatctcgttcacagtattgcaaaaataatcttcttcaataacatcttccttgggtttttcttttgcccatgaaccctcaatgtctcccatcaatgacaagatcaagtccactttgcttagccttgaaactccagacctccatactctgattcttaggatcatctttccctttttccttatatgaactatgcatatgtattcattcctttatttgtatagcatgctgttacgtctcaaccatgtacctggcagtgtcctggttgcttctgaaaagctaaacagaaaagtccttaccaatgcactttatgatcctggtagcccatgctgctacctggaatgtcctccatctaaaccctaaaccattttccaagacctgttaaaaattcctctgtcctccagaaaccttttctgagcacctggaaccctctttatagtccctactggtcttattgtctgaattaatcatttgacacttaggaattatccattcactcattcaatcatcaaacacacactgaacacttattgtctgtcaggtactataataggtgttgccttacatgtcagtacatttccatagcataataaaaataacatcaacaacaactgttataaagctcgtgtcaggctgggcgtggtggcttatgcctgtaatcccagcactttggaaggctgcagcgggcagatcacctgaggtcaggagttcgagaccagcctggctaacatggcaaaaccccgtctctgctgaaaaatacaaaatttagccaggcatggtggcacacacctgtaatcctagctactcagaaggttgaggcaggagaatcacttgaatctgggaggcagaggtggcagtaagccaagattgcaccattgcactttagcctgggcaacagagtgagattccgtctcaaaaaaaaaaaaaaaaaaaaaaaagaaaaagctcctatgtgtaggcacaaatttgtatatgttaatcctcaaagtaacttttgaggtaggcattattattagtcaaattttatgataggaaaatcaaggcaaagaaatgtttaacaactttcctagcgtcacaagttagaaagtagcacagatggaaatcaaacctggctctgaagtccttgatcttaacccccatgcatcactgtcaggtatgagtatatatggcaaatgtgtgtgtgtgtaaatataagcacatgcataccttcgcagctagactgaactctagaggtcagggatgatgtcccacacttacttgtatccccactaccttattcagtctatgcatgtggtagatacatgaattgtttggatgattggttgttggtacttccattcactgttgaggggcttgagatttttagcaacaagtaggagtgttttgaggtagaaggcggagaagcagaatttcaaaatagacctgggcatgatggaattcttggtttccagtttttaactctgcaagctctgaggacaggtttgtgcaagaaaatgtactgatgtaaaagcccttgaaagtggaagataattcttttctcaaaaagcaaaataaaacaaaccgtattatggttacatggtttctccccccagtcctgtttcctgtcacactgattcatatccattttgctttattggctataaaaccaaagttttggcatcaggatcgtgtatctcgttttctggcctagtatttctatttaagggttttataagttgaatatgaacattttatttgagtggcaatactgcaactacatatgtagtttaataaaacctgataagtacatatttgaattttaaaaacacaggtggtgagttatttgcattttaaaaggattcttccctttacaaaagggtccactgcagggttctattaaatatccaattccccttagtgcatttattatatgatttaatttaccaaaatttgatttatatgccactctaaaggggtagctctcaagttccagtaagcatgggaatcacttgggcaacttgtttaaaattcagatctggcccccactccttcccaaaattctgattcattaggtcttggttcgtgaagcccaggatcttcgttttttaataaccatctccaggtggccgatgtagattgtcagtgaaatacactttgggaagcatataagataaagcgcaatgatagaggtttttacgaggcttgaatcccctcttactaccaaatgtcctgttcactatttagtaaatttaaaaaatattcacgtgggtcaaataaagactcttccatcgctttcctactcacttcttcctgcagctgccaaacatctttaatctcaggggtaaaatgtttgccctttttaaccctctatttgactcttaggtagctcttcagatcttccttattcttttcttttcttttttttttctctctctctgtcttttttttttttttttgagacaaggtcttgctctgtcacccaggctggagtgcagtggtgcgatcatagctcattgtagcctcaaacttcttggctcaagcaatcctcccacctcagtgcccacccgagtagctgggactacaggcatgcaccaccacccacagttaattctttaatttttattttgtagagacagggtttcactatgttgcccaggctggtttcgaactcctggactcaagctattctcctgctttggtctcccaaagtgctaggattacaggtgtgagccactcttgtgagcgtcacctactgaattcatacacctgttctgttcctgttccccttgccacatactccaacagacattttaagaacctttatttctatggaagtttcttttaaccaagtctagggccttttctcctctcttcttactatacccttcccccacaaaagacccaaaatgaattttttgaacaaaacaaatcatgaaaatgacttgttttatcttgatttcattcttccgtgagtatttatcctggtcctagagcaacaaatactaaaactatctatttaaaatattatagtttaatgaaacttgtttgacaaatagaccccctgacatttatggcacatgtatctgtgtatttaatatatcattgatcttttaaaagtcagttgcttgacctatattttgtctctgattacttttctaaatctctagtaatctctaaaaacatttagagatttccatactttttttttcctttattaatcccctatatccctgaattttgctcagagtaaggttctctggagtgatttggatatgtcaaatatctccagtaacaacagaaccaatacaagagcagataactggtacaattggttcctggttaaaaattttttcttcttaatagatttatcaaggcttgtgctttcctgaaccaaggagctcttaatatccctgtttgccttccataataatatagccagaggttctgttatctatttattgggactttacataccttttataaccattcagtgcttggctagtcctccctgatcaagtgtggaggcctttctaggaaagatggtgggggagaagtggaagaagtggtattgttgtccctgggctaagatgacagtgatagaaacagttccaggttgtctgagcaactcttgtaaacaggaacttatttgatacattccatatgattcaatttttgtagaaaagactatctagagaaaaaaaagttggatggtagtctctggaaggtgggattgccattgatatttttatttttgttctgatgatttttcccaagtttctacagtgaccatgtattgctattacaagtaatttaaaagaaagaaacctactttacctggcgtcttaagtctgcttcccaagggacttaatctttaacagatttatcacaaatcctacctattgcacagaacaacggtaaaaggaaagttctcgtgattaggcccagagcagttctgcaaacacaagactgtaagctagaaagccaggctttctgcccagcagcaggaaggctggggtgtccatgtttgttgcatgtcccagggtatgtgcatgtggagtctgacatgtgagcaagcgtgcggcccctgtcactcctttttccactcaaggattaagattgtattgcatttgggattttaactttgtcttctttctttttttccttacccttccccactcctcttccctttctccctgtttctcttcctcaggcctctcccacctcatgatgagtgaacaaggtaggtgctttgtgcttgtggtcctgcagctgcctgaactgcttgcctccgtgcctctggctggtcacagagcctcatcgtcactggcaggccattcgctgcctgtccttcctgcgctgggccaggctggctgcaggaccaccctgcagtgggggtgggggcaccttccttgatgcatcgtggtttcccacccctattgtccccttggcttctccattctccaccaccatttgtcattttgggcgctggccctgctgggctgcatccgagagggaagcatgaaaccaggcatgacggtgtcgataatgggggtgaatgaagctaatttcagagcaaccaagcggttaacttcctcctgctcctccccaggccccatgccggggctccaggctgggggagaggagctgggctcctccctgaatttccctctgctttttgtcttcccctccattacactgcccgtaatgatctgccttccatggtcaaaggaagcccttgtgggtttgactgttttcagttttatataaaagcaaaaaccacctaaagaacatgctaatgtcctcatggcagaatactaactcattatacaccctgaagaaaactgcatataaagatctgtaaattcagcatctgcaacctaaaatattcaaatatgcaaggaatgaactgtgcaggaaattcagctcagctaagcacagggtgggatgtgaatgaagcctttttctcctaaataaaaattttccacattatcagcctaaatcaggagttgagagctgagcctagttaaaattgtcttttccttcacagttcaattgctgctattgtgtttcttctgagccttgggatgattgcaagattggtctacctgccttgccctgtaaccaaaagtctaatttttcttgactatgtcgtgttgaaatatacatgggactcagcacctcttctggaggaccaaagaaaaagggaaagaaggataattccatatattcctgtttttcttgagcttttgaggagggtgggacttcccctcccctgctccctgacattgagtccatcagacatttttgacataaacggcagtatcatcaaatcaaggaactgcccgaggctggaagaagttcgtttatggcatccagttagctgtggaagtgggcagtcgagggcatcctgaactgacaaagcagggtaaggaggaagcctacttttccaatgtaaatgtatcctccagacctaagccaagatcagtggtgtggacttcagaaatttcaataaggagatggtttggtagagaccatatgtcaaaaaatagaactgggagaggagatcaggtgacttctctagtattagaaggggctccagaagaggctgagatgaagtctctgttcttgcagtttagtgagggagggaagggccaacagcaagtgactatgaggtggacatgagtaggggatgtacctgatgttgaccagtgtgcaggcagcttgagagagttaagcacatctctttgaggaaccgagctctatgaattgctggaatttgatggctcacctttggtgacaagttacaccagcaaaagcagactcttagagtcccaataagcccctcctacattcttttttcccctcctacattcttttttcccctcctacattctttagccttatgatcccacgtgccccttgggagttctccaagcttttatagtggcttggagaactgagtgcatcacatcatagggcagagtgtggcaaatgggataggctgatggggacttccttgatcttgatttaacttattgcagacacactgatgcagcatggatatcttggaaggctaaatcccaacactggtatgaaaaacatttggagagcctatattatattccttatgcacacacacagagcttcagatacaaccatgctccgggggaataagtctggtaccttctagaaagagagaaagacataatgacagacatggatgttgtgaattcctcttttgagaggttttcaagaaaggatgcagaattcttctgggtaactggtgctactaatattttaagttgcaacttgaagtttaatctgtttttaagacagtcctttgactgcattcctcttcctttcattctttccatttcctatccccttatctgttctcacccatttgatgattacctaaaaaaccgatactcttcttctcaccagtactcctttccttttccttattccttcaacatgaaaaaaggaggcttctgtctggtttctgctgaatcttaacaatttatttttgtgcccataaatatgtgtggaaatatgtatgtatgttgtgtgtacaacacctatacatgtgtgttatactcttggtcctcataactcatattaatgttaggaaaatacaggagaacctagcttctccgagatgtcccctaatcatttttagattaagtgcatgcaatttcacatacatgtggctgtgcagtacttttgcatgcagactttgtcatgtttctgaggatgggactgagaagaaatgaatgggatggagcttgaacatgaagctgagggagcagccttgctggtcacagcgtttactgcttgtttaagcttccacattgtatgtttgttttgcgctgcctccttaggatgttgcaatgctactgcctttactgttgtgagtttttgttttgtgtgttttatgtctctttgtgtgtttgcagtgtgctgatgtttgactctccttgctctctctctgtctctctctggccgcctccatggtgaacaccatgcttcctctacttaattggaccttcatttctgtaggtagaagtaaaggtagagctcactttatttttatcattataactatcaatctgccttttgaaatattcatgcatccaagaggattgtcgattctgaatacagtccagattataaattaatgcttttaacaacaactgaaaaataagaataaaaataaaaagccaatgctatcatttcccttcagtgcatttcatgttcagtgtttggggatgattctgtgttggcctgcctccctctaaactgagggcgggccttctgcatgatcttgtactctttctatcaggaacgggggagggtgttctaagatcccctcccagtaaatatattgagggaacaggggaagtatgaaattatgtatcattgttgctattatttggaataactgaatttggggataacattggtgggggaaggatgatagatgagaaagggagagaattggtgaattgcctgaaattttatttaatgtggaattgggggggatatttatttatttctctttttttcctgtgttgtttttcctgtatatgtgggattcggaattttctgatggggtgatgggttcagaagggtggaactgggagggtgtgaaagaacacaggaatgaaaatgtgttacacagtcaggaggaagaggagaaagagataacgtaggattttaacttacaaagccagccttttgccaggtaggcagagaaaaggagaggggctgagtgtgcaaacttgcgccaacactctgacatgcctttcatcgcaccacacctttgggtaacgcatccatttctaatcaaagctgtcagagacccgagcctagagaacctggctcaccagctcaaattggattagttgttcaggagtgaagggagaggttaattgataaattataaatatgtatctacatctagtcttccctgtttcctccctaattctccagcccctatctcaatgagtctgtgtgctgtctcttccttcaaagactggcaagtaacagaagtaggaaatgtgttttatgccatgaggatgttgaagaaagaaggggctgacaagttgttgaaaacatggattcagtgacacgtctgtgagatggctatcgcttatttgagttttatgcttttctgggtctttgaaaagttatgtatggttgccttggaagcagttcagtcctttccactttggggttggttgattgcctgttccttttatgctaatcccaggtggcttcattctcagaaatctgtcatggggaacccttaccccattgctaagttggtatcttttgaaaggaggtgggtgggaaagcagggagaggaagaggaataaatgattaaagggctacatctggctgtatctccacctctccactgacgctacttagtggaaggcactggtgacctcataggcacagccaccaatctgcctaggactcaacttttctgatgcgtgtggcactgttgcctcttctctcattggcaatacattagattcagtctctgtctctgtctccttgtctttccctaatcccctacaacatcccataaaatagatgttttgagtgttttttagattttgcacgtgagtatcttattttctttctcggagtcactgctactaccactactagaagctgctgacactttcatgcaccagccattgtgctatatgcctaatgggcttgtcacacttaatgctcataactcatctgtgaggtaggtggtggcattattcttgttttacggataagaacaataagactcagagtcagataacataagccaatgactactaagtgagaatcaaacccagaatctgtgcccctaacccctactctatactgtctttcccggatacaagggtgacctccacgtttaagccttctagctacctctctacactgacctgtcataagttccagcctaccaccttgcattctctgtagcatatgtctctgtaaatgccccactaagggaggcacttcagtgggctcaaagtcaaccttcatgtcatctgcccacaaaccagcttccctttatgatgtctccctgtttgttaacgcatttcccacctgccttatcaccgtggggtgtgaaacccaggaattactttctatcattctccttcctgaaccttcctcctcctaggcaattggtagagagagagcttgttgagactctcctccagaatgtctcttgcatctctgctgtcagctccctggatcagtttccagttagcacttactcaattattgccctctcctaattggtctttctgcctctgttctcttctagtctatccagtggttgagaattgcttaaactctgcggcccacaaatggagtgcaggattagctatctccctttcaaagccttcccttatatggtcgtgtttacctttatcttgctcctctgttaagcttaactacaaaattgctgctccagccaagtggaataccaaataacctctctagaatttcctcatctcttacctttgcttattctgtttctctaccttttaatagtccctcatccccttttttctgcccattgaaaaatacatatatttcatttcttatgtgatattttccttgaatgctccattcagagttgggctcttcctccatgtacctctctaacaatttatatggaagttaattgggacttggaccactcccctctactagattgcacgtacgttgaagacaaatgtattcatttgttaacatccagatgtgtctagcatagtgtgttccatgcagaaaggactcaaaatctctaatcctcttatcttgctgtcatttatcttcctaaaagtgaaaataaagcaaaattaaaattaaatcgggtcatgtagctcatctgttccaaagttttgggtagattcttcttgtataattgtcaaggtgccttccctgctttattttcagtgggcataccccctctgcccacctatcacccctgccagctcccccatctccaaaagtcccaaagtcactctgcttgcatccacactgcattctcctgcctttggacttttgctaaagctctattctctttcttaaatgtccttgaacatgcttctccctcttatccttgaagatccaagcctcctaagtctgccagactttgtgctgtgttataaggtacctatgccaaactgccttgagtcacgtttactcatgtatttcaatccactccccaacacctgtcccacaaaggaccaagacttgtgtctttgccctctctgtcactcattctacacaagctcagtactagggccagagtcgtacttaatgaatgcttacaaaattaagtaatggtttaactgaactaaacaactgattttagatatggggggaggggagatagacaggattagattttcaacactgatgttagtaatgaaatctctctacttactaacatgtaccccttttcacaaccctcatgaccccaaatcactgagcaaaggagtcccaatgggtcatgaagtaagaccacgtgttctggctccacttccctcctcactaaggccttctcttggccctgtgtgtgcaagtgtcagagggaaaattttatagattacaccagaataaacgtgggaaaggtcttgaatttattcttagacatttgtcagagaaaagaaggactatgcctcagatgttgtcattcttttaaagctgaatgatgaagtagtaaatccataatggaaagaattgtcaagttaaatctacaaaactgagcagggtgggtaggctataacaaaaaccactctgttgaggaggccgttgggcaggacatggccagaaacaagcgtgaacttacctagaagtggctcacacagaggacttcagcaaccagccttggtcaggtatttcgaaagcccctgtttaagtgttgagagtatattttggccttcttccccttcttctagtccatttagggattgcccgttctggatgaggttaccaaataccttcccttgaaactgaactcagggcaggggtcacagacccaaaagccagcagggacctgaccagtcttaagaagtagacctggagataagtagtgtcctagtgtaagagaagcaataggtcatggtgggaatcatggcaaactggagagtgcaagtcccatcaaaggcagtagtctccactctgttccagctgatcgctgccatgcaaggatgcaggcacagtcaccagatgctcaagaaaagccagaagtggacgtgataaaaatgtcatctgaaggtatcttctctgtatgtacgtatgaacacacacacacctgcgtgccagatgatttggtgcatgagtcataagtttttgacctttggcttgagaagacaggaggagaaaaagattccttcaagatttcttactggatgtcaatagtgggaggtagtttgattaattttctctttgaccattgctgtgatcagttaccaagaatccttcctacccttggcactaccttcggagaggctggtctgtgtgttgggtaaagttgcttttgtagagtggtgtgggaaagtgtggggagggtatggagaatgcagagaatgacctgggagagaggtatctgacatctttaataacgatcaagaactgatttttaaacctttagggcggccgggcagcagggggatttagtttctttttccttttgctctacagagttttgtattcactggattgcctggtgttgaccctaagatctattctagtcctttaaagttcagaagccctttttgatttgtttatgtgtatttttcccatgtagatttgatcactggccttctaatgctgagctaatcaacactggccaaactggaaagatataatcaagctacatgaatttgaacatgatttcatgtagattgcattttactggtaataacattaagaaagctgatttgaggagctgagccccctcttgtccctgctaggacttgagagccttgaaaataagttactgccttgatagccaactgtgtatgcaaattcctttactaatgccagctactaattatgaaaataaactcatctgtgctctataaatatctaattataataaaataggggcagtattacatttccatctcttgtctcatctgtttctcatccaccactgatttgtcctcttgacagtgaatataaaatcgctttgttttttcaagaagcctgttttccatgtattttttcttctaatgttttgaaagtctgtgggggaaaatagatttattttaaacataaaaagtaaattgcttgattttagcagctctgtgtttttggcagtgatgtctttgagacggtgcttgaaaaatatgaaaagtgtgtttttttcttgtttagaaattttgactggacaccaaagacattttttgcatggatgtttcttggagcattcaaaaaagtgttaatgtgaacagaagatttattaataaaatgtacaatgtatcagtagaacattttaattaaattccaactgacaatacataaaagaaattatttctcagattttgaaacaacatgtctgtttcctcctcctcaatgatcaatttggatttattgattacttatagattttatgtctgcgtatatatgtcataaaatactttctcctctaaggtatgaataatgatctatctgtttgtatagacctttgcttatccagttgagttagttaatcttagaagatatataattttcaactgtagatcaatatgtatacacacataaacttgactttgatagcacctacaggcaaagaatgttttgaattgtgttgtctttaagatacatctcatttgtaaagaattcgaaagagtagtctgatggaaagatacttaatgagagaacaagcaaagtgcatttccccttgtgcttaggcttgtacatgccatggtctgtttcttaggtgtgtagggcagtgtatatctgagtataggtacaatttgcacaagtacatattaataggcttatactggtgtattgtgtttttatgtgtagttgccatttgtaggtgtactgaaaataatagattccagggtgacatgtatcagaattaagcagatcctctgcttcaatattagaaaagcaatgcttatttggcattcaacaaatattgatggagagccaacgatatgctaggtgctaagtacacagaaactgagcaaacatagacccagccctctgacaccttgctcacagtcaatgggagtttgaaaatagctttcagatgtaacaaccacctttcctcaagtaaaaagccttaaatgcattgtttttaatgtatttttatatatgcagtttttaaattaatttttttattttaaagggaaattgttaggtaatcatttagtcagatcacccacgctttacattatcagaatcagaaaagaaaatgtgctttgtgtgtgaacacatagggaattttttatttgcttgtcatttatttgtttattggggatggcatacacagtgcaaagtgtataaaatgcatgctcttaagcatacagcttaaaggttttttttttttaacctgtatatacccacataaataccatccaaatcaagaaatagaatatgcccatcactataaggttccattgtgaccctttctgccattacttctttttctttattggttgatttattttttaaaaaattaccgtttatttttaataaatacatgtattttccccactcaatccaaaattgtgtttatccatgtaataatcagtaggcaggctctagattgcttaactttcattaagaaggattaaccttgtgagacacccaggcagtgtggtttttcactgtgtgtaaatagaagcaaaaatattgtcctcttgtgaggtagctttgccctgtttttgatgaagcgcaggtttccctctatacaaagagaatacctaattgatattattgagtttttctcttttttcctaaggcatttagtggtaagcagaatagcagaggtggaaaagaccatatgctttgtaaaaagccagactaataacactttttgatggatgtctgattgtaaaagtgctgcatctttcattaaaatttacatgtaaagcaagggcagaagcgatgacatgaaacctaatccaacttgcacatcttgacataataacaatcacaagaaactgcagatcccagatggcagcttggcctttgccatccttttaataagctactaactgctaattatttcactcttttgggcaagttaatttactgttgactcttaaagagatactgctctttttttcccccaacccacacaaaacagagaccttccacctggagctttgaaaagtgcttccctgcaggttggaagctttccagtcagttgtaacaacgatggcaagtattgggatgaaaaatgttgcttaataacattttcttgttttttttttatgaatatagagaatttaaaaaatttgttcgactaaagagccattgtgtgcatgtgcatgcatgtgtgtgcgtgtgtaagagcaatagatggagcagccaatgcagggagaagatctgaaatttggagcctatttaagagtgaaagaacagctgccttttaaatggttgctaattctgacaattaatgctgttctgtgagtgtgtgattttctgtgatagcagttaggagggatgatggtgtgtaatagctcatttcctaagctttatggtaatgtagcatagtcaagaccatagaactgaaagagaactgggtcccacatgctctgcagcccttttaaatgaaaccctgcaaagcctgcttttctctgtactttgacctccttaggatgattttatattttagcacagacacagattattaaacgaatgatgtgcaagtgggcttggatgcatcagaagtgagtttggaaaagaaccttgtttgcaatgagctgtctgacaatcaaaatatttacttaaagataagctaatgactatgcctcgcaaatgcctgcagatctattattgaaatgagagtcagtacattggcttgatactataaaaaataaatctcaaacctcaaatactattgtgtgtgtgtgtttgtgtgtgtgtattatacttctctccaaataaaagtctttcaagcaataaagaaatatagaaaagtctctcaacccattttcttgaaatatttgaaataaatttgttactgtaatccattgttccttgttgctggtaagaattgctaaatggcaaatatgcattgaacaacacactcttctattattagtgatatctctgaacctgaacttgataatgtgagttttgtggtccagtattttacctataatggcttgtgtgctatgaagttgatgaaaggactgtgaaactcaaatcaaatagaggctaatgcctcttgcttattaaacctagacttattaaacctatttgcgtattgactgggtaagttttaaatgttctgtttctttaaaaacaatgcattatatggtttcaaaataggcccaaggaaaaatagaaatctgggtgaatttgaggaagttttgtcatcttgtagaacctcgtattatatagcacgttcagccagattgtcatcttccaaaaaaattttgagaaacgctaataatgtttttttttttaactttttctttaggtttgggatatatgtgcagatttgttatacaggtaaattgtgtgccataggggtttggtataaattattttgtcacccaggtaataagcattgtacccgataggtagtttttccatcctctttctcctcccaccctccatcctccaccctcaagtagtccctggtgtcttgttcctgtcttggtgtccatgtgtactcaatgtttagagatgctaataatatttcaagaaaaaaaaactactgggaaaagtaagttctgaaaacatagttctaaactaagcaggtttattgactgtgggacttctcagagcctttgttatggcaatgcaaattacaaacctctgagaaggaaaatgtacatttcaaagttaccaaaatttatttgacatgaaacgcttttttatgattttcattttggatgaaaatagctagaattagaactagttagtgttcagttaaaaacactttggacagcaattttatagtagctaccaaagctaatattataaggcttaatgactctaaaatttgaaggaacttttggattggcttaactcaagtgtctttttaagtacattttctattttgattgggaatagtttttttggaagggttcgtttaaatagggaaattactgcttcctggtaaaatacacaccacagatgttaaaacaactgcaattttaaagatactagtctggttaaaacacttccagtttgtattacctgagtacttaaacagatatccatatagtgagcataaacaatacttctgagaatggctgcttaactctaggaagagctgatcttggcataacatgagaaaactgctaggaactttagtcttatttgctttcaaatttggagcaggtcaacagtcatcatggttatttctctactgtatatctaaggtcattcatcctgagagtctggttatgaatggcttttttttttttttttttttttccagacagtgaacatgtaggtgaaggaattgctttctggtaggaattacttgtttagaagtcattggctcagctaaggattttgtgggttgtcgcagtgcacagctgaggactttgtcctatttatgtgctgtctgttcagtatgaagtggcagccattgatccatctgtagtacaccatttgcctggggctatttatctggttgtggagatgtagtttgctgagccaggcatacgctcccttgtttccccaagtgaccagtaatgagtctttacaaatgccttggcccaaattgttacgagtgaggttctgcagttctaaactaattgatccatgtgacaactgaacctggaatactagatctccaggtgtgaataattctaacctagggtcagcattatggaacaaatagaacagtgagataaatgtgaggacctaattcagaatgctggggaataaaacatggtgggttagagtactgatgttagtgtttgacactcacaagctatacaaccttgttaagcttccttatcctaataagcaaaacgggagcaagaatactagacacttcacaaggctgctgagaggatctattgagacaataatattaaaggcttatggtagagcttagctaacatacataagcattagtttagttatcataaacattaacaacaaacatcagttatcataaatacattttgtcaatatcagcatcactcattaaatatgggaactttgaacatattattcaatctttttgactatctgtgtttttacctgtaaaatgcctacttggtacatttgttctggctaagaattgatacaatgcaggtgaaagtgctgtgcaaattaaaatagtgctacacagtgttaaataataagtagttcatgagactatgagcaccataaaatcagaggcagtatctgattttgttcgtcttggtatatccagtgcctgtaacattgcctgccccatcatagaaacaacttagtaaatacttgttgatgagttaagtaacttcttagcagagttctgcaacagggccagccccaagtcttcctgtgatcccattatgctttcaatagagagggtctttgggtacctccattgcaagagggaatcattagtctcttcctttagaacaagttcatccaaccccaggtctgcaggctgcacacagcccaggatggctttgaatgcaatccaacacaaattcttaaactttcttaaaacattatgagatttttgtgtgtgtgaattttttttctaagcacagcagaaatcattagccttagtgtatttcatgtgtggcctaagtcaattcttcctcttccaatgtggccaagggaagccaaaagattggacagtcctgctttagagcctgccatactaaaaatagtaatcctcataaaacctgttctttcttaggtttttgatagatgtgtctgcttttttttttgtgcacacaaagagctataggatttccttgtattacttgatggaactataggagccatgaagaaaacaaaaacatttggttgggttacttttaaaaaatgctgatttgcttcctcaaatcttagaagcatataatttcagagctcaaaggagacttagaattcctttagtcgattccactgtgattttgtggatgacagaacatgctgagagggcatgagtgatgtgtttgtcactgcacagaaaatttgtagcacaatcgggacttagaacagactttctgacttcagatgttgttttctttctcctcccaccaagttgcctctaagtcctggtcatcttcactgttgatggtatttgttatagatcattcataggctgctgagatcattgttgataatgccatataaggaagattctggaagtttcagtgtgcaaactttctaaaaaaggttatctcttaaattactagtctgcctgggaactgatacaactccagctttcaaagttgtcagtaagctgctttgaatttcagtattttatgatgctttgtaccacttacacagacttgctttgttgatggctttgtcttggctgaagtaagacggtgacaccagttgacttttaaaaagcttttatacccataactttttctttcttgctgtcccatgttgactatttataacagcgtggatgcatgttgagtgcaataaagatgagctgtgatgatattcaccagggactgatttacaaactgttgcttaatagttgtttgcacttcctttcttcctttaaaattagttgtcattttatttgtaattttttcaactaaaaagaaacattttttttttcaagtgagagtgtatttatctttaagccagtatcatttctgggttttctttttaaaaaacaattttttcggggttctaccatgtgtctgatgggttaagtttagtgcccgtccgtgaggcagccttgggggatgttgatgggtgcaggaaatcggttcttaaattgttgcaaaattgccttccttcagactgttttgatcacgagggctctcaagtgtcaaagtcatttgtagaactagatagataaaatgcatgagcactaagctttttttccaggatagaataaataagtgtgttttctactatgtgctccgcctttgatagtgatttgttaaaaggaaaaaagaaaggcaatgatattaaatatttacaagagtgatttagttctattatcctgtgcgctgcatctctgttttttatagtgaaatcagctactgtagaaataaatgccattaaaccagtggtagtgtgaaggtcaccgcctaggcaaggttagagtaatttgtggagagtaatgacttttgtcaactttccagatctcttcctgtttttagccggcttccctccaaaaattataggaaaaaaatacatttgaggattcacaggcttactgtctctcttgcatgccttatgccctttctggccaacctgatagttggaagactttcgtgcacttttttgtttgtttcgtctgtttagtggacagagacaggtctgttctccctggagatgagcagctgcattcccatttactggcttttctgttggttcttgcttgacagtttgttttggagatccagcactacttctttcttagaaatggtttatcttgtctgaaataatcctccagtttccctacttttacctctgcctttctttaaataaaggtttttttttttaacaaaactttctcgtatcagtttaaatacatttctgaatgattacatggcattatccccattttcacaggcaagaaaacagaggcccaaggttacaaagctagttacagagctagcagcagaaccaagataaactgagctttgtctgaccccaaagcctgaggtgacactactatatacgataccatcatttcaattaatttcactgaacctcagttttctcttctgtaaaatggggatgctaatatattattctaatatattctgaattcatataaatagtattacatatgatgtattataaataataagacattattttacttttggtaaaattgagaagtatataagctaacacatattaaatgcctaaaaagatgtctagctctcgttatggttttaatatattccctttcctctcgacagtaacaataaagtgtaattgaatttaacaagtattgagcacaagggatacacaaaatgggtaaaaatcagtctttgttcttgagcagctcacaatagagtaggaagaaaacccctatataatgaattccaaaagcgattcacttttttttcttttgtcttgggctttgtctgtaccaaatgccacttaaaatatgaaagcccttttctgggtgcaagtagtttgtttcctataatgttgagatagcatgttgacattgcagtggtagcgacttgtggtttgtttctctgttagtctgtgtttacttcatcctaaaatccagaagagtgggttgaaaatgggggaaaaacagggatacagggaagtagcaatgtatattactcagggcaggctaactgctatgacaattcccaaatcacagtggcttaatgctaacaaaattttctcacattccagtttgcggtgcagattggtgggtggtgaagtgggggatctctactccacacagtcattcaggcaccaagacaccttccgtcctgtagctttgtcattttctggagccttgtccttctttgcagtctactggcagaggaggagagagcgagcttggaggatttttcctaaagggccatgcctggacatagtgtgcatcatctatgattggccagaactcagtcacgtaatcccatccaattgcaaaggagattgggaaatgcaatttatctctgtgctcaggagaacaggataaggggcctggtggctacagtgacagtctctgccccagtggatgagttgtgttctgtgcttctgtgttctgatcttgtgtcatgcgtattagctttcttcagcccaccttcattcaaacaaaggtgagtatggtttctatgagatagagaatcacttctcattcatttttctattacacacatgtatgtgtattttgtgtatttttcttttccgttctttctttctttctctttctttctttctttctttctttctttctttctttctttctttctttcttccttccttccttccttccttccttccttccttccttccttcctttctctttctttctttctttcttttctttttatttttttttgagacagggtcttgctctgtcacccaggctggagtgcagtggcatgatctcagctcactgcaacctttgcctcttgggttcaagcaattcttctgcctcagcctcctgagtacctgggattacaggcgcttaccagctaatttttgtatttttagtagagaccctgttggccaggctggttttgaactcttgacctaagttgatccgcccacctcagcctcccaaagtgctgggattacaggcatgagtcactgcacccagcttgtatgtgtattttgtattaaacaaaacccttcagagttacttacattagtgtttctcaaattcgtgagaatcacccagggaacttgtgaaactatagactttagttcctgcctcagaactgtaggacctgcagctctaaattattctatgatcaggtaaatttgagacacgctgtgttacagcaaattccaaggaataaaatgaaccgaaaggaagtgtatgagactttaatagaagtattttgttgtattttaaatatttaaaacaagctgcgtttatgtataccaaatctatttgttatacgtagatttttgttgtagttcttgttttaagggatgtgacctctatcttgcatccataacccaaaagtgattgggatcttagcttgagttgatggagtggggccaaatgcctgattcaataggattttgttttattgtgatcactgggtaaaaatatctcagcattttttttcctctttatcgtctaaaaagggacacttttgattaagataattttcttgttgcattaagacaataataggagtacatgtttgataggcctgcttattttttgtgactgacttgtgaacagttaactgatggcaactcattttagtttgtagatatatcttaatctcttgtacgcatagtaaccattacctccatgatgttctgaaatgaagccccttcctgtaaagctgtgcttttttctcttgtagctagaggttggcccattgtactattggaatggatgtcagagtgtggataattctgggcttgtgatttttttctttctcctattttatctgcctctttttgtgtctttgtgagcaagtctgtgattactattgagtttttttccctaaatgccagcaattatctcacaggtggagggattaggaaagagctgagagaaatgcactgggtttagaataaaggctccccacccccactttaaatatggtgacaggagggagtgtagagttgggggcgggggtggcagacagctgtgggggtagggtggacaatttgcttctgatatttaaatccctagaaggagtaaaggaagaaattcctaaggaaagaaagaggaattaaagacctatataataagatattttggggttattgtttcagggagctggagatgcaggaagggaggggcagccacttttcttaacttgctttacctgcctctttatctgaaaggtgtttgtttgtttgtttttttcctttggtctgacaatttatttttggaggagaagggagctgggagggcctaatatatatgcccaggccaagagaattttggtgagacattccctttcttcccagcagagaatgatttatttatttgatatgtcagttaggatgctttcagctgcaaagaacagaactttcaactcaactgccttaaacaacaaagggcatttatgggctcagtttctaaaaagtccagtaactcacatgatatgaccaagacctagtgtttgtcttccccattttttggcttgactttcttggtgttggcttcatttttggcagctcctgcccatgtgattttaagatggctgatggccattcccaggatgatttggtttttggtctttgtaagtgagagagagtaacactcttccttgactgtattagtcagggttctccagggaaacaaaaccaagaggagatatatatgcacatgatgattgttatgaggaactggctcacgtgattagggaagctgagaagtcttatgatctgccgtctgcaaactggagaggaagccagtggtatagtttcagtgtgagccctaaagcctgagaaccgatggtgtcaatcccagtctgagggcaggagaagactgatgtcccagtgtaagcaacaaggcagagaaagcatattcccctttccatagcttttttgttatagtcaggtcctcagtggattagatcaggagtctccaacccccaggctgtggaccagtggtggttcatgacctgttgggaaccaggccgcacagcaagaggtgagtggcaggcgagtgagcattatcgcctaagttccgcctcctgtcagatcagtggcaacattagattctcataggagtgcaaaccttattgggaacagtgtatgcgagggatccaggttgtgtgttccttataagaatctgactaatgcctgatgatctgaggtggaacagtttcatcctaaaactatcatctcctcccctcttctgctttccccctgccactccatctgtggaaaaagtatcttccatgaaattggtccctagtgccaaagaggttgaggacttctggattagatgatgcttgcccacattggggagggcaatttgcttcactcagttcactgattctaatgcgaatcccatttagaaataccttcccagacacactcagaacaatgtttaatcagagtactgggactcagttaagttgacacgtaaaattacacttcacaagtctaccccttttcaactcgacactcatctatatctccttaaatgatacttaatctataaataaagataaaaagatcataatttcacctaacgtgatacacctatcctgagtataattgaaaatgcactaaagagttggttttcctcctacagtatattggatttagggggaggctggatatttgactccaaattttgggaatagggaaatggatattgagttgcaaatgccagctctaccttgatagaataactttcaaaatatgaaaccaaacccaactaggttcttaataaggacttgggaaatttgggggtgtatatttttcatccttactatctggctgtgaaatcatcctatttccatgagaaggggatgtcaaagagggagcttgtgtgccagcataggtaacatttggaagcagagaggtgaaaggggaaggccattggtatcctagcatctgtggaatcagggactcagcatcttaggatcttagttcattgacatgaaaagaggcagggaaatgtctgtgggaatggagtgaatgccaggcccaactttcttaagtggaaactgctctgatggcatcctttccttctgccttgatctcaggcctccacttaggtcacctgacatggattgctattgatggatagctgactgaggcagccctctagtctcaagtgtgtttttaacagagtggctctcagtaaatacctgtttctcaaatgcctcacctcattcacagagtctttctttttagctgctgctcaatcagctgctatttcttagcacactgacctaatttccaaccacacatttcatctaggattttgaggcagcaacatcccccccgattcccccaatgtcactgcgggtgttagctctaccttgacttgtggccacagttcttattacctgccttagccgtcagtataacaaggggcagccagtgtggcaggtagaacagaatgagttccctagggtgcaacaactggaaggatgtggttatcaggttcttcaaaccaaataccatgagagcaaaggcccttcttgaaagggctgctgcctcttagcaccaaggttgcatttgaccttctcaaactgctttctaggccagtgtgtctcacaatctaatgtgcacccgaatcatctggacatcttgttatacgcaggttctgcgtggggagggttgaggtggagcctaagattctgcatttttaacaaactcccaagggatgtccatgatgttgctggtatgtggaccattctttggagggacaagtctttgaggccatcactttgaatgatcttgcaagtgagggcatctgcttctttctctctaataagtcagaatgcaaagatccaaaggaggagaacagcactccttggaagtagatgggagagctgggactcagattcttaggaattagttgttatcttcaggcaaccacgcaagtgcctgctgaaactcaagccttctcatcccccttggataatagaagtggggcgtcagtctgcctctgtctccgtgtctgtatgggaaacatggaggtcatggcatatatgacaagtgcacatgtgctgttccattcccacaaggagagaaacatggggagtagcctataattctgtgtctaccagactcctcttcatgctcctaaaaaggcctgtttctgtaacaaatcatcaccatgaggacacatttctgggggcctacatgattcacagactgcccattgtaagttgcttgtaattatcaataggaaactcatgtgacccgtgagccccaagtcccacccccttgcccaaatttatcagggcttgccttacacactggtggttgctatgggcttgggtgactcccaacagcgatgacaatatacattctcagtaacctggagctggcactgaggctgcagccctggacatggggtgtcctctgggtataatctcacttaactttactctgcaaatgcaatgttggtcttgccatccctgtgttgtgttcagtcttgtttgatctcactctccctgttacccatctgtataatcccctgggaagaatgagatctaaacaaaaacaaaggagaaaatgcttaagaaatataatctgactgtctaacaaagcagatagttaagtctctggtggactcctttgttttatttggactagagggaggaagaaaaaagcttgggactgctgctggaggaacagaagtgcattaggaggctcatatttcacaactggttgccagtgtctatattggctgatggctctggtttccagctggcggtggccttggttgaaacatttacctggtgtcttcagggatgctgtatcaacagctgtaagtagagctagttattcagtctgctctgagaaaggttaaagtgtgtgtctttggcttccccagggactaatccagtaacaggagagtcagagagaacacgtaccacttgggagggggtttcttcaccgggattttcgttgttattttagttacaaatggaagcatttaaaacctaaatctgtatttaggcagtgagaggagaaacagggacggaaatgaattatttatttcatcactggggtcctggaagcgtggagtgggcgttaatctcctttgaacaggagcctctgggtcgggcttgaggtcgtctgtgtgagatctgaccttatctgctcctggccagacatctcggctttgaggaaattgacttgagaatactccaaataaaccctttaccttgttgttcagaaggatgtgaatatttacctagcatatagtcagaggaatcgaaagtgcttgtgtctgtgatttcttttaatcccattatttcccagtagatctgacgggagacctagaagcaagggaggagtgcctcacgctggtggtcaactgggagttgggggtaccgtgtggctttcctgtgtgttgtgctcaaggaatgtgtatctgcacatttatccagtgagagagctgcttttgttcccatttcactgatgaggaaatcgaggtttaaagagattcagcatctcacctaagatcacccagccctggctgggtgcggtggctcatgcctgtaatcccagaactttgggaggccgaggtgggtggatcacaaggtcaggagatcaagaccatcctgcccaacatggtgaaaccccgtctctactaaaaatgcaaaaattacctgggtgaggtggcgcatgcctgtaatcccagctactcaggaggctgaggcacgagaatcacttgaacccagcaggtggaggttgcagtgagccgagatcgcaccactgcactccagtctggtgactgagcgagacttcatttcaaaaaaaaaagaaaaaagaaaaagaaaaaagatcacccagccctaaattatccctgctgggattgctgggattcaagtccagggtgctcttcataaccccatcttgagctctttccagtgtctcgtgcatgctgctactttccatctgccccaaggcagcatatctaataaaaacattgaaaaactttcccaaggccaggaagggagaagtaaatgggtcaggggttacaatcactggtaaagacagaacaaaacccatcttcataaagaacagtgatttgcccttttaccctctcctgtcctatttctgtttttttctggattcataaatatttgtatgtgaatactcttgtatgtgtataccctctctttcctttcgtcttctctgctctttagagggcacaatgagtagttgtcattgttttttaaaggttcctgcaaggctctctgttggatttagtttattcttgctaaaacatttctgagacagctgttgaaagcaactggtgctttgtacatttctgtcttcagtcatcaaggtggggttcttggttccatggtagagagaaggaagggttgggtgtacttcttcctttcacagttttgaagtttcaaggtccctaaaccgagtcaaaagaggtatgtgtttgaaaatgctttatgcctccaaggtctcataggcttcaaaacattgctggtttccccttccagatccattgcttgagtgtctgttgtgtgctgggcgtcggagattcagagaccatgttccttgataaccagcaattaccttctgaatgttacctgagtgcagatgaggaaggtctctgaaagcatacagggcgggggcttccaatacacactccctactttggactgttcaccactttgaataaaactaggatcacactcccattccttccaaaattcttactcctttctaccgcactaccctcaatctgcataccagccctttttttttaatcagctcttaaattttactctaatccaagccaaaaaattttattgagccttcatgggttattaggggcagggggattgcataaatgaaataagccaaaccctcagcttctgaatctttacaatcctttggggaagatgcctgtcaaatatgtaattgggaaagccacagatgttaggaaaaggggcaaagtgtactagggaagttgagtaaggaggttgcactccctggctattcggaaaggggtgatcattcctcctggactctagtttgaacatcctttgccttgctcttgctactccatgaaaatgcgctctggagtccaagacctccaatagtagtattgtgtaatgttgtagccttatttaatgtctctttgttttctgattgtctctgtcatgttgcttgccgtgatataccaccttctgtggggctgcagacaaataaatcctccctcaactctgtgctccatgtgtcactctcccaatgaaaagacttttgatggctgcccccattccctagaagataaagttcaagctccttagcctggcattcggtacttcacagtttggctaacctcagctcccatcccacttgctgaaaccttggctagaaccccaccctgctaatccatgatgcttcactatcccaggtgccgtcttatctctgctcgtgcttgcccatttatcagggacatttctcccatttgtagccatatcttgaagtttaatttgagcctcacacactctgtgacactttgcctggccacctcaactccttagaatgtcgtgctgctttctagctgcaccatgcattagctatcttccccgcactatgcctttctgcaatgtgtgtcaccttcgtgtctccccaaccagtctgaaatgaggctgggcaccttatttcttactccttatggccaccataatgcctctacaaataaaggcttgatgttataggagaggagattgactgtatctgattaactagtatttcacagggtttaacacaatgcttgggtgggggataaataggaaaagaacttgaagatttaaagtgaatttaaaattgtatatatcttcccaaatatcaacctacgaacatgataaaagtattactttcatttttgtgggggatgaggtaccgtggtatgggctacagaaattgagattggggcagaggaggaacagtaacacagaaggaggtgagttgggaaagaatgaagagagacctaaaatcaaagtgccctgtgtgtggattgagaagccctggatttaagtcctaactctgcatttctgactgcatagcttgggtaagacgcagcacacctggagcctcatctgttgaagggggatttaacccctgccgtgcctgccccaggtttgttgggaaattaaatgtgtgcagtttgtaaactgtaaagtgtactgtgaatggaagggagtggtgttactataaacagcatcatcatttatcagctaaatcctccctgagccatactgtggcaggggaatagatcgatggataggtctgctgtgacaggcaggaaaagaccagactggagggagcctgtggtcagatcctgtaggccctcccatctgtacgaatattctcatgccaaggaagtgcttccctaggccttgtgaataaagataaggtgcataggtcctaaccttacctgtgacaggtacaagtgggagcccagtcccaggatcctgatggtcagatatcaggttttggggtataaatatgaacacaggaactagcaggagaggtgggttgtggttctagatctgtacttaccagccatgagcagtttctccaaatgtagtattattaatacaatgagtgccaaggatggagtgcttcatggccattatctcacttcatccttgcaacaacactatgagctgggtgtatagcaatatgtgttattatcctcctactacagacaggagaacagggtcagggattgagactagcccaaggtaactagctaatgagaaacccgagctgggattggaacccaggcctgagctcttaaccactatgctctgcagccttcaacctcttggagcctgtcttttcatctgtattatggggataaacccgcttaccacatggggtatgaggatctgatgagagaatggacatggaaggactgtgcacactgcaaagtgtctatggtacattcactgagcacctactgcatacctggcattgctgtgggtactaggacatagtggagcataggacagctgagacacctgctcacaatgagatgtgttctacccatgatctgttaacagaggaagctgtcagaaagtgggaagaaaaaaatgcagtgatctgagagtgtttttgttttcaaaaaggaagaagtcctgttaattgccagtcattgccctttaagtctaccttcattcattctgaagtataaataacaaaaccaaattaagagattacgcaatgtgggaaatttacagagacagttaaacagagaaaagcaaagagagtgcattaataaaaggacaaatcatgtcaggacattctgatcactacagaaaagcaaatcacagttctagaaggtgagaagtatgcagtggatgtaatatatctggattttagtaaaatcacttgatggagaaatggcctgaaatcttgcctgagaaattaattcaagctggccaggggggaagccatgtcactcagaatgagaactggctgggagatgggagtgaaggttgtgatgacaaatggccttagctttcggggtgtgatagggtcaggtgagaagacccaatttggccatcatcacttaatgatctggaagaacaactaaactcctggtactgacattcatacgtgatgctaaattgggaggtgtcatggcgatggcttgtggaaggaagcatagtataagaggtcagcagtcaaggacaggaggccgaggcaggtaggaacaatgcgggagagtacaggcaaggacaaatggagggaatttccttgaggacaatctgcaaacattaaaaaatttgcaaatatataaaaattagcatcaggacaggaatgagacaaaggtccaaggccgtccaaggatttatccttccataatttgaactgaacgtgaggaatggacaggggttatgtttcggggtgtgggaaggcacctgagccatggtggtccttatagccacagtgttgcataggactatcccttcctctctcttcagtgtgatagggtcagaggcagaagtactctgcctttcacagtgtcacagattgcttgaatgaatgtacactgtgcacatttgcattctgcctctactactgaatctgtaaaatgggagaataatagtccttactttgggaattttatgaggaatagacaaatgtgataccctaacaccatgcctcatatatggtaagtgcttgatagatgttatctattattatcgttatttttatcattatcatcattgccctgtgtgcccagtctgtacctgatggaatggcctttctcattcaagtaggggaagaaacatccagagaacagtttgaaaaaaagcatagggtgtaaaaaaaaagcctagggtcaggggatctagattctttcccaagctctgctatagctgaccttgaatgagttgtttcatctctctgcccctgtttccatttgtacaaacatctggggcttgacctggtgatctctgaggtcccttctagctggaaaagtttgcaaatctatacaaatatgcaaagtgagttgagctttgtattattcaagttgtcatttttgagggatatcttctaacacatctcactctatagacttattctttacccagcaattgccatcctggagagggtgacaaacttgtatacttttagcactgaaagccccgtcttccagaaacccccttagtcctgggcaaaccaggatgattggttagcctgcccataggataactgctagcctgttggaatgttgcatggaagtctaaatacacatctgcaagaatgcaggagttttactgagctcaggggagccatccctagaaagccacccaacattttttatggggagtagagtgatcaaagttggggaagtgtgtgcattggaggtgccagagacacgagtacctatagaatgatatctgtggccatacctcatctctacactgacccagtcccactcagggttcttttggctgcttgcagccttaacatgtgctgagaggagagtcatgagtctgagaagggcaccatttcacaggataagtaaatgtgaagttactctgtgaaaagaatgagctgaaacaaggagttggttatgttttccacagctccatctggaataacatgttccgttttggattcctcagggaccagaaaggtgacaggttgaagggactgtgagggagtcacgcatgtgattgacaatgtagaggaagtaattgaagggaaaaaaagaaaagaacaaaaggtatacatcgtggtggggtgcacatgtttgtgcagggaaagagaagttaactaggacatccaggagcagaagtaagatgaagcgtggtgttcacagagcaatggaggttgaggcaaaattcgctctgaagttacacatttaattctgcaaatatttatttagcagctacttactctgtgctatgatctgttctaggtgtggggaacacataaagatgattactgccctttctttgttctagtggaggagacatgcagtgtgtgtaattgtgaacagaatggatctgaattcgaatccagttagtctgcttactcacacaactcactgtgttgccttgagtgagttacaaaaaaaaaaaaaaaaatctctctgttcctgagtttcctcatctgtagaatggacataatcatagtactgcctgttatggttgtgaggattaaactagtttatgtattttaagtacttacaagaatacttggcacatgatccatgttactaatattattattaagtgaactaatgcattcaaagtgctcagtgcaagactcaataaatgttagatattattagttattgttaatggtatatcgaaatgaggcataatagaaccatgtttgaagtgcaaaggcaacaaagacaaggcaaaatcacttggggtcggggaaagaattaatatcacagaaacctactgtcaacctaaaggtgatatttgaatggggataggaaggatcagtagagctttgcctgctgggaagaaagggaatcctaggtgaagcaaacaacatgaacactggctcatctcctgaggttgtagctggcaatttgat

SEQ ID NO: 408 - DNA, 20001 bp, Homo sapiens
cctgaggcctcctgctaagaggagcagctgcccagggcagccactctgccctctgggcccatatgcttagtcactgcctgctctcagcacatggcacaggctctggttctgctcaccggtgggtgtgggggctatctgctgccttcatcaggagcctggcctcagcaggggtcacatgctatccctggggcctccgctccccaggcagagcccaagctgggtgccatggcagcacctccaagcagagacagaaggacaagcagagcctgggcccaaagccccggggccagcacagcgcagggagcaaactgctgcagggacagagtatccggcagggccctgggagaatgtgggcgggggccggccggcatgcgcacgtgttgtgcctgtgggtgtgtgcatgtctgtgtacgcgtgtccatctgttgtgtgcctgtgggtagtgtgcccgtgtgtgtgtgtgcctgtagtcagtgttctctttgtgtgcctgtgcatgtttgtacatgtgtgtccacatatgtttgtgtgtgggtccatgtctgtgtatgtgtgtgcccatgggttagcacgtctctgtgtgtccatgtgtttgtgtgtgtccgtgtctgtccatgtgtatccacacatgcctgtgtgctgcctgtatacgtgtggccttgctttcagctttctttctggaagcagtaggaggaatggcaagtctgaggtcagcctgctgtgagcagctgcagggaattcaggggtttctagaagccactgaggcacgcaggtgggtgaggcaggggtgggggctgtggaggaaggtgttctgcaggggaggcgcagggtgggtgcagcacagccgccaccccagtaggccagagcatcgtgcactcaggaccagtatcttttgaatggatctttttatttctaattttataagatgcaacatctcaccccgttgacacggttagtttgcatgcacacacagagcggccagccgccccgagcctgtgggcaggccagcagggtcagtagcaggtgccagctgtgtcggacatgaccagggacacgttgtacagggtgggtttaccggtggacttgtccacggtcctctcggtgaccctgttgggcagggcctcatgggccaccacgcaggtgtaggtctcccccgtgttccattcctcttcggacacggtcaggatgctgtgggcgaagtaccggcctggggcctggggctcaggcattggggcgctggtcacatacttctccggggacaagggctgccccctctgcatccactgcacgaagacgtccgcgggagagaagcccgtcaccaggcacgtgatggtggccgactcccgcaggttcagctgctcccgggctggtggcagcaagtagacatcgggcctgtgcagggccacccctgtgaacagagatggtggtgagggcggggcagtggggggaccagcctgtgggctggggttgagtccccttttccccagttgcccagacaacgggggagtgaggggtgctttccaccatgccccagaggccaagggaggtcccagggagtgcaggaagaggggcaagagtggggcctacccttgggccgggagatggtctgcttcagtggcgagggcaggtctgtgtgggtcacggtgcacgtgaacctctccccggaattccagtcatcctcgcagatgctggcctcacccacggcgctgaaagtggcattggggtggctctcggagatgttggtgtgggttttcacagcttcgccattctggcgggtccaggagatggtcacgctgtcataggtggtcaggtctgtgaccaggcaggtcaacttggtggacttggtgaggaagatgctggcaaaggatggggggatggcgaagacccggatggctgtgtcttgatctggagtcaagagaagggagtcagaggtggggcaggtgtggatgtgggcggaggcatggttcccacccaaagagtagcaactgcctctgccgagcccaggggtcctgccgcccgagcccctgcccttggccgctctgggaagccaaggctcagggagtagatggctgcatccggggtggcgaatgccagacccgagtggacccctgtgtgtcggtgggtgctgcccctggggacaggtcactcaccggggccacacatggaggacgcattctgctggaaggtcaggcccctgtgatccacgcggcaggtgaacatgctctggctgagccagtcgctctctttgatggtcagtgtgctggtcaccttgtaggtcgtgggcccagactctttggcctcagcctgcacctggtccgtggtgacgccagaccccacctgcttcccctcgcgcagccaggacacctgaatctgccggggactgaaacccgtggcctggcagatgagcttggacttgcgggggttgccgaagaagccgtcgcggggtgggacgaagacgctcactttgggaggcagctcggcaatcactgcagtgagggacacgtgtcagcccggtgcccgccactcccgcccccttcggctccctctctgtcccggtggctgggcccggccctcacctggaagaggcacgttcttttctttgttgccgttggggtgctggactttgcacaccacgtgttcgtctgtgccctgcatgacgtccttggaaggcagcagcacctgtgaggtggctgcgtacttgccccctctcaggactgatgggaagccccgggtgctgctgatgtcagagttgttcttgtatttccaggagaaagtgatggagtcgggaaggaagtcctgtgcgaggcagccaacggccacgctgctcgtatccgacggggaattctcacaggagacgagggggaaaagggttggggcggatgcactccctgaggacccgcaggacaaaagagaaagggagggtgaggagctgcctcctcgtgccctgcctgtcggggctgagtggcgttctgagtgccctcactacttgcgtcccgctgtggctgccccaccaaggccgagcccacctgcaggcctccaaagcccagactgtcatggctatcaggggtggcggggccgtggtgaggcctcaggtctttgtccaaggctgctggggctgcaggcctcggcccatcctgctgcagggcccagcactgaacacctggacagacctggggtctcctggagcaggctgagccatccctgccaccattcagctggctgccctgctgcactctgaggcctgactgcccctggctccctgctcagaatggctgagggctcaggtttgggtggaccaggcctgctttcccccgaggcatcagcacgtaggtgctgcacacactcagctcccagcacatgcagctggagggcccaggttgcatacctgaatgtgaagcctggagccacacaccccgcaggcagccaatagagtccctccagcccagcttctgctgcccccagctcagtcacactccagctaccctgaagtctccccaggcagacaacccaggcctgggagtgagtatagggagggtgggtgtgatggggaacgcagtgtagactcagctgaggctatccatctatgtccaacaagatcatgaagattggcccagtgccatgtcctccagttcatcccagcccaggccagctcaatccagttcatcccagcccaggccagctcaatccagcccagcccaccccaccccagctcagcaaagccaagctcagctcagcccaactcagatgagctcagaccagctcagcccagcctagctgagctcagaccacctaagaccatctcagctcagcccagcccagctaagcccagtatagcccagcccagctaagcccagtttagcccagcccagctaagcccagtatagcccagcccagctaagcccagtttagcccagcccagctaagcccagtatagcccagcccagctaagcatagttcagcacagcccagctcagctcagcacagttcaacccagctcagcccagctcagtgcagcacagcccagctcagcccagcccagctcagctcagcccaacccagcccagctcgctcaaccttgctcggctcagcttagcccagcccagcccagctcaatccagcctggctcagcccagcccagcccagtttggctcaacccagcttggctcagcccaggtcagcctggctcaactcagcccagcccagcccagctctgctcaacccagctctgctcaactcagcccagctcagcccagctcagcccagttcagctcagccctgctcagcacagcacagcagagcccagctcagcccagctcagctcagttcagctcagccctgttcagcacagcacagcagagcccagcccagcccagcccagctcatcccagctcagcccagcccagcctagcttagctcaacccagctcagctcagttcagctcagccctgctcagcacagcacagcagagcccagctcagcccagctcagctcagttcagctcagccctgttcagcacagcacagcagagcccagcccagcccagctcaacctagcctggctcagcccagcccagcccagcccggatcggctcaacccagcttagctcagcccaggtcagcccagcttaactcagcccaggtcagcccagcttaactcagcccagcccagcccagctcagcccccagctctgctcaacccagcccagctcagctcagctccgctcagcccagttcagcccagctcagcccagcccagcctagcttggctcaacacagctcagctcagccagcccagaccagctcagctcagcccagtccagctcagctcagcccaacccagtccggctcagcccagcccaacccagcccagcccaacccagctcggcttaacccagctcggctcagcccagatcagcctggctcaactcagcccagcccagctcaacccagcccagttcagcccagctcatccaagctcagctcagcccagcccagttcagcccagcccagttcagctcagctcagcccagcccagttcagcccagcccagttcagctcagctcagctgagcccagcccagcccagtccggctcagctcagccccgccccactcagcccagctcagctcagcccagctcagcccagctcagcttagcccagctcagttcagccaggcacaatctggctcagcccagcccagcccagctcagcccagcccagcctagctcagcacagcccagttcagctcagctcagcttaactcagctcagctcagctcagcccagcccagcccaggtcagctcagcccagcccagcccagcccagatcatcccagctcagctcagctcagctcggcttagcccagctcaacctggcccagcctggtccaggtcagcccagcctggaccacccagcccagctcagctcagcccagctcatcctggttcagctcagctcaacccggctcagcccaggtctgctcaacccagcccaaatcagctcagcccagcccaggtcatcccagctcagcccagcacagcctacttcagctcagctcagctcagcctaggtcagctcagttgaggtcagctcaactcagcccaatccagcctggctcagcccagctcaccctagctcagcttagctcagcccaactcaacccagcccagccttgcccaacccagctcagctcagcccagcccaggttagcccagcccagcctcggcttagctctgctcagctcggccctgctcgcctcagcccgttcagcccagttcagctcagctcagctcagcccagctcagcccagccctggttagctcagcccagctaagctcagctcggcttggctctgctgagcttggcccagcttggcttagcctgatacaacctgctcagcccagttcagctcggctcagcccagcccagcccagcgtagctcagctcagctgagcccagcccaggttagctcagccccagtccaggtcagctcaactcagcccaaaccagcctggctcggcccagctcaccctagttcagcttagctcagcccagcccagccctgcccaacccagctcagctcagcccagcccaggttagcccagcccagcctcggcttagctctgctcagctcggcccagcccaggttagcccagcccagcctcggcttagctctgctcagctcggccctgctcgcctcagcccgttcagcccagttcagctcagctcagctcagcccagctcagcccagccctggttagctcagcccagctaagctcagctcggctcagctctgctgagctcggcccagcttggctcagcccgacacagcctgctcagcccagttcagctcggctcagcccagcccagcccagcgtagctcagctcagctgagcccagcccaggttagctcagccccagcccaggttagctcagcccagctcagctctgcccaggttagctcagccccagtccaggttagctcagcccagctcagctctgcccaggttagctcagccccagtccaggttagctcagcccagctcagccttgcccaggttagctcagcccagctaagctcaacttggctcagctcagcctagcttggctcagcccagcacagcacgctcaacccggttcagcttggctcagcccagcccagcccagcctagctcagctcagccccgctcagcccagcctagctcagctcagccccgctcagccccgctcagcccagcccagcccagcctagctcagcccagctcagcccagcctagcccagctcagcccagcccagctcagcgcagcccagcccagctcagcgcagcccagctcagctcagctcagcctagccttgctcggcccagctcagctcagcccagctcagcctagccttgctcagcccagctcagcccagctcagcccagctcagcccagcccagcctagctcagctcagccccgctcagacccgctcagcccagcccagcccagcccagctcagcccagcccagctcagctcagcccagccctgcccagctcagcccagcttagtgcagccaagcccagctcagctcagctcacctggtgcaacttagcccagctcagctcagctcagctcaacccagttcaactcagcccagttcagctcagctcagcccagttcagccttgtttagtctaggtcagcttaggtcagttttgcccatctgagtccatttctgaaagctggatggagttgtcatggccagaaatggtcagcccaccagacctgcttgtctcagctaaagccatctcattgccaggttcctgcacagccaggctggcttccatcttttgtctccctctacttgataccccagttccctgcagtcctgccccagcgccacctgggttttggttccaaagcattaccaatcattaccaccctccactacctgggtggaatatttctttgctgctttaaagtcattaaaacatcttgagaatgagaccaagaatttaggagcctgtgctgtgataaaaatgagcaggtccccttgctctagaagtggcagcatatcttctgcaccaagaggagggtattgagatgctcagagcctccaccttcccggagcatcccctcccttctgagtctgcagtaaacccctgcctttaaattccctctagataacagtcatcattggaaacaaccaagaaatgcattttatctgaatttgccacttaaaattctgccatttaccataaatcgctttggaaggcatgggctactttcaagggtgcgatgatgacctacagtcaatgacttagacaagggcgatgccagtggggcttggtatgttctcaagcatcattacccatgccatccccattcagaggttgtggagcagctcgtgcgacctctccttcaaatgggctttagggaaagttaaatgggagtgacccagacaatggtcactcaaaagactcacataaatgagtctcctgctcttcatcaagcaattaagaccagttccccttctagtggaaataagacgtcaaatacaaagttttaagagaagcaaatgcagcagcggcggctgcctgtctcttaccatgtcgggcgcctggtcactgcgagccttgcaaagctttggcatggaatcattcctccaagtccattaacaagggctggggcctgagcagccagtcggcccggcagcagaagccacgcatcccagctctgggtagtccggggagacccaaagcccaggccgggcctggcagccaccctcccagagcctccgctaggccagtcctgctgacgccgcatcggtgattcggaacagaatctgtccttctaaggtgtctccacagtcctgtcttcagcactatctgattgagttttctcttatgccaccaactaacatgcttaactgaaataattcaggataatgatgcacattttacctaaaacttatcctaaagtgagtagttgaaaagtggtcttgaaaaatactaaaatgaaggccactctatcagaatatcaaagtgtttctccttaatcacaaagagaaaacgagttaacctaaaaagattgtgaacacagtcattatgaaaataatgctctgaggtatcgaaaaagtatttgagattagttatcacatgaagggataacaagctaatttaaaaaactttttgaatacagtcataaactctccctaagactgtttaatttcttaaacatcttactttaaaaatgaatgcagtttagaagttgatatgctgtttgcacaaactagcagttgataagctaagattggaaatgaaattcagatagttaaaaaaagccttttcagtttcggtcagcctcgccttattttagaaacgcaaattgtccaggtgttgttttgctcagtagagcactttcagatctgggcctgggcaaaaccacctcttcacaaccagaagtgataaatttaccaattgtgtttttttgcttcctaaaatagactctcgcggtgacctgcttcctgccacctgctgtgggtgccggagacccccatgcagccatcttgactctaattcatcatctgcttccagcttcgctcaattaattaaaaaaataaacttgatttatgatggtcaaaacgcagtcccgcatcggggccgacagcactgtgctagtatttcttagctgagcttgctttggcctcaattccagacacatatcactcatgggtgttaatcaaatgataagaatttcaaatacttggacagttaaaaaaattaatatacttgaaaatctctcacatttttaagtcataattttcttaaccatttttctcagaagccacttcaaacatatcctgtcttttaacagtaagcatgcctcctaagataaacaatccttttctcttggaaaccagcttcaaggcactgaggtcctggagcctccctaagcccctgtcaggacggcagccaccgtttctgggctacccctgcccccaaccctgctctcatcaagaccggggctacgcgtccctcctggctggattcacccactccgacagttctctttccagccaataaagaatttaagatgcaggttgacacacagcgcacctcataattctaaagaaaatatttcacgattcgctgctgtgcagcgatcttgcagtcctacagacaccgctcctgagacacattcctcagccatcactaagacccctggtttgttcaggcatctcgtccaaatgtggctccccaagcccccaggctcagttactccatcagacgcacccaacctgagtcccattttccaaaggcatcggaaaatccacagaggctcccagatcctcaaggcaccccagtgcccgtcccctcctggccagtccgcccaggtcccctcggaacatgccccgaggaccaacctgcaatgctcaggaaaccccacaggcagtagcagaaaacaaaggccctagagtggccattcttacctgaggagacggtgaccgtggtccctttgccccagacgtccatgtagtagtagtagtagtaatcacaatggcagaatgtccatcctcaccccacaaaaacccagccacccagagaccttctgtctccgggcgtcacatggaagctgactgtccgtggccctgtcctgcccttctcatggaaccctctgctggcctcccacgtaccccacattctggcctgacccctcagaagccagaccactgtcggcctgggaagtccaactgcaagcagacggctgctaagtcacccccaggagtccaaaaaccccggggggcacccgtcccagagagcgggtgccttggagcgggacagagtcccaccacgcaatcatcacgacagcccctgagaatgctccaggtgaagcggagagaggtcaccccagaccagccgaaggagccccccagctgccgacatctgtggccggacttggggaggacaggctgggttcccattcgaagggtccctctccccggctttctttcctgacctccaaaatgcctccaagactctgaccctgagaccctggcaagctgagtctccctaagtggactcagagagggggtggtgaggactcacctgaggagacggtgaccagggttccctggccccaggggtcgaaccagttgtcacattgtgacaacaatgccaggaccccaggcaagaactggcgccccgctacgtccctgggaccctctcagactgagcccggggagggcccgggggttgttgggcattggaccccagaggcctagggtggccctggccacagagagacccgtgctgctgggctcaggaggaaggagcatctggagcccttgcccctcgtctgtgtggccgctgttgcctcagggcatcctcctgagccccccaggatgctccggggctctcttggcaggagacccagcacccttatttccccccagaaatgcagcaaaacccttcagagttaaagcaggagagaggttgtgaggactcacctgaggagacggtgaccagggttccctggccccagtagtcaaagtagtcacattgtgggaggccccattaaggggtgcacaaaaacctgactctccgactgtcccgggccggccgtggcagccagccccgtgtcccaaggtcattttgtccccagcacaagcatgactctgcccaccctttgccccagcagcagagtcccagttcccaaagaaaggccttctgctgaacgtggtcccaaacagccggagaaggagccccggagggccccacatggcccagcgcagaccaaggagcccccggacattatctcccagctccaggacagaggacgctgggcccagagaaaggaggcagaaggaaagccatcttacctgaagagacggtgaccattgtcccttggccccagatatcaaaagcatcacacagggacacagtccctgttcctgcccagacacaaacctgtgcccgtgcaggacactcgaatgggtcacatggcccaagcacagagcagaggcagccggcgtccctgtccccagccacacagacccccgggctgagacccaggcagggaggggtgacgttcccagggagacggtggccgggctgccctggccccagtgctccaagcacttgtagccacactaaagcgcaggcctggtccccggcacatgaacagccagcgcccagccccagcccaggctctgcccacaacttctccttcccgtccctgccctcggcctgcttgctacctgtggagggtccctgacggggctgaagcccagcggggtccctgcctgtccttgggggctccagctggccccagggctaagtgacagcagggctctggcatgcagcccatggcggagaccccagggatggcagctggtgtggcctcaggccagacccaggccggctgcagaccccagatacctggcctggtgcctggacagagaagactgggagggggctgcagtgggactcacctgaggagacagtgaccagggtgccacggccccagagatcgaagtaccagtagcacagcctctgccctcctgcttctcccatacaaaaacacaccctccgccctcctgccgacctcctttgctgagcacctgtccccaagtctgaagccaaagcccttgcctggcccagtacacctggctccccgctatccccagacagcagactcacctgaggagacggtgaccagggtgccctggccccagtgctggaagtattcagccacggtgagtcagccctgagccaggggctacagaaacccacagcccggggtcccgggggagcatggtttttgtagagctgccaatcactgtgtccccagttagcacagtggttctcagctcagccaaaaccctgcggctggtagggggcctgtggggctgggggctgatgtggctgcggtctccagggcgggtcgggtccaggggcccccagcacctttgccagtgctctcccttccgctgttagccccaaaacacgtgggagaccccagccctcaaccctgccagtcactctggagtcttgtgccaataatttgctgctgttaagaatcattagagtgctgaaggctgccaagtgtgtttttccttttcttttgtaaattagagcagatctgaagctgggtctgtcacgccacctctcatccacttgctttctgacttgttttcccagcagcagagaggcccgggtggcggtggccaggggagcctcctcgcctggagggccacggcccccgccagggctcctcgctggcctgcaggggcaggaagcctttcctgctctgatcccgtctgtggggcccggcgggggttgcctggttggttccacctgttcaccgtcgtcccactgaacgggaggcctcagtgggtggcactgggcctcactcaccacggcgccctggcgtgggctccctgcgtgtccaccagtgctgggtcccttctctgagcctcagctggtcctcagtgagtctcagctcttcccatggtgggtgccagggaaggtgcaaggtggtctaaggagagcccctccccaggcctgcactggctgccttccgccgagtctgggtgaggggctttgcacgcaccactggccagacgcgggctgggtggggccctcagggaggctgaggcctgcggccaggtgtgagcatgggggtgtgcctggtgagggcctctgctggggatgaactgatgggcacagggtgtctgggggcaggggaggtgccctgcgggcttgctggggagggtctgtgtcggggcagagttccagggagaggaacaggcaaggcaaaggctgggaggctgggacctgtcgttggaggacacaggtggtttcctgaggctgggtggaaagggggcctgtgtgccttgaaggggccgaagggtgctgggggcttgcttaggcgctgcccaagaaggccccctcaggcaccgtgcgggcagggatgaggggtctgggagggaagcctggatgtggggagagggttggggctcctgtaggggtgtggacagaatggcggcggtttgtggagtttcctacagggttccaggcaggacgggggaccctgaggtgctgtctgggacagtggatctctctagacatggttgaacagctgccagcatggggatggagtcttaggctgggaatggtgagagaacccacctccagccacgaggggccgagaacccatttgtttaggggtggttgggccctgatggcctgggaggcacctgtgagggggtgaggtgggggagtgaggaagagggtggtctggcgctgggggagtggctctctggcctgaggaccctctgcccccacctgccacaagcacacaccagggaaagcacacgagtgtcacaggcgtggcggctggatcctacaatgggtggccagggcagggcccacaggccaggtcgagttggtcccccagcctctcccaacagctggcatctcctggggcacctgtcccccctgagggtcacttagcctggatggtacctcctggcctggctgccctgagcagggctgggagctgagctgggagctgcggccccgagggcagtggagagggcgctccgctcacgtggcccacacactgtttaggacgcggcctttagagtctgctccgctcccgtggcccacgcactgtttaggacgcggcctttagagcctgctccgctcacgtggcccacgcgctgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcactgtttaggacgcggcctttagagcctgctccgctcacgtggcccacgcattgttcaggacgcggcctttcgatcccgcggaagacagtccttgagcaggagcagctccccagctgagacagggccctggatgtccaagccagagggaaaggcccggggtcaggaacaagggagggtctgggcctagaagcaggggggcaacacctactccaggcactgagcctctggaccgtgcggtcctggagaaggagaagccagaggcgacccctggcagggatggcaggcctcacgggaggacagggcactgccgcaggtctccacgccttccaggcctatggtgcagcttggcgagctggccaggctccaggttggtgaggggctggctctgggctggctctgggctggctctgtcatgggccagatggctagaacacagggtatcactgtgaggaatgacgctgtctgtcactcccaggttagggagaacgcgttgtttcccttatacccgaggctccgcttctgatggtctctgctgtaggagacgtggtttccacgcttccaccactgctcctgccggcctgggtactctgctctggggggatggcccttctgggcaaagacacagcagaaagagtcttgctgcttcatttcccaggtcagaagcaacgcaggagcacaccactgcttcagctgataatcgacagagtctccctcctctaacacccaattccttccctaagaggactgggagagtgaggagaaggtctgaggagaatcatcttccctggcatggagcttggcattttgtcccaaaggaaacagtggaatttgcttggggtgaattttgcccaagttttttcagcttttcccattttgtgtgtaatactcatatgctatatagagttgggttttatcttgtggtccaatttgaaagtctcttccttttaataggcaagttaaggccattgatgtttgttgttttcatagatctgtttggcttcaatcttatcttagtagtttatattttctatttttatgcttccaaaaagttttccatcttaagttttcttgttctttgctatcttctatgtgtagtggctacctttataactttccaaaatattctttgttcttctttggacaatgtactttagttctttactatatacgagtatgaaattacctggtttcctcttccttttcccctccatctctagcatcatgtgattgtaatcagtaatattattttcttagaatttgtttgtactgtctaatatgcccaatttggttttactgaagtcctttggctgagagttatttggagtgaggcagtaattcagaagtgctctctatctcatattctgtgttttgatcattgtaaaatgtccactttgtcaggcagacaccatttcacctctgttgaggccacatggtcccccacagtcatttctatcttagtctcgcagttaaggacacttaatatttacttttggttcttggccctgggttctccaagcaccttttgatggctggtggtcttcctctagtagtttcatcatgagattatggattatagaatgtttggaactccttttcagcagccttttttcttcaagaacagttggctgtatatagactctggactatccactacttctttcccccttaaggaccctacaggttttgtcctaccatttactgatcttgaatgtggctggtgagaaatctaggactggtcatcatcccccttatagatgattgtgtgtgtgtttttttctttttttttttggatttagaattttttcaaatttgtgcccaaattagttctttctaaaattaattaccaaaagtaatagaacagaaagcatacttaaatctataatttcaaaaactctatcctgaaataaaacaagattgcccacgtattggtagggtgactgagagaaccagagaaaattggcttagaatggtggctcctgagatgcactggactccattctttcttaggtactcggattatgtggatgtcgtctcttctttgcctgtcttccatatctgtcacctctttttatatattttattttacagaatttttatgggtacatagaagatgtatatatttatggggtacattggatgttttgatctaggcgtgcaatgtgaaataatcacatcatggaaaatggggtatccatcctcttaagcattatcctttgtgttagaaacaatccaattatacacctttcattattaaaaatatacaactaaattactgactatagccaccttgctgtgctatcaagtagtaagtcttattcattctttctatttttttgtacccgttaaccactgccacctttccctatccccccaccaccgttctcagcatctggtaaccatccttttactctttatgaacatgggtgcaattgttttgatttttagatctcattaataagtaagaacattgtaatgtttgtctttctgtgcctggcttatttcacttcacataatgatctccagttccatccatgttgttgcaaatgactcaatctcattcctttttattattgaataatactccattgtgtatatgcaccacattttctttatacattcaactgctgatggacacttaggttgcttccaaatcttggctgttgtgaacagggctgcaacaaacatgggagtgcagatacctcttcatatactgacttcctttcttttgtagtatatacacagcagtgggattgctggatcctatggtagctttctttcagttttttgaggaactttcatgctgctctccacagtggttgtactaatttacaatcccagcaacagtgtatgggggctcccttttccccacatccttgccagcatttgttattgcctgtcttctggatatcagccattttaactggggtgagatgatagcacattttagttttagttttgattgattgtgtttctgtgataatccatgatgttgagcaccgttccatgtcggtttgccatctgtatgtcttattttaagaaatgtctattctaacatttttcccatttttaaatcagattattagatttttttttctatagcactgtttgagctccttatatattctgcatatattctggtttttaatcccttgccagatgggtatttttcaaatattttctcccattctgtgggttgtctcttcattttgttggttgtttcccttactgtgcagaagctttttaacttgatgtgatcccatttgtccatttttgctttggttgtctgtgcttgtgggatattactcaagaaatctttgcctggactgatgtcttggagagtttccgccaaggttgtcttgcagtggtttcatagtatgaggtcttagatttaagtccttaaacaattttgatttgatttttgtatatagtgagagagagaggggtctagtttcactgttatgtatatggatatccagttttccccacattatttattgaagagatatcattatctattccccagagtatgttcttggcaactttgtcaaaaatgaatttgctgtaggtgtgtggatttatttctgggtttttaaattttgttctgtttgtctctgtgtctgtttttatgctagtaccacgctgttttggttactatctatagctctgtagtagaatttgaagacaggcaatgtcattcctacagtttcgttctttttgcttaggagagctttggctattctgggtctttgtggttccacgtaaattttaggattttttttttctatttctgtgaatgatgtcattggtattttgataaggattgcattgaatctgtagattgctttggatagtatggacattataacaacactgattcttctaatccatgaacatgcaattgctttccattttttggtgtactcttcaatttctttcatcagtgttttatagttttcattacagaaatcttttacctctttggttaattcctaggtgtttatttgtggttattgtaaatagggttactttttaatttctttttcacattggtcattgttggcatatagaaatgctactgatttttgtatgttgattttgtatcctgcagctttactgaatttgttcgtcagttctaataactttttttggtggagtctttagttagctctaaatagaagatcataccatatgcaaatgaggataatttgacttattcctttccaatttggatgccttttatatctttctcttgtctgatcgctccagctaggacttccagtactatgttgaataacagtgatgaaagtgggcatctttgtcatgttccagatcgtagaggaaaggctctcagtttttcctcatttagtatcatactgtgggactgtcatatatggctttattatgttgaggtaagtttcttttgtacctagtatagaagagaatttttattatgaaggaatgttgaattttatcaaatgctttttcagtatcaattaaatgatcaaatggtttttgttgttcattctgttgatatgatgtatcacattgattgatttgcatatgttgaaccatctttgcatcccaagttagataaattccacttggtcatgatgagtgaactttctaatgtgtagttgaatttggtttgctagtattttgttgaggatttttgtgtcaatattcatcagacatattggcctgtagttttctttttttcatgtgtctttgtctagttttggtgtcaggttaatactggcctcgtataatgagttttgaagtattccttccacctctattttttggaatagtttgagtaggattggtattagttctactttaaatgtttggtagaattcagcagtgaagccgtcgggtcctgggcttctctttactgggaggctttttattacggctttgatctcattacttgttatcagtctgttcaggttttgaatttcttcttggtttaatcttgggaggttgtatgtgtctaggaatttctgcatttcttctagattttccaatttattggcatatagttgcttatagtagccactaatgatcctttgaatttctgtggtgtaagttgtaatgtcacctttttcatctctgattttatttatttggatcttctgtctttttttcttagtctggctaaaggtttgtcaattttgtttaacttttcaagaaaacaacctgttgttttattgatcttttgtattgttttcttcatttcaattttacttatttctgctctgacctttactgttttcttctactaattttggatttgatttcctcttgcttttctagttctttaagatgcattgttaggtttttttattgaagtttttcttcttttttaatgtaagcatttgtagctgtaaacttccctcttagtactgcttttgctgtatcccataggttttggtattttctgtttccatgatcattcgttccaagaaaaatttcagtttccttcttaattgcttcattgacccactcagcattcattaatttccatatatttatatagtttccaaaattcctcttgttattgatttctagttttagtccattgtggtcacagaagat

SEQ ID NO: 409 - DNA, 20001 bp, Homo sapiens
atgcttcaaaagaaaaaaaacaccattaagtacattatttaaaaatggcagagtaaggaactccaaggatcagttcctccactaaagcaaacattaagctggaagaaagtgtcaaaagaaacttttttggaacctgaaatctaatcaaaaccctttagcaaccagaaaaggctgctaattcttggtaagaaaatactgtagcatttttgcttacttgcctaccatctcacattcatcagcttagtcgtggctatgagtacagtagcctgcattcttggcatggcttgctggtaccagaaagaacaacacaagccttggtctcaaagaattgtgtttctacattttgatctgtttggcatctccctaaaggatccactcaggtgcttgcctttgttttgccctcccacttcccctgaactctaggctggagcagcttcccaggcaatgtctgttgacaaactttaaagacacacactacccatgtggggcaaaggatgacagacaaagcaaaaagcagagaccgaccaaaaagctggagaagaaaaagactaaggaggaatgtatatgggggaataagggctttgaaaagcttccgtgtataccagggaatctagaatataacacatatgcccagggctgaagtcatgcacagaaatgatatgagatgatcctaggcttgcacctctggctaattgggctctgcacaagcagaggtgaaggctaagacagaattgtagtctgcctggctaagtgtaaaggagtatcccagctcagagccaatttacaaagactaggggagtatcttttattttgtttttctttttggctgcaggtatataaggaaacctcttacagatcactgaccaactgctgagataacagaatggagatttcagtgaacatacacaaaaagggatatagtctttgcaaaaatagtttggaaaagtcactaagtaaatgaatggctgaagctcacagcaaatgacaaaagcaagccttgtggacaggggaagggagaatgtgatttctagaattatcacattgtaacattcaaaatgccaagtttccaacaaaaacctataacgtatacaaagaaacaggaacacccagcccattcacgggggaaaaatggatagaaaatgtccctaaaaaagtccagacattggagctgctagacaaagacattaaatcaattgtcttaaatatgctcaaaaagctaaaggaaaccatgagtgaagaactaagttaaaccagaactacgtgtgaacaagtagataatatcaataagagctagacattatttaaaataaccaaatagaaattttggacctgaaaaatataatagccaaaatgaaaaatttattagagagctccaacaccagatttgagtaggcagaagaaagaatcaataagcttgaagctaggtaaattgaaataatccagtctgaggagcataaagtaaaaaggaataaaaataaacagagcctgagagacctgtgagacaacagagcgagactccatctcaaaaaaaaaaaaaaggtataaacatatgcattatgtgaatcccagaaggaggagaaagaaaggaccagaaagaatatttgaataaaggccaaacatttccaaaatttgatgaaaggtatgagtatatacatccaagaagctcagtgaactccaactaggataaaaccaaaggaatctacaccaagacacattataatcaaactgttgaaagacaaagacaaatcgagaatctggagactagcaagagagaagtaacttgtcacatacaaggggtcctcaacaagattaatgaccaaagtctcatcagaagccacaaggccagaagacagaaggatgatatatttaaagtgctgaaggaaaaaaccctgccaactgagaattctttatctggcacaactatctttccaaaatgattaagaaattaaaacattcaaagattgcaaaaaaaaaaggtgaagtatttcatcactaggaggctttccctatgaaaaacactaaagggagtctttcaggctgagatgaaaggacactaggcagtaaatcaaagccatatgaataaatacagaacactagtaaaggtaaatataaaaactagtataattatatttttggcttatgactcctctttttgtttcctatattatttaaaagatacatacataaaaataattataaatctatgctaatgagcacatgccacataaagatgtagtttgtgataatgacaacaaaagagggggagggataggagtagaatagagtagagggagctgtataggagtagagtttttgtattgctatttaaaccaagttgttatcaattcatactatattgttataaatttcctgtgaagtgtaaacctcaaggtaaccactaagaaaataactaaaaatatacagaaaagaaatgaggaggctatcaaaatggtgcactagaagaaaatcaatcaatacaagagaaggaggtaatgagggaattgaataacaaaagaaaatttgatataaatgaaatgaatagcaaaatgcagtggtaagccttttatcatgaatcactttaaatgtaagtagattaaattcactgattagaagacagaatggattgacagaaggaattaaaaaacatgatccaactacatgctgtctacaagagactcactttatatccaaagacacaaataagttaaaagtgaaaggatggaaaaagatattctatgaaaatagaaaccaagagagagctgaggtggctatactaatgtcagataaaatgagtcttaagtaaaaaattgttacaagagacaaacaaggacattacatgttgataaatgtgttaatttgtcaagaagattggccaggtggtggctcatgcctgtcatcccagcactttgggaggccaagatgagtggatcacctgaggtcaggagtttgagaccagcctggccaacatggcgaaaccctgtctctactaaaaatacaaaaattagcagggcacggtggtgcacacctgtagtcccagctactcgagaggctgaggcaagagaattgcttgaacttgggaggcggaggttgcagtgagctgagattgcaccattgcactccagcctgtgtgacagagcaacactctgtctcaaaaaaaagaagacataataattatgaccatacatgtgctaaacatcagagcccaaaaatatatgaagcaaatattgacagaactgaatagaggaatagacagttctacaataatagttggagaccatctagacagaagactaagaaagtaggggacttgtacaactataaaccaaccagagctaatagacacacatagaacactccacccaacaataacagtgaccacaaagtgcacatggaacattctccaggactgactatatgttaagccacaaaacaagtcttgataaattttaaaagattgaaatcatatgaagtgtcttctctgatcacaatgaagttaggtatcaatagcagaaggaaaactggaaaatttacaattatgtggaaattaaatagcatatttttaaacagtcatcatgtcaatgaagaaatcacaaggaaattagaaaatacttagagacaaatgaaaatgaaagcaccaaaaacacacccagaattatgggatgtagcaaaagcagtgctaacagggaaatgtgtagccctacatgccttcattaaaaaaaaacaacaaataagatcacaaatcataacctaactttacttttaaaggaactaaaaaaagaaggacaaatgaaacccaaaggtagcagaaggaaggaaataataaagattagagtgcaaacaagcaaaataaagaatacaaaatcaatagagatgaaagaaaccaagagtcgtttcttcaaaaagattgacaaaattgacaagcctttagttggactaagcaaaagaaacaatacaaatcactaaaatcagaaatggaagtgggaatattactacaaatcatacagaaataaaaaggatcataagggagtactgtgaatgactgtatgccaacaaattagataataatagttgtcaacttaaatattaaagtttggtaacacaaactgccaaaactgactcaagaagaaatagaaaatcttaataaacatacaacaagtaaagagttgaatcaaaaacctcccaatgaagaaaagtccagagtcagatggctacactggtgaattccactaaacattggaagaagaattaacatcagttcttctcaaactcctccacaaaacaggagagaaatccagacaagagaaccacaagaaaacaaaactacagactaatattccttatgaatatagatataaaatttcacaaaaatacaagcaaactaattctacagcacattaaaaggattatacagtgtgaccaaaaaggatttatcccaggaatgcaagggtggttcaacataagaaaattaatcaatacaatacataacattaatagaataagaaaacccacacgatcatccaaattgatgcagaaaagcatttgacaaaatttaacaccctttcatgataaaaacactcagtaaagtaggaataagagagaactccctcaacatgataaagaccatatatgaaaaacctggctgggcacagtggctcatgcctgtaataccagcactttgggaggccgagacaggcagatcacctgagatcaggagttcgagaccagcctggccaacatggtgaaatgctgtctctactaaaaatacaaaaattagttggatgtggtggcacacacctgtaatcccagctacttgggaggctgaggcaggagaatcacttgaacccatgaggttgcaatgagctaagatcatgccactgcactccaacctgcaccagagtgagactccatctcaaataaaaaagagagagacagagaaagaaggaaagagagaaagaaagaaagagaaataaagaaagaaaaacccgcagctaacaagctaacatcacactaaatcagtgaaagactgaaaacttttccaccaagatcaggaaagaggatgcccactttcaccactggtattcaacattgcactgaaagttttaaccagaacaattcagcaagaaaaagaaataaaaggcattcaaatgggaaaaggaaagagtaaaaactactgttattcgcagatgacatgatcatatatatggaaaattctaaagaacgcacaaagaaattattagagctaataaattcagccaagtgacagggtataagatcaacatacaaaaataaattgtgtttgtatatactagcaataaacaaccccaaaaggaaattaaataaattctatttataatagcatcaaaaataataaaatacttaagaataaatttaaccaaggaggtgcaagatttgtacactgaacactataaaatattgctgaaaaaattagaaaagacctaaataaagttttttaaattctatgttaatgtaatggaagatttaacattgcactcctcaaagtaatttatagatttaatgcaattcctataaaagtcccaatggccttttttaaaaaatggaaaaactgatcctaaaaatcatgtgaaatttcaagggacccagaaaagccaaaacaataaagttggaggactcaaattcccatttttaaaatttactgcagagccaagattgtgccattgcattccagcctgggcaacaagagcgaaactctgtctcaaaacaacacaaaaacaaaaacaaaacaaaacaaaacttactgcagagctacagtaatcaaaacagtgtgataatcctggcacaaggctagacatatagatcaatggaattgaacttagagttcagaaataaacccatgaatctatagtcaattttttttcattttttttgcattaaagcacactatcaacaaagtgaaaagacagccacagaatgggaaaaatatttgtaattcatatatctgataaaggtgagtttccagaatatacaaagaactcttaaaattcaacaacaaatgatgaacaatcaaatttaaaaattggcaaggagctgggcacggtggcttatgcctgtaatcccagcactttgggagactgaggtgggcggatcacctgaggttaagggttcgagaccagcctggtcaacatggtgaaaacccgtctctactaaaaacacaaaaattagctggatatggtggcacacgtttgtaagcccagctactcgggaggccgaggcacaagaatcgcttgaacccaggaggtagaggtttcagtgagccaagatcacaccactgcactccagtgtgggagacagatcaagactctgtctaaaaaaaaaataaaataaataaaatttggcaagggacttcaatagacattactccaaacaagatatgcaaatgactaccaagcacatgaaaagatgcttaccatcattagccattagggaaatgcaaatcaaaaccacaatgagataccacttcacatccgctaggatggctataataaaaaccaacagaaaatacatattgtctgctgggtgcggtggctcacgcctgtaatcccagcactttgggaggccgaggcgggcgcatcacgaggtcaggagatcgagaccatcctggctaacacggtgaaaccccgtctctacaaaagaaaatacaaaaaattagccaggcgtggtggcaggcacctgtagtcccagctactcgggaagctgaggcaggagaatggcgtgaacccgggaggcggagcttgcagtgagccgagatcgcgccactgcactccagcctgggcgacagaccgagactccatctcaaaaaaaaaaaaaaaaagaaaaaaaaaaaaaagaaaatacatattgtcaaggacgtagagaaatgggaaccttcagacattgctggtgggaatataatacagggcagctgctgtgaaaaacagtttgtcagtttcttaataagttaaacttatttaaaagttaataagttaaactacctttaactcaacaagtctccttctgggtatatatccaaaagatttgaaaatgcatgtctacacaaagactcgcatgcaagtgttcatagcatgcttgtttgtagtaaaggaaaaagtggacatactccaaatgtccatcatctcatgaaaggataaatgaatgtggcatatctatgcaatgtaatattcttcagcaataaaaatcaatttttattttttatttttttgagatggagtttcgctctgtctcccaggctggagggcagtggcactagctctgctcactgcaacctccacttcccgtgttcaagcaattctcctgcctcagcctcctgagtagctagggctacaggtgcacgtcaccatacctaactaatttttgtatttttagtagaacagggtttcaccatgttggccaggctggtctcaatctcccggcgtgtgcaaccacaccaggctaattattgtattttttagtagaggcggggttttaccatgttgtccaagctggtctcgaactcctgatctcaagtgatccgcccaccttggcctcccaaagtgttgagattacaggcatgagccaccgcgcctggcctaaaaatggatttttagatatgtggtgccaacacacgctacaacgtggttgaaccccaaacacgcgatgctgaaagaaactaaacacaaaagacaacatattgatatgagatgcctaggaaaaaaaaaaagcaaaatcagtagaggcataaagtagacgagtggccctgggaatgggaatggagattgactataagcaggcacaaggaacctttcaggagtgatgggattgttttaaaattggatcgtggttataattgcacaattcgataaattcactaaaaatcattgaactgtacatttacagtggcttgattttatgttatgtaaaacatagctaaataaagctcttaaaataaaaataaaaaagaggaaatgggttgagggagggggtgtgtcaattattttttcccaggaggccccttggctgaaatgcaaatgtgaccacttcctccccgctgaccagctatcagcactgaggcatggttggagggccgctgagatcctatggcaccttccttccaagggtatagaggccatacttatgagacatttacagacccagaggaacccctcaagggaccacatgtctatttctgaggggactcatgtttaccccagtggacatgggcctggcagctccaaatgcatctactttttaagcaccaagggactgtgacccctgctgatcccacccattccccaactcctggcctgaactgaaaatgtaaactggattaagccactcttaagatgaaaccctccaatgatgacttcccatttcctttggaacaatctaccttcctcacccaaaaccgtgaggtcccatgtggtgtagatgtgtgatttccgtgccttcaccttctactattcctccatttgctcactgtattacgccatgctgttctcaagttcctggagccagccacattctttcctacctcagtgcctttgcacttgcagatccttctgccgataatgttcttcccatggctgggcacttcttagcacctagtgtacccccaaatgtcacaaccttgatctctcattggttttctatgacatttagtacagtttacattgagtttgtctgttacttctttttgtctaactctccctactagaatataggctccatgggggctgtcactgtgtgtatatttctgtgggctagccccaggatgtagccaagctgcgtgattttggacaagtcacttaacctctctgagcctgctcaataaatattagggggaggaagcaaggaatggctgggtgggtgggtgcagagaagaatgaatgggtggataggtaggtgggtgggtagaaagcaggtagataaagaaggcaggcaggagggagggaggagaaattgaatatccttgttttcatacacaccccagagcagtgtagtgagttaagagtgcgggctctggagcccaaatgactgagttcaaatcccaactctggcactcatcagctgtgtgaccttggacaagtcacttaacctctctgagcctcagtttcctcatctgtaaaacagggacgatgatgatgatgatgataactatcttctagactcattctttttcattttggggattttatttttgaagacagagtcttgctctgttgcccaggcttgagtgcagcactacagtcatagctcactgcagccttcagctccttggctcaagtggtcctcccacctcagcctccagagtagctgggactacaggcgtgcaccaccatgactgtctaatttttaaatttttttatagagacagggtcttgctatgttgcccagactggtcttgaactcctagcctcaatcgatcctcccacctcagcctcccaaaatgatggaattataggtgtgcaccgctgcacacagccttctcgagtatttctgaggtttaaatgagagggtgcatctttaaagtccttaaaaccctggcacacaatgagctttcagcaaatattagctctttttactgtctcttctcctgatctttcaaccactacaaatttcagtgcatgttatcagagaattcaccccgaagatcaagagaaagaaaaacaaaagctggtgtcttcccaaggttcgttctccagagaacacgacacacttcggtagctgggaagagctctacagggccaggatccctcaaatcaaccacaggggaatttgtaccaagttcctcaaaaacagctagaaaaaaaaagaaagaaagaatagcaagacgctttctcttttttctctggagtggtcacgaaagtcaacagcaagttgattcccaaaaatgagtcagcagggagagctacaaattgcatcttgttatcaaaacagcataaaatagcctcccccaactgtgggacatttcatcctggtatggccccgttttcacagcctggtataagcttaggaatcaaacacacccaggttcaaatcccagctctaattcttcttggcttgtgtgacgtttcactcctctgggcctcagtctctccatctgtaaaatgggactaatcttgtctgcctcacactttgtgggataaagtgagatcatgtaggcaccaaagtaattcgaggtggtggtgatggcagtggtagtggtggtggtggtagcggtggtggtggtagcaattctcttgctctcctttggagactgcactaggcattaagcttgttacattttgtctcctggtttcttgaatgtcttccagaaacatctgaccctctcatgggcctctggcatgttagcaagatgaaaactctcttgagaatttcttttctctattttcttcttgaattctcatgtgttaatgtctgccctcttcctcatagctaggtgcccccatttgacagatgggcaaagtgaggcattcagagaggtgatgtgacgtgcccaaggggtcctgctccctggagctctgcagcaggagactggatccaaaggaaatggaggcagagaggcatgggggtcaagccagagcagagggtcccaagctcagaccctattaggcaggtaaggctcaggaataagaaacaggctggtttgcaaagtctgaaaaaggggcttccgtgggaccttgggcaaggttctggtccttctctctgtgctgaggggctggagtcggccactgaggactctgggtccacgggtgaaactgtgccacatcttcacacctctggcctcagtttccatatctgtgcaatgtggtggctccaggaggcactgcctgcctcatgggttatgactgagaggcctgtggggatgatgtcacaggtccctaagagggaagtgtcaccccgatggccccaaatgtcttacttgcaggtgacctttggtgacagtgggtgcctgctgtggggccaggccccctcccacctctttctcactccctcccaggaggagcccagctgcgggtgggcggggctggcggggagcggctcaccacatcctcctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccagctgcccgtcatcagagtgacaggtcttatgacagcctgattggtgactcgggctgggtgtggattctcaccccaggcctctgcctgctttctcagaccctcatctgtcacccccacgctgaacccagctgccacccccagaagcccatcagactgcccccagcacacggaatggatttctgagaaagaagccgaaacagaaggtaattccagccctggttttctgctgggaccagggtgccttctctgcccaggagggactgttccctgcctgctgcatctagtgtcacagtgggagggctcggaggactgtgcccaagtcacaattggggacactgaggcaaagaagattcatgcagtgaggctgggcagaaatgaggttggggtctcttgttcagcacagcttaggggcccagcagcagggatgtggctgagacgaccctctatcttgaaaaccagcctccaaaatgtagcgggctggggaaggaaagccagtttcaagccaaacataacatgtcaatcacccgattctgggcggctgagtcgggaggtgacgggcatgggtgtagagcctgatgggacccattctgtgtcagtttctatgtcttaccaccttgattccacccagtcattcaaaacaatggctggtgtgcccatttcgcagatgaggcaatgaggctgcgagaggtagagtgattttccctcggtgactcaactgggacgtagcaggtcgggcagtcaagccaggtgaccccatgagctgtcgctgcatctttctcatgaagcacggggaacgggtcggatggtaagaggccaacccagttccctgtgcatgtggaggagaggagggtggggaggtcagtggaggctgagccttgaaggatgggaaaggaagaacattcctggtggaggagccctggggagcgggaacttaggacttgccgcaggaatgacgtctctgctcagtgaaggcagaagaccaggtgcgggacattcaaagccaggaggctgctgcgaggaggacatctgtgattccctggggggagagtggggctttcagaagcacatggtggagtcggggaaaacctgccaggtcaaaacccggccacgcgccttcctcactcggtgaacttgggcaagtctctctgcttctagccttgagaagccatggttttctcatctatgaaatggggaccaaggtacccccatcctggtggagctagttgtggggacctcagggccgaacagggtgaaagctgtgctcctaatggcccttttcctttgaggaagagagtttgtggcatgagaagctttgagcccatggagacgggcccgactccaagagtgacagagggggagcgacacactcaggctgctgtggtcctgcctggccagccacctggctctggcccccccagtgccaactcaccatgttgtaggcacttaagcgtctcccatagtcctcaacaggtgaagcgggcagcctcattcagcccatttcacagatgacaagagtgaggcttagtggggacaaccttgccccaggttaactgtgaccagatgacatggagctgggattggatgccagtctgtaggacaaggccaccacctgctagatagaataacatgaaaacaagactcatgggcttgggtagcttctgggaagcagcattggatggggatggcggagtattcattcccacgaggacaggcaacccccagaggagaggccctgctcacctgctccccaccgtgggctcagcgatgcccctgtcctgcccgctcctctgccaggagggtgtccggatccttactcagtcccacagtggaggtagctaaaagcccttgtgataggaggaggcagaatccaggaccaggagaggtggggagagcaaggcaaagacagctctgagctcagactgcaggctcccactgcccagcgttcctggtttcaggctaggagaagaaactgggaggtggggattagagccagtaaggggcttgtgggcagtagagtagggggtggataccagaggaggaggcccattcaagagaaagccagccaccagaagttctgggaggaacccacctctttgtagcatcaggacaacccaggtgcctgataaataaatgaatgaaaggaacggggtatccgttccttccacagccagagagggaagctagcgccttcagcatcctcacaggcaggcacaggggccttctccacacaactaggaaggggtgcctgcggttagatgggggaactggaactggcttcccagcacaccaccccttgtgactttgagctgtggaactggccagacctgggttcaagtccaccgcttagtacctgtgtgaccttgaggaagccacctaacctttctgcagctcagttgctgcatctgtaagagtggaaataggaataagaatgcctgtcttaggtctgtggtgaggatttactcaacctattcttcatggaacatctaccatggcccaggcacctccctaggtcctgaagctctggggtacacagagagagccagtgtgatggggaaggcaaaagagctgggcacagatggctcatgagaagtgcccgctatcatgttttacttttttttttttttaatttttttttgagacagagtcttgctctgttgcccaggctggagtgcggtggcgcaatctcaactcactgcaaccttcatctcccaggttcaagcgattctcctgcctcagcctcccgagtagctgggactacaggcacctgccaccacacctggctaatttttgtatttttagtggaggcggggtttcaccatgttggccaggctggtcttgaactcctgggctcaagtgatctgcctgtctcagtctcccaaagtgctgggattatagacatgagccaccgtgaccggcctatgttttactttaaatatgtaagagctctttgcttttagctatgaaaatacagaaaaaaaataataaatattattggtcatattggcatatatgagacctcagtaaataagagctcttatgatgattctgcttccccccttttacagatggggaaactgaagttcagagcagggtgggggtttttctagggtcactcagggaaccgtctagaagggagcagtgaaaagaggggaacagatgcttcctccaggaagagggtcttcttgccctcgcagccccttcctcacatgccctccttccctgccctccggagcccccggacacgtgaaggggagggagagggggcaatgggaggaacccacccccacccctggctcacaggtgccaccgcccccactccctgccctggccccaggccaaagggacttttcatgacagctcaaatgagacctctgagtaaacttggaacttctgaaacgacctgagaatattccccaggctggggggcaggggccacaaggagggcccccgactgcccaggacatctgcatcaggaacccagcctgctgatctctgcagcccacaggaaggatctggccaccccgacccctgccctgaattgtccccggggagttggggcaagtgcaccagcccgggtcctagcccaggcccctgccatcccccactgtgtgaacaggacaaggccctgggcctctctgggcctcctttccccatctgccaagcgggcttgactaggacgagggcttgccaactttccccagaatgaatcagtaacaccagtccactttggccagggccagggcgggctgatgggggctgctgggaactgaggggagagagacggtgggtggccagctccgctccatctcgtggcatagttcaaagcctcctttcactgctctacaagcggcccctcctgggctggaggaaatggagctggagtgagatctggctgcagaggctgagagattgcaaggtttgggcaaggctgcagaggatggcagggcttgcagggagatagagattgcacaggcagcgggggtggggagtggggggtgcgggtgctgggactgggacctcatgctccacagctaggagaggttgcacaggctggaagaagtgccaggagggaaagattgctggagctaatagagatttgctgcctggctaggagagagagataggctgagaggtcgcacagcctcagaggttgcacgagctggggaggagaaggcccttcctctcaccttcgtcttctactgattaactgtaagcctgaggtccccaacatacctgccttcagacacccataacccaccccttgccactggcgaaaaaaaaaaagatgaaaagcaactaacactaaccacacacctaatactaaccacactaacctgcctcacactccgcatccaggctaagcctgctgcccccattccacagatgaggaaagctgaggctcaaagaaaggcagagatacggccaagttcccactgtgagtgaatggcagagtctgctttctgacccagggccactgggctagttcttccccagcctgagaacccactgagatgagaacttgctgtgtgaccctgggcagcccactgtccttctctgaaagttccttgttactaatctgatgacattagtcatgattattcacactctggaagcagaagatgttgcctgaggtgggtctggggggagtttctggggacagtgaggaagctaatgaggaaagcaggacctcttaggggctgtctccatttttagcctcattcattcattcacttaacattcttcttcagctacttatggggcacctacaggtccccttctctgcactagggatactgtgctgaacaaaataggtcaattacccagcctctgagagctcatgcttcagtacagaaacaagttacaaacacatacacagagacatttacaaaacgattcctcatcttacacctgctatgaaggagacaaactaggggatgtgggctacagagatctgtggcgtagacccagttcagatagggttgcctctttgaagaggcaacactgaacttgaaacctgaggatgagaaaggaaagaagctgggggaaaagcattctaggcagagggaaaggcatgtccaaaggccctgatgcaggaaaaaaagattgaagcattaaagcttttatcctcggccaggtgcggtggctcatgcctgtaatcccagtattttgggaggccaaggagggtggatcacctgaggtcaggagtttgagatcagcctgaccaacatggtgaaaccctgtctctactaaaaatacaaagttagccaagcttggtagcccatgcctgtaatcccagctacttgggaggctgaggcaggagactcacttgaacccgggaggcggaggttgcagtgagccaagatcgtgccactgcactccagcatgggcaacagagcaagactccatctcaaaaacaaaacaaaacaaacaacaacaaaaaacgtatcctcaccaaatacataaggctctcaatcccctaaagctccagaaaaatgggtcaaaaagggtaagatttaactttggagtgtacggtctacataggtcttaacattgaggataatgtttgttcacaattcgtttccatagaaagcattctctttcatttagtcactcatgtagcaaatgttttgagcacccactgtaggcactggttagttactggggattcagcagtaacaaagaaacacactgtccctgcctagatggtgcccagaatatagatgaaaacaccatgagctatgtactatgtggagggtggaccccagaggaaggagtgactcatgctctttggagaggtcaaagattgacagaggagctgccatttgaatgggattttgaagactgagtaggaggctaacagtcagtcaaaaagggcagatagtttccgtggctaaaacagcacatgcacaggtgtgcaagccaggtgaatggagcatgttggtgaggctgtcagtggtctgatgagcctgaagtccagtatgaatactgggggctagatcccgaaatgccttgaataccagacaaggaatttggggtttttcttttgtggataacagagagccatggaatgacacggttggagtaagaatggagttggaggaaccacagctctgtagctatagcaggaaggtcagagaggaggaccagcaggagagcaggtgggcagaagtccttgaagaccctggataactttaggagttctttcttctgtgttccctctcgggaagtccctccgccttaacacttcctcttctggtgacctgttggctcctgttcctggcacttctggggagtccctcttcgcccacctcatttctttgtgatccctataggaaatagggccattttacttttaccacactacccacctttcactttcagccccatgtccctacctgggtcacattgcagagaatggccgacttgaggaactagacgcatcccattcctcaatcgtgtgacagaaaaaagatacagggaaaccaagaacttgggttctttccagtgtggggaggttgtaaataatggctgctatgaacatgctggtacatgtctgcttgggcacatatgcttgcatttctctttggttatataacttggaagtggaaatgttgagtctctgctcagcagaagttttccaaagtggttgtgtcgatttacactcttaccagaatattgagtagagacagagagtttagttactctgtatccttttcagcacttggaattgtgtttatttctctctctctccatatatatatttataaaaataaattatatatgtttattatatataatttatattttataaatatatataatatttataaataaatatttttatatttatattttattataaatttacatatatatataattctttccctcttcctctttcagtttcttttccattctcttaatggaaacttttgatcaataaaaaatcttaattttcatgaagtttatttataaatctttctttatgaccagaactttctatgtgctgtttaagaagtgttgcctgcaataaagtgataaaaatattattctgtgttttcttctagacgatttactgttttacctttcacatttaggtctacagtctatctgtagtttatttttctgtatggtgtaaggtaggggtcaaggtttactttttccatatgaatattcaattaatataccatcatttaagaaaacatgttttctctccactgccttgcactggtgacttactgaaaatcaagtggttgaatacatgagtttatttctactgtttctgttcttttccattggttagtttgtttttccttgcaacaatgccatactttctaaattactttataaatcttgacattcttcttcaaaattgtctaaactattttcagtcctttgtatttctatataaattttagaactatcttgtcaatttccaccaaagaaaatcttgctggagatttttttcttgaaactttggattttactgaaactttacttcaatttgggggggactagcatccttaaagtattaaattttccaatccatgaacatagtatgtaccaccacttatttatgttttctctaatttttcttagtaatgtcttgtaggtttctgtgtagaagtcttgtacatcaactaggtgcagtggctgacacctgtaatcccagcactttgggaggccaaggtgggtggatcttttgaggtcaggagttcgagaccagcctggccaatgtggtgaaaccctgtctccactaaaaatacaaaaattagctgagtgtggtggtgcatgcttgtaatcccagctactcaggaggctgaggcagaattgcttgaacccaggaggcggaggttgcagtgagcagagactgtgcctctagtgacagagctgagtgacagagcaagactccatctcaaaaaaaaaaaaaaagtcttgtacatctttcattagatttcttctcggatatttgattttttgatgctgatgtaaatggcataattttaaaatttcttgactgtttgtagtgtacagaaatataatgagtttttatactttacaactttattaacactttttaaagctaaagttccagatgttaaaagaaatagctatcaaacccagcccacttcaactgaccaccagttgagggcttcctgcctttctttgcttttgtaatgtttatggatcctttcctttgctaatctaacaagagagggtattgtagtgcaaagtatagtgtcccgggtttggattttattaaccagtagatcttttttacccttaacaatttttagatgtgcagtacaatattgtaaactgtatgcacattggtttacaagagatctctagaactttttcctattgcatgggtgaaactctatacccattgaaaaacaacttttcatttctccctcccccagtccctggcaatcagcattccactttctgtttctatgagattgattactttacatacatcatataagtgatacaatgcagtatttgtttttttgcaattggtttatttcactttgcagaatgtcctcaagaagcatccatgtcgtaacatatgacaggacttcctcctttttaaagtctgaataatattccattatgtatgtactacattttctttatccattcacctatcaataaatttaggttacttgctcatc

SEQ ID NO: 410 - DNA, 91631 bp, Homo sapiens
ctgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagaggagaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctattcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcaacgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttgtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcaattggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagacagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctaactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttggcctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaacacatgaaggttatattattatgtcgactttccagatgaggagactgaggctcagtggcttgtcataggtgtcaaagacaggagtccaatgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttctttttttttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgttttttttcacttttgtcttcctgacttttttcttccatccctatttatgaaaacaaaaagataactaaattgaaacctgacaatgtaatttgtcagaggaaggcagcctgttttataagctcaggtgatttcatttttgttcacctgtttatttcatgacacttgcaggaaaaagaagaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgcctttttttttataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttcctgggagaaggtcagagctggagtggggcactcgattccggcaagagaaggcaaacaaaagaagccacaacagtctaggaagaaatctttaatttctattcagctttaaagagtttgagagagttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttaaaaaagacatacctttgtaactttctatgctaaggtgttgcataatcaaggttaatttttgtttgtttctagtctattggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagttggaaaatttcagtgacatgccatcagatttgttccatgtagaaggacgacactatcagttagatgcttattttgttggcaaatttctatggcacttctgcttggctatttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataatagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgagagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgtaaacaggaaaggccacaggacagctcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtccctagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcatgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacatgcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagagctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttcgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtagacggccatctattccacctgtgacatgagggctcaccccctcatctccaccgcagcagctctctgataaatgtagctctctgataaatgattctgttcctagtggtgtattcacagagtcaatggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgctttttttttctttaccatatattgtttatcagaaacctctgtaccctttcctttaaaggagtcaatatgcatttgtattctgtgctgacaactataaattgatggctagcagttatcaaatgaatgttgatgaaaagcagctacttaacattttcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattcttctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctctttcatcttttctgcattatgaactgatgccccaaaaggtggtatgaatgaaagtcatctgatggtgattaaagtgctctttaaattttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtatgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaacaaacccaagtctgccttatggcagattcttcacgtcgtaacaccttccttgggaccctatttctcagtatggacctgactctcccagggatcctagaatgcaagcatagtgattgcaaaccagaccatttgagggaaactcctccagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccgcaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagttgaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcgaaatgacgccatctcatcactccttttcttaaaatttttttttgtctttcttcttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatcatcacctgaagtttgtattgtttctttaaatgtttgtttcagtttgtttttgtttttcattttttagaaaagaaatctagaggaaaaataaagcgcttctaataaagcgcttctcgtagatgccaggaaaacacgattcttgtttcttctctgagtgagtttgtgttttgtttttgtgctttgtggctgtccgtgggccaagttgtctcacgcgattagcatgccagcatattttctgttaaagaaagaaaaaagaaaaatgactattgtttcatttcaccttaagatgttttgttattacttacttacagtgagttattttagtcctcaatggtctgctcccctgcaattagcaagtacttagtgattagcgggtatctctatgtttgagaatgggagctgtgcagaagctcttatctgcgcatcccatctcatggacaccatgatttccagcccgttccagcaagcacatgagaaagtccactctggcaagacggagaaaatgcttctgctgaaataccaggaaggtgtggaggctgggtgtcattgttccccctcctgatcatggcagcttcaggccagacaatgtcttgaacttctgtgcctctgcatctgtggtgcagagcagtcgaacaaacaaacaccattgccctccagtggcccatagccttgccacatcctcccatctggctatagtcttccttacgtaatccttattatcacaggacctttgaaactatgaatcagataatgtcacttttcagacattattgtcatttgcaaaagcagccgtcagaactccactctcagaatctacacctggaggggatcacccctcccatatgacctctgactttggccatgtgactggccttggccaatttggaaagtgctttgcactggggcttgcctttccttgttgatctttggaaccctgcaacttccatcatagggaacggctcctgggctagcctgctggatgatgagagacacgtagtcactcccagaaccggcatccagcagttagttagttagacatgtaagtgaggccatcccagactatccagccccagctgtgccaattcagaggagaagaaactgcacatttcactcacagcaatgcaaaagatagtaaaagtttattttaagccactaagtttcaggattacatgttactcagcaaaagctaactgatacagcttctcagctcactaaggttaatttttttctaccctacttctcttataatttggtctccagctacctctctaatctcaacttccagcactttatccactagaagccactctagtcttcctctgttcctcgaacatgccaagcacactcccaactcaaggggtgcatatttgctgtttcctctgctgaaatgctttccttccagaaaccagcatgcctttcttcctcactgatttttagtctctgctcacgttatccctgtcttcatggtgtcaccccattcttattccccttcccctctattttttctccacaacacttaatattattgtacacattatgtgtctattttttctgtctacccactataagaaactccatgaaatttgtctgttttcttcacaacttggccacagtaccttgaactgctcctgtcacacagcaaacttactgacttaataaataaccactgaaagaatgattctgggtgactaggctttatgttcaggaaaataatttccatcattgtgacaatgatcccgagccacacactgtgctaagcaggctacattaccactgtcgcccgggctgcagtgcaatggcatgatctcagctcactgcaacctccacctcccaggttcacgcgattctcctgcctcagcctaccaaatagctgggattacaggtacacaccaccacacctggctaatttttcatattttaagtagagacggggtttcactatgttggccaggctggtcttgaactcctgaccttgtgatctgccctcctcagcctcccaaagtgctgggattacaggtgtgagccactgtgcctggctttttttttttttttttttttttttttgagacagaatctcactctgttgcccagtctagagtgcagtggcgtgattttggctcactgcaacctccctccccggttcaagcgattctcctgccccatccttcagagtagctgggattacaggtgcccacaaccacacctggctaatctttgtattttcagtcgagatgggtttgaccatgttggccaggctggtctcgaactcctgacctcaggtgatccacccacctcagccccccaaagtgctgggattacaggtgtgagctaccatgcttggctattacatctgatttctaatatgactacagtcttgccagttcaccccttctccccattttactgatgaaaaagctgaggccaagaagtgtcaatctgctgttgtccatacagctcataaattgatagagctgcagttcacacccaggagtgtttgatttcaaggtcatgcagattgcctgcaccagtgccactgctccttccataagttgactatatccattctggtaggatgcaccatcttttttccttttaaacagagatggggtcttgctatgttgaccaggctagtctggaactcctggccttaagcaatcctcccattacaggcatgaaccactgtgcctggccatggatgcaccatcttaaaatcttaggctgatcagagaggtgactttatgggtctgactctagttatgcttcaagcatttggtggaagtgaaagtaaagccacgagaaagaagatattggcgtatcatcagccaaggtgctgtgcaaaatgtcaaagagaaccaagagaggacatgctggcctcctgcttcctggccgtgtctagggcctctatgctgacttcctcctctgtggatcctgcagggttcacatctgcaggctgacaacatgaggcctcggggaactttgtaagggtagctgaggattctcccaaatcaagatttccaagtcatatagaccaaggcttcatacattcattcatttaacaaacataccaagtgctacatcctggaaattcaaggtttaaagtaaacccctccacagcctctgctataaaggaatttacatcttgggtctgtaggagtcctcacaaagcacaacgtcctactccactttatcagaagttatctacgttacttgaagatgaactgaggccccgtaacagtagcgattgccccctcatgcccatttctccctgaacccactcagtcagacactgtcagtccccatgggccattttctcttgccagacacatcaatcttatttccttggctatttctgtgataaattcttgacaggtgagcaagtgcatggcataattcctattattcctattttagcttattctatggccaaccctatttctccccatttgtcatatgtgcacatctgtatatgtatatgtcatgcacatctgtatatgtatgtcgtgcacgtgtatatgtatatatgtcgtgcacatctgtatatgtatacgtgtcatgtgcacatctatatgtgtatatgtacatgtatgcatgcacaaatatgtgtgccatacatgtaaaacacaggcattatagatgtataacacatatatgtggcacatgtgcatatgcacatatatgtattgcatatatatgtgtatattcacatatatgtatacagatgatccctaactcatgatggtttgacttatgatttttgaactttacgatgatgtaaaagtgatattcagtagaaactgtgcttagagtacccatatgactattgtttcttcctttcagtatagcattcaataaattacatgagacattcaaccctctaataaatcaggctaagtgttaaatggttgtgttaaatgcctttgtccaactctaggtaaacttaagttttctgaacacattaaaggtaggctgggctatgctatgatgttcaatacattaggtgtattaaatgcatttttgacttatattttcaacttactatgggtttagacggtaaccccatagtaagttgaggagcctctgtgtacatatatgtgtgtatttgtagtatatgatttatgtaataatgatcctactctatctgctacttttttttttttttttgagatggagtctcgctctgtcacccaggctggagtgcagcggcacgatctttgctcactgccacagccacctccggggttcaagagattctcctgcctcagcctcctgaatagctggaattacaggcacccgccaccatgcctggctaatttttgtgtttttagtagagatagggttttgccatgttggccaggctggtctcgaactcctgccctaaagtgatccaactgcctcagcctcccagagtgctgggattacaggcatgagccatcgcacccggtgtcatctgctacttctaatttcagatgctatttactgagcatactctgtgccagttgatgggttaggcaaatcactttatgctcataggatgaaagtgagttttagagagaaagtaacctctccacagtctcatagctggtagacagcagagtcaggatgtgaagccagctccatctgccttgaagcccatgggccttccactacacactacttttatgtgtggcctatagactagaagcatatatacattacattcatacaatgggtgaattatctgcaagggaagaccagttgatttcctatttaagaatgagctctggctcttctcctgataccgaaatgtccagtataaaccttacaaatcatttttgtacatgccatttatccagcaatattggcttcagccttgcctacatttctcaataggccctctctcctgttctgactgtaagttggtctgcaccttctcatggactcaacatcccgagttcttcgcgctcatctgatgctacagaatccacccaaacaggaagagtaggccagtttctctgcagtcgttttcttccaagtccctctctctccctaagtttctttcaactccaaaggtggccagtttccactttcacacctgattaagggagaccttgctgcaacttatcaataggaaacaagaaattgaagcattccccagcaatgactgaaggctgtggcttgtggttttgctttttaaaatggggttatgagtggttttgttttgaactccagtgaaggaggcctgatgacgttcatcaaggtcaacactaggccagaaagacttggcttgcaatatcactgcccattctgttcaccagcaggcaccatttttagaagcttatgtaaaaaaaaaaaaaaaaaaaaaaaaaaaaaaaaaaaaaatctaaaatagcaataccctgtctattaactctttgtgtctttcaatatatccaagctagtttagctgaggtcactttagaatactaagtaatatcacaaattattattcatataatcactgaacaaacagctctgagttgtatctatagatgttatgttattgcctttcaaggattcatggtatttggcttcatgccccccctttttttcccttcccccctcaaagtcatcttatttctcaaagttttccattattttaatggctacctcatatatcacataggtgatgggccattatttggaaacccattcccctactgtgggacatttaggttatttctagtttctgttagaactaatggttcaattagcatctttatgcatacagctttttccttctatcaattgatctcctcagcatacctttgtagagcgtagaactggagttccttgatccaacagctcctactggcctttgccacagagagccacaatgctatctggaagggttacacaggcagaaccagcatattactgtttgtttacaaccttatcaacacagggtgttcccactgataacattttaaactgattttcacattgtcacaacctgtaactatttatatatggtattcccaagcagccagcctccttatttaaagtataagcattctgtctttcattttcccacaggacagagttcacatgtttaattagagtggaaattcaaagtgagtctacattcagtttgggcagaaaaataccagtccatccaagctactgcactgttactagattattgcaccagtgaagagcctaccttttttccttttcaatctccagttgtagcactacacagattccatctgaatgcagtgcaaagcccaaaactcacaccccaagcctctgtggttcatactggcttaggtatttaccccactagccaggattccttagctggttacttcttcccagctgatgcaccgtctgcttttataaacatgtgccacaccacttagaaagaagtgtcttgcctctaagctgatctgtttacaaggccatgccctgctgcatcttaggcgtgagagaataaaagctccttttaattttcaaaacagagttacgcaaatagaggctctccatggctcattcagatgagggaggctctgtgtcttcttccggctttcctgattttatctgatgttcaccaagagcttgtcctgttactttggaattgtgacaatgtctcatctgatgctgggcattccctgagggacagtccatttttataaagcaccatttcccgagtgcttaccaaaacgcctatctgaaattctgtctttgttcatttaagactcacagcttttgtacaaaaaattagccaggcaaggtggcgggcgcctgtagtcccagctactccggaggctgaggcaggagaatggcgtgaacccggggggcggagcctaaagtgagcggacatcgcgccactgcactccagcctgggcgacagcgagactctgcctcaaaaaaaaaaaaaaaaaaaaaaaaaaaagactcacagcttttgaagtgaatgttactgtccccttttcaccaatgagcaaaccatttgaatcgtggggtcaccacttcctgtgtgacgctgtgccaccattgtacgtctccactccaaggccatttgtctctgaccccgttccctactgtcactctgcgtctgtgatctcctgtacctcagacttcattcctaccgtgctttattttcaatgtaggacttgtttaggcttctctaagctgaacaagtgggaattccattggtaatttacctgaatgtggctttatgtttatatcctttcaatatgatttgtgatattggttatataaaaagttgtatcatcgtatttaaatagagttaatcttggaaataactggtaactaatgttctgttaaacaaaatgtactgctgtttttattaaaaaattaaaattctttgggatgccaaggtgggcagatcacctgaggtcaggagttcaagaccagcctagccaacatggtggaaccctgtctctactaaaaatacaaaaattagccgggtgtggtggtgggcacctgtagtcccagttactcgggaggctgaggcaggagaattgcttgagcccaggaggtggaagctgctgtgagctcagatggtgccaatgcactccagcctgggcaacagagtgagactccatctcaaaaaaaaaaaaaaaaaaagttaaagttaaaatgcatgcccagcatttaagtttggggggcaggatcagaaaaacacatgtgcccatagtcccaccactcaaaagaaccaactagtgtaaatactgtggtacattttttatgcattagaaaatttgcatgtatcttgtagttttcattttatatagttgtgattatattccatatacaccttgatatatttcaaactaagtaaattattttaaaataatttaatgcctttatgatcctgtatctagcgaacagatagatatatggtagttacttaatcatttttttattcttggagagttaaaatttctaccctttaccaccaccatgtttcattaatataaatcgtggtttagtaaatatatttgtgtaagatttgggggaactctttattttcttaacatcagttccaaggagaatgctggggtcaaacaacatgaaaatatttaaggctctgggtagttactggcaagatactttttctgtgctgcctacacagatggcttttatctctgctgctggttttctttgagaagagtaggtatgtttcacccaggtggatatgctgctgatcagtttattttccccagatgacctgcctgtctggcatgcagcactgttaaccttaccgggagatgccattaaagttcctgggtatgcaactctctttcccgtctggaaccaagacagaagaggacaggagcattgtgtcagcgaaataaaaaaaggctgaatgcggaaagcagaaagaaacaagctaaactttgggtcagctcgttttgccagccttttgatagtgttcattgttctgctgcttcagaacctactgagaaagttcgaagactttcttgactgcgttgggaaatgttcagaattctttgcctggtttgctaagacagagcttgcccttaaacttggttccggggaattttacctggtgtggcctagatttgaaggactttatgatgaagtacttggctttgtgctcttcttattattggctgccttcaaacccactttagggagagaggctgagcagatcctccctgggaaaaaattcagtcatgttaccgttttctgaacaagaatccagaaccttccagaagcctgtgtaaatcactctatgtgttcccaaagcattcacagctcagcactttcaaaatataggagcagaagacatgaaaaaaatgaacactcatacatctatatctcatgttcaatctgaatagcaaatattaatagtaaaaaccactgtttaaagtattaaaatcactatgatccttattaataatacaaaacagagcttcttaatccagaaattcaaattctagcagttaatcctaaaacaaggcaatcttcatcatctggacagctgataagagtgtatgtgattatgtgtgtgtacatgtgcatgagtgtatgtgattgtgtatgtgtgtgtgtgcacgtgtgtacgtatacgtgattgtgtgtgtatgtgtgtgtgtgcatgtatgtgtagatatcaggagtttcagaattcaaaaaccgcatgaacagactaatagatctgtgaagttctgttattaaaaacaatttaattatgtttaaccctaatcctttgaacacaggccactgctttgtttttgtctttgattttttttcattagctatttgttaatacacttccctgggacacagacagagaaacgtttttcttaaagcagtaaaaataatatcatgagaaaccggagatcaatttaaatgtctaacagttggggcgaagctctctgactaccatgaaataacgttgtgggagaaatttaatagaaatgatgtttaagactaacagcagatctctcggcagaaaccctaaaagccagaagacctacaagccagaagagaaagggggccaattttcaacattattaaagaaaagaattttcaacccaggatttcatatccagccaaactgagtttcataagcgaaggagaaataaaattctttacagacaagcaaattctgagcgattttatcaccaccaggcctgtcttacaagagctcctgaagaaagcactaaacatggaaaggaacaactgataccagccactgcaaaaagataccaaattgtaaagaccatcaacactatgaagaaactgcatcaactaatgggcaaagtaactagctagcatcataatgacaggatcaaattcacacataacaaccctaaaacttaaagtataataataaaaaaaagaaaacaatattaaccttcaatacaaatggactaaatgctccaattaaaagacacagactggcaaattagataaagagtcaagacccatcctgtgctgtattcaggaaacccatctcacgtgcagagacacaaataggctcaaaataaagagatacaggaagatttaccaagcaagtgggaagaaaaaaaagcagggttgcaatcctagtctctgataaaacagtttaaaccaacaagatcaaaagagacaaagaagggcattacataatggtaaagggatcaatgcaacaagaactaactatcctaaatatatatgcacccaataccggagcacccaaactcataaagcaagttcttaaagacctacaaagaaacttagactaccacacagtaatagtgggagacttcaacactccactgtcaatattagacatatcgacgagacagaaaattaacaaggatatccaggacttgaactcagctctggaccaagcagatctaatagacatttacagaactctccaccgcaaatcaacaaaatatacattcttctcagcaccacattgcacttattgtaaaattgaccacataattggaagtaaaacactactcagcaaatgcaaaagaacggacaacataacagtctctcagaccacagtgcaatcatattagaactcaggattaagaaactcactcaaaactgcacaactacatggaacctgaacaacctgctcctgaatgactactgggtaagtaacaaaatgaagacagaaataaagttctttcaaaccaatgagaacaaagacacaatgtagcagaatctctgggacacatttaaaccagtgtgtagagggaaatttatagcactaaatgcccacaagagaaagcaggaaagatctaaaatcgacactctaacatcacaattaaaagaactagagaagcaagagcaaataaattccaaagttagcaaaagacaagaaataactaagatcagagcagaactgaaggagatagagacacaaaaaacccttcaaaaaatcaatgaatccagaaactggtttttttgcaaagatcaacaaaatacaccactagccagattaataaagaagaaaagagggaagaattaaatagactcaataaaaaatgataaaggggatatcaccactgatctcacagaaatacaaactaccatcagagaatactataaacacctctgtgcaaataaactagaaaatctagaagaaatggataaattcctggacatatacaccctcccaagactcaaccaggaagaagtcaaatccctgaatagaccaataacaagttctgaaattgagggagtaattaatagcctaccacccaaaataagtccaggaccagagggattcaaagccaaattctaccaggagtacaaagaggagctggtaccataccttctgaaactattgcaaacaataggaaaagaaggaatcctccttaactcattttatgaggccagcatcatcctgataccaaaacctggcagagacacaacaaaaaaagaaaatttgaggccgatatccctgatgaacattgctgcgaaaatcctcaataaaatactggcaaaccgaatccagcagcacatcaaaaagcttatgcaccacgatcgagtcagttttatccctgggatgcaaggctggtttaacatatgcaaatcagtaaacgtaatccatcacataaacagaacggatgataaaaaccacatgattctcgcaatagatgcagaaaaggccttcaacaaaattcaacaacccttcatgctaaaactctcaataaactaggtattgatggaacgtatctcaaaataataagagctatttttgacacacccatagccaatatcatactgaatgggcaaaaactggaagcatgccttttgaaaacctgcacaagacaaggatgccctctctcactgctcctattccacatagtattggaagttctggccaggacaatcagacaagagaaagaaataaagggtattcaattaggaaaaaaggaagtcaaattgtctctgtttacagatgacatgattgcatatttagaaaaccctatcgtctcagcccaaaacctccttaagcagataagcaacttcagcaaagtctcaggatacaaaatccatgtgcaaaaatcacaagcatttctatacaccaataatagacaaacaagagagcaaaatcatgagtgaactcctattcacaattgctacaaagagaataaaatacctaggaacacaacttacaagggattatgaaagacctcttcaaggagaactacaaaccactgctcaaggaaataagagaggacacaaacaaatggataaacattgcatgctcatgggtaggaagaatcaatattgtgaaaatggccatactgcccaaagcaatttatagattcagtgctatccccatcaagctaccactgactttcttcacagaattagaaaaaactaccttaaatttcatatggaaccaaaaaagagcccacatagccaagacaatccaaagcaaaaagagcaaagctggaggcatcatgctgcctgacttcaaaggatactacaaggctacaataactaaaaagcatggtactggtgccaaaacagatatatagattaatggaacagaacaaaggcctcagaaatagcaccacaaaactacaaccatctgatccttgacaaacttgagaaaaacaagcaatggggaaagaattccctatttgataaatggtgttgagaaaactggctagccatatgcagaaaacagaaactggaacccttccttatgccttatacaaaaattaactcaagctggattaaagacctaaacataagacctaaaaccataaaaaccctagaagaaaacctaggcaacaccatccaggtcataggtatgggcaaagacatatgggcaaagacttcatgactaaaacagccaaagcaatggcaacaaaagccaaaattgagaaatgggatccaattaaactaaatagcttcttcacagcaaaagaaactatcatcagagtgaacaggaaacctacagaatgggagaaaatttttgcaatctatccatctgacaaagggctaatatccagaatctacaaagaacttaaacaaatttacaagaaaaaaaaccacacaaccccatcaaaaagtgggcaaaggatataaacagacacttctcaaaagaagacatttatacagtcagcaaacatatgaaaaaatgctcatcatcactggtcattagagaaatgcaaatcacaaacacaatgagataccatctcacaccagttagaatggtgatcattaaaaagtcaggaaagaacagatgctggagaggatgtggagatataggaacacttttacactgttggtgagagtgtaaattagttcaaccattgtggaagacagtgtggcaattcctcaaggatctagaactagaaataccatttgacccagcaatcccattactgggtatatacccaaaggattataaatcattctactataaagacaaatgcacacgtatgtttattgcagtactgtgcacagtagtaaagacttggaaccaacccaaatgcccatcaatgatagactggataaagaaaatgtggcacatatataccatggaatactatgcagccataaaaaaggatgagttcatgtcctttgcagggacatggatgaagctgaaaaccaacattctcagcaaaccaacacaagaacagaaaaccaaacactgtacgttctgactcataagtgggagttgaacattgagaacacacggacaagggagggtaacatcacataccagggcctgtcagggggtggggtgttaggggagggatagcattaggagacatacctaatgtagatgacgggttgatgggtgcaacaaaccaccatggcatgtgtatacctatgtaaaaacctgcatgttctgcacatgtaccccagaacttaaagtatataaaaaaatttaaaaacaaaatgtttataacctattagatgaaaaatgtacgttataaaagttggtagggtatgatcccatttttgttaaacctacattcatgactttgtacctacaaatacgtattgagagaaaaaatgaatgaaaaagtgctaataatgtttatctctgggtagaggacatgtggatgacatttttttcttaggctcatctatattccccacattttctatgataaaggtatgctctaatagtttttaaaaagtaaaatttagaaaaatgatgacaaaatatgccagtgcttgtaaaacatgcccagctgccttattgagtattatagcacggctgtgagctgactcaggtccagtcatggagcctccagaaagtactcttgagttgacatactgacagaaatggaatggcttgtaagtttcccaggaacaggatggggaaccttagggctacatggcaccaagaaacatatatttgaaaaaaataaaagcaggtggattattttgggtcacttaattgtttcaaaataactggctgggccagttaatcccagccctttggcaggctaaggcagcaggatcctttcagtccaggagtttgagatgagcctggtctcaaccccatctctacaaaagtctggtctcaaatcccgtctctacaaaaaattatccaggcatggcggcacacacctgtggtcccagctactcaggaggctgaggtagggggatcgcctgggcctgggaggtcaagactgcagtgagccttgattgtgccactgcactctagcctgggggacagaaggataccctgtctcacacaaacaaacaaacaaaacaaaacaactggctggttgtctgaattacctttcattgctgtgtgtgtatgaacaccatctccctgtgactttggccaggtcagtattcaacaagagactttttttccacttgagtttgacattctgccatggtcgagtaacggtactgtaattgtttagctcctcatgtctccacctcagtgcactcctattaaccttgaacattcatgcccagattttgccacacccagagtatggatatatgacaaaccccattctacgttttgttttattactacttgctaaaaatttgaactaaatgataagctgaagtattgattttttttttgcccatctcatctctgctactataaagtttttaaacattggaaaacaaaataatacattttacgctactctaaacaaatatcctcatcaaaaaaacctgaaatatttagacttaaaaaatatcagcaatgtcaatataactgttgagtggagagaaatcctgggtgtagaccacaacttctttcttggaatctgagaataataccttttcagaaaaatctttgagacagggtctttctctgtcacacaggcaagactgctatggcacaattatagcttactgttaccttgaactcctgcgctcaagcgatcctctcacctgagcctcccaagtagctaggactataggcacgcaccaccacacgcagctaagtacttagtttttgtagagataaggtcttgctatgttgcccaggctggtctccaactcctagcctcaagtgatcctcctgcttctgcctcccaaagggaggttgggattataggtataagccaccttgcccagccacattatttttgaactttaaagttatttcatgacttgtgtaacaactatttgaagggaaagaatgaaaaatatgccatctacaaggaaagcgtgaatacctaagaaacatccaaataattcacccattaactatcagtctaaatgagggcaaggtgggtctgatctcctaataatatcacatgtgcttcattcataaaatcaagaaagaatggcttcactagatcctgctctgactttaatcccaggacaggaaatgcactgataattctcaaagctttggataggaaagcttcacaaattggcctggatccatttctgtggctgtgagtcttcacacattgatcttcctgatccctgagcccctgccggtgtttcctcactggctcatgcccttttcaatggttggcacctttgatcataaatgtttccacaggtacacaaagacaggcatgaaagatagaggaaaagagctctctgcctatatttgttatggttgaaaattcagatgtttctcctctgtttccacttaggctgagttacaaggtaatttgctcaggaagacgaatataatggtggtggggggttagggcagggggaggtccgctcagggtttccaccaagggtgcaggtttaacagaagccagaatgggaggatcatgtacatagactacagtgagaatggtaccccagttcctccctccagcaacatcagcctgcaccagtctgagacagggcacggtggggaatgaggggccaagatgggctttcatcgttaacacacatccatcagagcacaattcttcttggagcaaaagatacagcacagtagaaaaagcccaatcagccacattctaatccccttctcacccacggagctgtgtgatcctggcaaatcatgtgtcctctcagagcttcttccttcaaacatagaccccccccaacacccaggtcacacgaactttctccttctgaggataaaggccacagccggaatttagtaacattaattttaaaaccctcatctccaggccagaaaagcctctcccaaccccttggaaacgggttttgatggcaccaccaagacagcagggtcagtgactcacggatttgggggatggccttgtgggcgcgaggctcctccggaaagcaggcattgtgcagggtgtctctttgatggtcttttaaagagctttccctgttagctagagcagtttcaccttcagatagagctgcctttccgttgtccgtggaattcactgcacatttcgagggaccgcctgtcctggcagagagcaagggactcataaaagtgtcagaacattatgaacagcccgaagatgggctgtgagcggggataagtgaagcgcggcgtggaggccgttcggtaactccatccatctgtggacaggggcgtgaggacaaggcgaacagactcgtggcgagcagcacctgggcaagccagcaggtgcttgagccacggggctggctcctcgttgagctatctagaggagtgcaccgagcaaagcgcctgctgaaaatactttgtacctccgggattccttctcttcacttcgaagtgaaagatgcggagtttaatcctaacctagtggtgagagggtcctaaattcccttcctcgtagaatgacctgatttctgcggctctgagcttgcttgcggcagcctgtgtattaatttaacttcgtttttataggccttttgcatgcaatgttaaacacacagccccgccatctaatcaaaagggactcttatcaatttgcaggatagttgcttacagaaaaaaaaagaataaaagcactacactgaatccttcattcttaagaggtaaatatcgatcactgagaatgtatttaatcactgatcttgtaaacaggttgtaaacacatacatgctgagtgactctgtaggcaagccctatctttgagaaacatttctggttcttacacagttaactttctggagttgaattgcacagaacctgaggactgaatgctagacgtggttatggcaagggaagctctctttggcattctgggttctgacctttcacccggctaaggcaggctgcttctgtgggtgcctccagcagtgacagaaagaatgtacaggaggtgtgaccaatagagggaactgagcaagaagtactgaggctcggagagtcaccatccgccttgaaggcactggaccagacctcagataaacgaagcccagcctagaccctgcccttgcccgggtgggcggtcttgagcaaattaggtaagaccattgatttcgaagaatgtttccaacctggaaaaccatgtagtacaaaggaataaacgtgggtcgaatcctggttctacagctgagcaaccttcagcacaacactgtgcctctccatgtctgcaaagttgacctgaaaatgcatactacacatggttcctttaaacttgaagaaattaaccaagtatacgaaaagagttgatgcataggcttgctaccaattccattttcgcatgatggagtgtgctttctgaagctaacattctaagattatattccaaatttcctgaacaaaatgtacttattgcatagcaagacttgcccctgagatccttaattatccatttattttgggatgaagataggcgaatacattttactgactctgcttcccgctcagtaattctttttctgatcctacggggtagggctgcatacgctaatatttctctgcccaaaatatacggatatcacttgcctaaaactggctgcagcttgtcgggttggtcaggttcaaatatctattttaaaaatcacccaaaaagcaaattaaaataagaaatgtcatgtttttctgtatagtcttattagttttgccccaggaaaaatggagtaaaaatagctctcaggtgggatagcagggacagccacgatactgtctccacctggatgtgaaatctggggaccaggaagctcaaagtcactctttgccaatgggctcttatgggacaggatatctcaagtgctcaaaggccagacttgactgtttaagaacccgggctagcatgcacacagggagatgccacaattttggtattctgacctggtttctggggtaaaactggaaatgagctcttgctgcgttttaatttttaaattaacatcagatataaacctgaaagaaggcctatcaaggatgtagtctaaatcacgaaagctgacagaagcggaaataaaaccatctattgaatggaacagaaaacagtggtctcggcaccaagaatagaagattcctggctcattggattcaaatgtgaattttcttatctctgttatcacctgtctagttatcaggtatctacctgcctatctatctattgttccatcccatcccttaaaaggggttcttatgttgcaaaaagaagaaagcaggaaagaattacaaaggtgttaagataactatatggaacatgctgttctcaacctttttggcaccagggactggtttcacggaagacagtttttctgtggaccggagttaggtggcagatggtttcgggatgatttaagcacgttacatttacggtgaactgtatttctattattattacattgtaatatataatgaaataattatacaactcactataatgtagaatctgtggaagccctgagcttattttcctgcaactagacggtcccatctgtgggtgatgggaagcagtgacagatcatcatgcattagactctcataaggagcacacaacctagatcccttgcatgcacagtttacaatagggtttgccctcttatgacaatctaatgccaccgctgataggacaggaggtggagctcaagtggtaatgtgagcaatggggaacggctgcaattacagatgaagttttgttccctcacctgctactcacctcttactgcgcattccagttcctaacaggccatggattggtaccaatctgtggcccaggggttggggaatccctgatatagacaatatacaagttaaaaagacttaaattacatatactgtggtctattaaaatggctgggttggtgaaatgtgaatttggggagatatgaatataggcatggtttcttcttaccttcacatgtaaacacttttgtactttacaaaatttgcataagaacattttcatgttattgatacgacttttggtaacacctgcagcagattccagaatttggaggtacggtagttgactcgacaatttctcttttatatggagaaagaaacttggagtcttgatacaacataatatcccagcctagatcatgaagaagttaactgagaaggctcttaccaacatacttaacctaatattagaaggacatttcaggcttaagcccttcctgcctgacactcatggcacatggacagtgtgtgaagtttggttagaagttaaatcaaaataaaaatagtcaattcgcatctggggttctttgttctccatgatgccctatgatctgtgcagctgagccttccctcccatttgatctatggatttgataggattagataatgcagaagtccctgaaataatggcccagtttaataacagctggaaaagtgttattgtaaagataagccattctttttttttttttttttttttgagacagagtctcactctgtcgcccaggctggagtgcagtggcaccatcttggctcactgcaagctctgcctcccgggttcacgccattctcctgcctcagcctccccagcagctgggactacgggcgcccgcctccatgcacggctaatgttttgtatttttagtagagactgggtgtcaccgtgttagccaggatggtctcgatctcctgacctcatgatctgcccacctcggcctcccaaagtgctgggattataggcgtgaaccaccgcgcccggccttgataggccattcttaatgactacccgtgcaggtttttcatgcaatgaagaaggatcttgactaactcatgggaatatcaatgcacagaatgggtcatttactcactcaacaaacaatcaccaagtggaccctaatacaggttgtgttcaacaactggaaatgcagagatgaaaatgtgctatgttagccctagagttctggaagtagacctatgaaatgatcatccagggccccttgtgcaactgcaggtggtaacattacactggacgctaagtgatagccctagaggttccattgtggagattcaaggtggatgtcatctcccagagctatgcaactgggggcactgtgaataatcaagacacaagatgcatcagtagctaagcatcactggctaatcatcaatggcaaatacatcaatgggctaagcacaagtactgtgggaacagagatcacaggaaccagctctgtcccactgggaggtgatgggataccgttaaaacttcccatgggatgtaatattgacatttgaaaaatggtagacaagcagattcaagaataagtatatatagctgggcacagtggctcatgcctgtaatcccagtattttgggaggccgaggcaagcggatcacaaggtcaggagtttgagaccagcctgaccaacatggtgaaaccctgtttctactgaaaatacaaaaattagccgggtgtggtggtgggcacctgtaatcccagctactcaggaggctgaggcagaagaatcccttgaatatgggaggcggaggttgcggtgagccgagatcactcaactgcactccagtctgggcgaaagagtgagactccatcgcaaaaaaaaaaaaaagagagtaagtgtatagaatgggtaagatcaaacaccaatttttgctttcattaaatattttcagaaagtgatcctgaacccgcccaccctccaaccttcctggagtaagcaccctcttcattctcaaggtgccagtggcccttttcacactgtccttcacacttgtgtggcacacacagtggttttttttggcagagactgccaattgtgacacttacttgtaagccaccaagccctgaacattccacacagaccatactattaattttatttttgccctcagccagatttcaaagaccccagagatgtctggaaaattaatttattaaaaagcaatagcttgataatacacacgatgatagaagaaatatgttcaatatcttataaaacagttggcaatcacttaatagagtgttcattgtcaatttagtagcttgtctcattatgctcagcaaatagttgtaaaatagtgtattattcatgaaccaacatgctttaataacttttagtgcacatttatttctcaaatgcaatctgagttagattcatctataaaagcaacccattttgcaaaagtcggcttcaggacctcccaaagaaagagcaacatgttgtgtgtctcagcctggaaatgcaaactggccaagcccacacctttgtcctagcagaaagcaggtagtggtagcccctgactttagatcatccaggaaagggttagctgataccacccccagctgtggacccaacacagtggggagtggctcccctaagccagtcctgcctgaggtgggtaggatctgattcagccacctgagtctcttgatgaggctgatcatgtaacttactttgcagtgggataggagcagacccagaagcaggggcttgacctgccctcgcgttgctggacgcacccttctttacactcctgccattcaccatgagagaaacatccccaaggggaccactggtccaaggaagacagagacacatccagtagccacggacttaattcatagcctggagccaacccagctgggatcagctgaccctcagcttacagacagatgcaaaagcaataaagacaatgatagctgctttaagccagtaccatttttggggtggtttgttatgcagccaaagctcaccgggaaagtggcatatccagaatttactttgagatgctctggggacatcctcaaagcagctggcagtcaatttacctcatttcacttgctgtagaggatgtttggcacacgggactataagctcaaaagagaagtcacacatagtgaataaagaaaacaaaatttgcagaggagggaagatcacttgaagccaggagtttgaggcaagcctggggaacatatcaagataccatccctagaaaaaataaaaaataaaaaaatattagctgggcatggtggcacacgcctgtagtcccagctacactggagggaggctgaggtggggagatcgcttgagcccaggagtttgaggggcaaccgcactactgcattccacactgtctctaaaaaaaaccagaagaaattttaaaaatatgattgaaagccgcagaagcagccattctcactatgggtcttgattttcatccaggtgcttctcatatgggcaactctatgcacacgctctacggtaatagaaggagaaattaatttagttagcaatggttgacaattcttcacctcaatgttgggaggtgggctaaattcaaaaaatacctgaccagtaagtattaaaaataatggtgaaaaatgcctcacaccacaggcacaccactagcattagtagcagtaatggttgtgatggttgttattgtcttaactattcactgatagtggaattcagaagcaagaggaagagcaagaagcatcctctcccatccctcactgcaagccaagccgcccagaatccagggtgtccttcccatttctctcctaaaattgttctctgccaccgtaccagcaatcctattccacagtcatatcctgtggagcccacgggaatctcagccagaggctgaaaccctgacactcccatagtccatgctagctgaaccttggctggtgggcctctggagtgggcttccacagctagaagaatattttacaatgcaagcatttgacttccaaacagaattgcttcctggtgtctctcctcgccatagcttgtgcgctcaacttgtcctcttgatacagaggaatacttgaacatcatggagctctgatgaccatcctggttaatgttggtgtttgggcaacagcgggacacagtctgtgtcctctacctggggtctcctttccctccctctccctcctccaggctcattgaggggagctcctgtacgtcctccaagagccacatcctgggggaagttttccagttgattccttggggaaagtcaagcattcccacctttggatccacagaatcctgcacctgcttctccagtattaagtggctgtgctgtttggctttgtgtgtttagtcttgtttctctcattcatccatgagatctttcaaaacataaagtacatctcacacactatgcacagtattaagacacagaaggggctcaggaaatattgtgaagaaattagggaatactcttgttgaggccaggctacaaggctagactggaggccctggtccctttccttgtcctctgagtaggccttctccaggctccgctcctttccaaatttccaggtcctcagcattccccattgaagaaacaggagctgatcatagttcgttcttattaggagttaaagaaaagtgcacgccatctccgatgactccaggccctccagggacaacctatacaaggtttacagccatagggagcatgcgaggacatttctaattaaattctttagtgcttctacttgacctcatttcaactgtgccataaatctcggaaaaaaaaaaaaaaactcaaatccaaaattttaaataatgcttatgagttggtttagaatcaggactcgccttattaacccaatagctgcatatacttggattgccagagtgtgccttgagacagggtcagttaaaggccagtggccatttcaattaaaatgttttcaaagatttccaaataataaactggtctggcctataattacagatgaaataataatttttaaaaaaccctcataatcctatgtgtaatgttatggcacgcagttggtgtccatgcaccaagacaaatatctccccaagacagggagccacggaaacaactgaagtataaatcccgggcaccattaacacgcaggctctattagttgactttgtcattggtcacattaaagcctcatggcgtttgctggtggcttgggagggaagggttttggaacaacttaaatgaacatataattccactcggtaaatctctgctgtaattggctaataagcacacactttgcaaataaccactggaaatggttggttggaggatttctcccccaacttctttctcacttcccatggttcttctggcatagagggtgattcactttcacacacctcctggcctttcagagtatggagacgtggaaattctgagtaggtgagttccatctcagaggacactcaggggaaagcgtgctgtgcttcttaaactatgatctatcctatagttttctcagctcctgcactgttggcgtttggggctggatcactctttgctgtaggcagctgtcctgtgtatttgcagggtgcttactgtcatttctgcccttgatccaccagtggctagcagcgacactgcaccctgttgtgataatccaaaatatttctagacactgacaaatgtcccatggggggcacagtcaccccctgtgagggacccctggtctagccagatgcaccctccaggtcctgtggctcagcatcccatcatggtgcatcgtgacagtccagcaactcgtcttagacgggaatcttcctcctgacttgcttctctactgacctggcctgtgtcaccttttgaccttctggattttgctcccattcaatttctcctctcacccaggcatgcggttctttttttgtcaggctttgacctgcagtcatcagcaaaggatcttgactctgaccctttctgaggctcttccttcttgaagacaactacagagctcaacccttgcctctagtatcctgggacagagcccagcatccccacaactgcagaagatgatggcttcataactgaatgccagcttttcccaggacccaagctgtccctggttggaaaagaggccacaatgaaagctttctgcttctttcctggctcttggaagcaggtacccactgtccttcatttacagattccctttgtatctaagagcgggggcactgtagagcatacgtcttttttacttatttgggtacatagttcatttcttttaggagtctatgaccacacagtaaagaaagtggaatctgggctattatgtgaccttgtgccaaaacataacactcacttagtgctgttgttgccagactgttttcactgtcacatctgaagcctaaagtctccctgggaatgccaggtgcaagacagaaagagtctctggaaatgggaatgaggttgccagattaaaacacaggacattcaatttaattcgaattttagataaaacaaatttttaaagtataaatatatcccatgcatacagtatgggatatacttctgctgaaaaaaatcagtcatttatttgaaacttaaatttaaatgggtaggctgtatttttatttgctaaatctggtcacctaggcaggcaggatctctttttcttgggggatataggatttgaacttgaccccactctacttcctgaacttgaccccagcacactccatcttgacctggacttgtttgctctgatctcatggtggggtaaccaccaggggaagtgaggactccagggagacgcagtctcatcctgtcacatcttgttgtcctcaccgtgctggctacaagctggggaggtctaaacacctctctagatcaggttctcatagccactcccactgttgtagtttgcagctctggccaaggatttgtccatagtcactgtcctaaaggaaagtgaaaagtcagtcaaactaattgtgtttgcagctcctgattttgtaactctcggttttgtcaaattctctctctgttgcttcccaaattctgccgagctggaacatttgcatgggtgccctaggctcctagtttgtgcgcagtgattgacacatgtctgtcactcttaagtagtgtcactgaccatcctggtttgctcagaagtgaggagtttcctgggccgtgggacagtccacgctgaaactggtaaagtcccgggcaagttggaatgagttggttatccaacttgaggctgttggtggagttatctgggggatggtttgtagggaacaaacctccaaaattcaaattccaacccactgaatgatagggttctcactcacactgggttggatggataaaagtgaattccagactttccacagatggccagattaaccatcacctccacagggaggcatttctggaccattttgcctacctagtccgaacccctagatgctaatggtttctttcctagcatgtctcacagctgggaatcacagatttattctttgtccctctcaatacctggaaagctctgtgagggccaaagccttctctgttttgtttattgctgaaatccccagaagttaggatagtccaggcacattgtagctgctctcaaaatatctattgactgagcaaatggatgattcaatgcccagccatggcaggggtaaggcgctgggaatgggctgaagaagcacagccctcaactttagaagccttgaagaaagatgattatttaagatggatagtggcagcacaacacgaatgttttacggatagatgcagaggatgtgtgtagccatgcccaggaaggcttcacaaagtatttacccaaattattattttaaatgggttatcaaggtgggcacatggcttcccttctctttgcttgcaaagaacatcaaagggctgggcaatgcaaaggtgatagagcccagaatggcattgggggtttagggtcccatggcggggggtgtaagtggagaaaaactatatgtgaaaattaacttggggatactggattgacattcaggactaaacatgtttggatccagcagtcttatgtttttgaatgaaaaaaaattggaagacatggttttcttggttacacatgttctgttttgtcaaaatgtgcccgattgccctttcttctgtctgtatgcctggtgacattttaactaaactcctcatcccactcccaagccctacaacacttcaactaccccttcaggacctctctagccaacatcatcttccccctctcctaccagaataaaaaacccttttgcctccatttgccaacaagcatctctggaaaaaaaaaaaaaaaaaaaaaaaaaaaaaaaaaaaaaaagggcagcagccccagttaggggcttattgataaaaaacccccatctccctgggacagagcacctgcgggaaggggtggctgtgggcgcagcttcagcagacttaaacgacctggcctgatggctctaaagagagcagcagaactcccagcacagcatttgagctctgctaagggtcagactgcctcctcaagtgggtccctgacccccttgtctcctgtttgggagacacctcccagtaggggccaatggacacctcatacaagagagcttcggctggcatctggcaggtgcccctctggtacaaagcttccagaggaagaaacaggcagccatctttgctgttctgcagcctccattggtgatacccaggcaaacagggtctggagtggacctccagcaaactccagcagacctggaggggccttaccgatagaagaaaaactaacaaacagaaaggaattgcatcaacatcaacaaaaagacatccactcacagacctcatccaaatgtcaccaacatcaaagaccaaaggtaggtaaatccacgaagatggggagaaatcagcgcaaaaaggctggaaattccaaaaaccagaatgcctcttctcctccaaaggatcacaactcttccccagcaagggaacaaaactggatggagaatgagtttgacaaactgacagaagtagacttcccaaggtgggtaataacaaacttcaccgagctaaaggagcatgttctaacccaacgcaaggaagctaagaatcttgaaaaagggttagacaaattgctaactggaataaccagtttaaagaagaacataaatgacatgattgagctgaaaaacacagcatgagaacttcatgaagcatacacaagtatcaatagctgaattgatcagacagaagaaaggatatcagatactgaagattaacttactgaaataaagtgagaagacaagattagagaaaaaacaatgaaaaggaatgaacaaagcctccaagaaatatgggactatgtgaaaagaccaaatctacatttgattggtgtacctgaaagtgacggggagaatggaaccaagttggaaaacactcttcaggatatcatccagcagaacttccccaacctggcaaggcaggccaacattcaaattcaggaaatacggacaacgccacagagatactcctcgagaagagcaaccccaagacacatgcttatcagattcaccaaggttgaaataaaggagaaaatattaagggcagccagagagaaaggttgggttacccacaaagggaagcccatcagactaacagcaaatctctctgcaaaaacactacaagccagaagagagtgggggccaatattcaacactcttaaagaaaagaattttcaacccagaatttcatatccagccaaactaagcttcataagcagaggagaaataaaatttttacagacaagcaaatgctgagagattttgtcaccaccaggcctgccttacaagagctcctgaaggaagcactaaacatggaaaggaacaactggtaccagtcaatgcaaaaacataccaaattgtaaagaccattaacactatgaagaaactgcagcaactaacaaatataaccacctagcatcataatggcaggatcaaattcacacataacagtattaaccttaaatgtaaacaggctaaatgccccaattaaaagacacaggctggcaaattggataaagagtcaagacccataggtgtgtggtattcaggagacccatctcatgtgcaaagacacacatacgctcaaaataaaggcatggaggaacatttaccaagcaaatgggaagcaaaaaaaaaagaaaaaaaaaagcaggggttgcaatcctagtctctgataaaaaaagactttaaagcaacaaagatcaaaagagacaaagaaggacattacataatactaaagggatcaatgcaacaagaagagataactatcctaaatatatatgcacccaataccggagcacccagactcataaagcaagttcttagagacctacaaggagacttagactcccacacactaatagtgggagactttaacaccccactgtcaatatgagacagatcaatgagacagaaaattaacaaggatattcaggagttgaactcagctctggaccaagcagatctaatagacatctacagaactctccaccccaaatcaacaaaatatacattcttttcagcaccacattgcacttattctaaaattgaccacataattggaagtaaaacactcctcagcaaatgcaaaataatggaaatcttaacagtctctcagactacagtgcaatcaaattagaactcaagatttaaaaactcactcaaaaccacacaactacatggaaactgaataacctgctcctgaatgactgctgggtaaataacaaaatgaaggcagaaataaagaagttttttgaaaccaatgagaacgaagacacaaagtaccagagtctctgggacacatgtaaagcagtatgcagagggaaatttataaccagctagtccacaagagaaagcaagaaaggatctaaaatcgacaccctaacatcacaatcaaaagaactagagaagcaagagcaaacaaattaaaaagctagcagaaaacaagaaataactaagatgggagcagaagtgaaggtgatagagacacaaaaaacccttaaaaaaaatccgtgaatccagaagctgtttttttcttttttatttttttatttttgttttttaaaacaaattagaccactagccagattaatttaaaaaagagagaagattcaaataattgcaataaaaaatgaaaaaggggatatcgccactgatcccacagaaatacaaactattgtcagggaatactataaacacctctatgcaaataaactagaaaatccacaagaaatggatagattcctggacacatacaccctcccaagtctaaacctggaagaagtagaatccctgaatagaccaataacaagttctgaaaatgatgcagtaattaatagcctaccaacgaaaaaaagtctaggaccagagggattcaaagccgaattctaccagaggtacaaagaggagctggtaccattccctctaaaactatttcaaacaacagaaaaacagggaatcctccctaactcattttatgaggccagcatcatcctgataccaaaacctggcagagacacaacaaaaaaagaaaatttgaggccaatatccctgatgaacattgctgcgaaaatcctcaataaaatactggcaaaccgaatccagcagcacatcaaaaaggttgccaaccacgatcaagtcagctttatccctgggatgcaaggttagttcaacatatgcaaatcaataaacataatccgttacataaacaaaaccaatgaaaaaaaccacgtgtttatctcagtagatgcagaaaaggccttcaacaaaattcaacaacccttcatgctaaaactctcaataaactaggtattgatggaacgtatctcaaaataataagagctatttatgacaaatccacagccagtatcatactgaaggggcaaaaactggaagcatgtcttttgaaaaccggcacaagacaaggatgacctctctcattgctcctattcaacacagtatcggaagttctggccaggacaatcagacaagagaaagaaataaagggtattcaaataggaacagagggagtcaaattgtctctgtttgcagatgacatgattgcatatttagaaaaccccatcatctcagcccaaaatctccttaagcagataagcaacttcagcaaagtctcagcatacaaaatcaatgtgcaaaaatcacaagcagttctgtacatcaataatagacaaacagagagccaaatcattagtgaactcccattcacaattattacaaagagaataaaatacctaggaatacaacttacaagagattatgaaggacttcttcaaggagaactacaaaccactgctcaaggaaataagagaggacacaaacaaatggaaaaatattccaggctcatgagtaggaagaatcaatatcgtgaaaatggccatagtgccaaaagtaatttatagattcagtgctatccccatcaagctaccattgactttcttcacagaattagaaaaaactaccttaaatttcatatggaaccaaaaaagagcccgcatagccaagacaatcctaagcaaaaagatcaaagctggaggcatcatgctacctgacttcaaagtatactacatggctacagtaacaaaacagcctggtactggtaccaaaacagacatatagattaatggaatggaacagaggcctcagaaataataccacacctctacaaccatctgatcttttacaaacctggcaaaaacaatcaatggggaaaggtttccctatttgataaacggtgttgggaaaactggctagccatgagcagaaaactgaaactggaccccttccttacactctatacaaaaattaattcaagttgaattaaagacttaaatgtaagacctaaaaccctaagaaccctagaagaaaacccaggcaataccattcaggatataggcacgggcgaagacttcatgattaaaacacaaaaagccatggcaacaaaagccaaaattgacaaatgggatctaattaaactaaagagcttcttcacaacaaaagaaactatcgttggagtgaacaggaaacctacagaatgggagaaaatttttgcaatctatccatctgacaaagggctaatacctggaatctacagataacttaaatttacaagaaaaagtaaccccatcaaaaagtgggcaaaggatataaacagacacttatcaaaagaagacatttatgcagccaacaatcatgaaaaaaagctcatcatcactggtcattagagaaatgcaaattgaaaccacaatgagataccatctcacaccagttagaatggcgatcattaaaaagtcaggaaacaacagatgctggagaggatgtggagaaataggaacacttttacactgttggtgggagtgtacagtagttcaaccattgtggaagacagtgtggcaattcctcaaggacctagaactagaaataccatttgacccagcagtctcattactgggtatatacccaaaggattataaataattctactataaagacacatgcacacatatgtttactgcagctctattcacaatagcaaagacttggaaccaacccaaatgcccatcagtgatagactggataaagaaaatgtggcacatacacaccatggaatactatgcagccataaaaaaggatgagttcatgttttctgcagggacatggatgaagctgaaaaccatcattctcagcaaactaacacaagaacagaaaaccagacaccgcatgttctgactcaaaagtgggagttgaacaatgagaacacatggacacaaggaggggaacatcatataccagggcctgtcagggggtgaggggttagcggagggatagcattaggagaaatacctaatgtagatgacgggttgatgggtgcagcaaaccaccatggcacgtgtatacctgtggaacaaacctgcacattctgcgcatgtgccccagaacttaaagtataataaaagaaaattaaaaaaaaatcaaagtgcacacccacataagcattttacactaaatcgttaatgactactttggactgtctaaatttagaaaaagagtccatctgtttgaaaagagtttacctctcatttacctgtttgactctctcattgcttgaacatatctcaacccacaaatgttaccaaagtcaccatctggctatctttcttatttcatgggccttgattctgaaaacacaaggaccccctcacatagacacccattaaaataaccctgtaaaacaaaatttgagttccctttgatatgtttggtttggtttaggcaggttttttttggggggggtgtgggggtgtatttaaatatacttttcagtttactgttaatgagaaaagagaaaaaaggagtagaaaacatggaaatgggatagagaatcaaatttccaacatgaaatgtgttaatttttaagtggctttcagtaggtgtcttggaacatcagtcaatatgtggtaaataatctgtggtgggtggaattgagtctaagaattcaacattggaactttacccaagaaaaaagtccaagagtgaggtcactccagttggaaattgtttgtgtccatctgtccatccatccatccatccatccatcttttcaataattttccatctacctttcaataattttaactgttgactctgtgccaggtactgttttaggttcctgttctaatggaactcccattctgtagacaggagacagagtaaacaaccaaacaaacaaaaaataaatcaatcaataaacgagaacatcagctagtggtaagtgctatgaggaaaataaatcacagtgctgtgatagagtataatgggcaagtgccgggcaagggcattaaagcaggtggtcagggaaggcctccccgaggtggtgatatttcaagcaagctgcgaatgaaaagaataaagtcaagtcctgcctggtgagcaaatagccagtgtgagagctcagaggcaagaatgagcctggcctggttcaagattcagcaagtgagtcaaaggagaatagtttaagaagaaaaggcatcttgaaattactggcatgtcaatggagaacagaaatgaatatggatttgatatcttttgatactggaagccagtcccatattatcaatggcaaagtcatacgtaacttctccttgccgatgatctcaatggctttgtgtgtgcttcactgcaaacttgcttccccctcaccagctcacccagttgaatccagcctgattcagtaactgactcctgtttgctgagctttgtgaaattaggcacttggtaaactggcattagggtttttgccaaaacagcccaaaacactctgcgcaaacatttcctgaggcacctcttccccgctggaagtaatgggtggctatttgcaaactgcttagccggtcttaccactgtcaacccatcctcattagctgcagccggaacaaaggcatcttcctggaagcctttgttggttaaaaaaataaaagtggttttttttggacatgcttgaactaactcccatttgtgtgtgcatcagaaatatgtaatgaataaaatgaaatatggaagatactgtcatagcacatccaaatcaaacatttatttgctaaaataattatattagaaaatagccattgcctgtaaaattctggaatgagtgaaaactctttttattttgtttccttctaaatgtgcttataatttcggttaaggacatcttttcccaatacttcttactttacccacccagttttggacagaattttactaaactgagtgactcctaacacataacagtctttttatttgtccttaataaacctcagagaaggttcaccctcatgtcgggattaattttgctattgattcattttctttggatcataaaacaagtgtaccacatgttagatacactggaattacttttttttttttttaaattaactactcatggttaagccaagcagagttatacataaagagttaagagagccacttagaattaaatgatcctacctgataataaattttgctttttggaataaagcaattttctcttcgttgctgtcttactaatacaatacagtgtctgcaataataattctatttcagacatccgaagctctcccacttctttagctctctaatttcttacatgatgcccctggttttacaagtatttttaatagactgatgttccagattcttctatacagtcaaatcctttcatagtcagagacttgtttttccacaggaatttaattccctctgcagaattgtaacatgggttggactgatctggtttacattttctgacatgttttccctcccctgaagattaacttaactatcacttggctccttctcaattcttttcatctcattttcacttaaaaaatattctgattttattcagtagggtatcttgcactgttttctgaagatagggattttagctctgggaacatggtttcatgctgccaagtgtttctcccttgaattccagatgatgcctagattgtttgaaattaacacaatgtgtccaaaatttacaaaaaaaaaaaattcagcttagtgagctgaatatctctattaagttacttggttagtcaatttcataaaattttgtccaaaagaatccactctgtcagccatttatcattaagtacataatgcattgcattgggtaagaacatttaaaaatatattttaaaaatctactcagaatgcacttaacccctgctgtgatttaagtttgtgtacccccaaaattcatatgctgaagcctaacccccagtgcaatagtattgagagacagggcctttgggaagtggtaaggttatgagggctctgtctacatggatggattagtgcctttataaaagaagttgaggccgggtgcggtggctcacgcctgtaatcccagcactttggaaagctgaggcaggcagatcacctgaggtcgggagttcgagaccagcctgaccaacatgaagaaaccccatctctactaaaaatacaaaagtagccggatgtggtggtgcatgcctgttatcccagctacttgggaggctgaggcaagagaaccacctgaatctgggaggtggaggttgtggtgagccaagatcatgccactgcactccagcctgggtgacagagtgaaactccgtttcaaaaaaaaaaaaaaaaaaaggaggttgaaggatgccgccatgccccttccaccatgtgaggccagagaaagatccatctttggggaacaggccctcaccagacaccaaatctgctgcaacctgattcccagcagaggcatcccagcctccagaactataagaaataaatctctattgtttataaattacatggtttaaggtaatttgttctagcagtctgaacagactaagacaactcccctctttagataattaaatctccctaatttcttagaagttagcttaaaaatctcttcagagataccctccctggctgttccccgctccctccctcccttcctcccttcctctcttctttcctccttcatggagctaatttacaacttgcaattgctttttttgttgttgtttggtctgtctttgccactattttatattccttgagtctgtaacataatggtcataatgctcactgcacgtagcccagtgcctgatgcaaagcaggtgcttaataaatgtatggtaaattaattttaaaatacaggtcccagaggggttaatttttctcctcaattctctggcctggcctcctacattaactgaattagcccgttaccagcatgatctcattattttattttgaatctgagttgaattatgactgctatgttgttgccattttagaagacattgttctcacctctttagccagatttgtccacaaatattccctttcaggagaaggactccaccaatccagggattctgggtccctcctcccttgtgttctggctcttgtgcatggcactttgaacaaatatttctcaggactgtgttatccttgcaaaggaggccatccaaacaaaagaggacttctggtgaaattccctattgtgattttcatgcctacgcttttaaggcaatctgcagagagcaagaaggtcaaactgacctctccgcaactcagctgtctccaattcccaaagagactgcggagaggtcatctcacctttttggcacttggctctttaattgccagaatgagaggatttgatgaaataaactctatggttgctcttgctctagcattttgcaatgacttccattatatggagggactacatttctttcccaggtaagaatcagtccttgttctggtgcttggggaaggctctacttctgagcagggggagcagtgaaagcgcataattcaatggtgatgagcaccaggtctgaggctcctgaacacttcctgtctatttatagagaatctgggattctatccagcaggcctgccaattgcatccaccaaataataaattcgtttgagaaatccgttacgcattgattccatgagcttcggtttccagcttgctagcgtggcctggctttactagggggatcaaccatcccagtttgcctgggaccaaggggatgtcccagaacttgggactttcagtgctaaaactgggacagtcccaagcagactggacaagtggtgactgtatttgtctgtaataattccgattacaaaagcaacagccatcaccatcagcatcattgtaacagtgagttgttaagtgcttagcacctgctacattttattaggacttcactaataccacctgaccttcagagcaaccctgatgatattagattccccccgtttcacaggtggaaactgactctcagaaaggttaagtgcttatttcaaagtttcttggctaataaggagcatacttaggattccaaaactgaccaacctgaacttaaaccctgtgtcaaaattggaaatttggccgctgattgcgcatttgatgacatcaaggactcattgttaactgttttctaggtgtgcaaatgctgttatggttattatttctttttaagtctttatcttttttttttttttttgagacggagttttgctcttgtcacccaggctggagtgtaatggcatgatcttggctcactgcaacctctgcctcttgggttcaagcaattctcctgcgtcagcctccagagtagctgggattacaggcacctgccaccacatctggccaattttttgtatttttagtagagacgggatttcaccatgttggtcaggttggtctcgaactcctgacctcaggtgatccattcgcctcggcctcccaaagtgctggcatgagccactgcgccaggcctaagtcttcatcttttagggacatatttaggaacatttactgatgggaaaagaaatcaaaccaatgtcaataagtcatatcaggctcaaagccgtccctcagtgcaatccctggggtcacaatagtgtagaaagagccaacgctgggggcctgggctgggtcttcccctgaccagccaagcgatcaggtatctattctccgatttgcctgggtttagacgtaatcttcatcatgataatttaaaaaaaatttttttgtaagaaaagccttgatatttaaacttctgtgtatgtgtgtgtgtgtttggttatcagtggaaccctttcttcaaatgaaatattccacaaatgcctaattgataaaacctttaaaatgagttattctggtgtaagggagaactaagaatcctgcaaatagcatcctttggaaacccactggtctatgccgtcccggcctgcagaaacctaacaatattagaaagaaacatttggtcaatgtgataactctggttctgtcaggcaggactggcaaacttctcttgtcaagagccgagttataaatgttgtaggctttgtgggtcgtacgacccatgtcgcaactacttaattctgccctcccaacacgaaagcagccacagacaaatgtaaaataatgggtgtggccatgttccaataaaactttatttatttataaataaactttatttatttatagacacaaattggaatttcatatactttttgtgtgtcacaaaatattctctttcccctcaaaatgtaaaacgattctcagctgacaagtatataacaacaggctcaatgtggcccatgggctgtcatttgctgatccctgctataaagattgtcaggagcctggtttcgattttttttcttttttttcgagatagagtctcactctgtcacccaagctggagtgcagtagcgccatctcagctcactgcaaccgcaacctcctgggttcaagcgattctcctgcctgagccaccaaggtagctgggattataggctctcggtaccacgcttggctaatttttgtatttttagtagagacagggtttcaccatgttggccaggctggccttgaactcctgacctcaggtgatccgcccgcctcaggctcccaaagtgctgggattacaggtgtgagtcaccgtgcccggccgtggttttgatttttgcccctgtgagttactatctgcacatttgagggaaagttatttaagtcctcaagcctcagttccctaattgtgaaaggggtgtaaaagtaaaatctacaagcagcagggatagatgggaactccgtactttcctctccatttttctgtgaacgtaaaactgctctaaaacaaagtctgtttaaaaagaaattcacgcttaaataaaatccacttcatgagtttattgtgcagattaaatgagataagacagtaaaacacctcagcacatggtggtcaccctcacctataattacccggtcctcctggaaaccagtgtactgcccttcttgaccttcaaatagctgtgacctttgcaaggcacagccctgacgcaaggatgcttagaacttggatcctgggcctgttttggcagaatgaactgacctagaatcagcatggatcagactcacaaaagtatgcctgttccctcagcccccagcctccaccccaccatcattgcctgttattggctgagctcccgggccttttccctggactaaagtgttgtttgcttttcttctgcagctttttccagagatatgagcaaggttcacttaaataaccttatcagtcttaccttcaactcctcccctaggttccccatttgagcagtgtaatttctatgtaatcccttaggcagttcctgtggcctcccttctccaattttagtatgtgctgccgaagctagcacgtggcctctcttttctaagggcctccggggcaggtgtgtgtatgtgcatgcgggagggtggggcgtggtcacatacacatctgataacgtttttctactcctttcttcatcttgggctccactgagctccctcctttccttgcatctctttgtccttgactttgaaacatggaacacctgctatttcttggggggacatttcgagcctgatcgtctctagctccttcccgtctgcgaggcctgggatttgggctatcacacctcctgttctgaggctcgttttagttattttggatttctttgtattgcaatcacctaaagaatcctaggggttcttttccttccttattttctcctccagcccctacctaaattagttgctaaagggctggctttctgggttctgaattcttgccatgcagttgtccccaaccacagtcccttcctgatgttgctggggcatctgtgaaatgcctcagcaaatctttttttgtttttttttttataaaaaactctttatatgttatttttcttattgtttaaaaataaaatgcgtcatgcacatttacattgtaaaagtaattcatatgcctcattaaaagtgtgtagaagctgaataaagagaaaaataatcaagcatattattattcaacattttcgaataattttctactaaaaatttttgacatactcctgtggttagatcattctctccctgcctctttctctctctacatttatatatatgtagtagtgtatgctgatagagttatttaacacggtagcatcaatatttttctttgttattactctcctagtgggcatctctctatgacttcatattattccatccaaggatcctcttacattttatttaatcatttccattttattaagcatttgtttgcaatttttaccattatcaataatactccaagtagcatctttgtgaatacatgatttttattatatcttaaattacttatttatggttgattgcctacaggtggaatgacttgagaaacatcttagagatagttatatattctttaaggaaaaggtattgtcagagcctgtgttacatgatatgactgctactattgactttctgcttcttctaactggtctgggatctcggttcctggattattctcccagagagaataatcctcaagaaactctccactcagtttgtcacctttacaccaaaccatgcccttccctttgctttagtgaacttggctgcaaactacagcagatgaactctacgcaccaaccttttgtttcagaacataaataccagctcaaccattgatcattttgcctgacctttctgagttcgtcaacttgtctctgatacatagcaaagcctaacttctttgttttaagaaaaattccaagagtcgaatccccaggtcaacgtattcatgagtgtgttgcaaagtaaagctgtaatatttcactgctaaagccttcaggagagcaagcaatcactctggatccttgcctaccactgttcaccggtgcagttttatgtctcctgaaaacgtcttctctctaaacacaccaagggctaaattgtctcctggcttcttgtatccaatccaataactgatgcatatacaccctcctcaaatgcaccctagctgacacacacgtttgactgacttctgaaaaagctttggttaacttcagtccaggaatggttagctttgccttttctgtgaaatcacatccaatggctggctcgacctgtcatggtccctctgtgaggccagtctatagtctaaggtttaggtgcagatgaaaatcagaagtgactaagaagagctctctgctcgttttgggagacagctacctcctgtgtcaagtgacaggagtgaaatttgctacctgccttcttttcagaatgaataaaaactggatccatctagaaaatccattcgaaactgatctccatgcttttatatttaggcagcattcacctcacaacaataacacatttgctttactgccagaaggggccttggagctcatcttgagggcttgttggagcccttagctgagggggtcacagacaaccccttctaaactcttggtctgtggaaagcattgtcttcaactgtctgtacagatttggaagagaagcagacagtgagggaagacacacctgcttggccatcagaggtggacgctcagctcatcaagactgtcactgatgacctgggagatggtggcaattcccttgattaacttaaggcccaggttcctcatctgtgagtggggatattaacagcttccctacaaacttgcctggaagaggagcaatgtttgtcaagtccttttcatggtacctggtgtgagaaatgatcaacactgaaagctattattgttagctagagagatgtctttatcttttcttttcttttcttttttcttttcttttcttttttttttttttttgtgagatggaatcttgctgtattgccaggctggagtgctgtggtgcgatctcagctcactgcaacctctgccttctgggttcaagcaattctcctgcctcagtctcccgagtagctgggactacaggcacatgccacgacgcccagctaaattttttttttttgtatttttagtagagacgggatttcaccatgttagacaggatggtctcaatctcctgacctcgtgatccgcctgcctcggcctcccagagtgctgggattacaggtgtgagtcattgcacccggccagctagagagatgtctgaatgaattgcagtggccatgagagggataaatcgagcaggtagatcactctccccactgcaacagcatccattttaccccctatattttacaggtaaggagaatgaatttcaggtgagttagcgggttcgtacctaatggcacattcaggactcatactcaacctccttgatccatgattcagtgttctctctgctatcttgcactgcctgccaaaaaattcaggtgaccacagacaaggacacaccaggagcgtacctgagttgacagtgagatgactgataagacgtccccagcatgaggttttaaccatggacatagatctttggactagcaaagccaggtctcccgttataagtggaccatcctttctgagttccagacactgccttccatgtctgttcaccggcactcaattggtacaactgtgagatgcatgatgctaggcaacctgtcttgcagaaattttgacagtacacattttaagccttaaaaatctccccattggtgctcacgtgagtctaggcatgggatcaaatgtcatagaactacacgcacacaaacacacacacaaaccataaacagaagggaggggctgggcccggtggctcacgcctgtaatcccagcactttgggaggccgaggcgggcagatcacaaagtcaggagtttgagaccagcctggccaacatgatgaaaccccgtctctactaaaaatacaaaaattagccaggtatggtggtgggcgcctgtagtcttggttactcgggaggctgaggcaagagaattgcttgaactcaggagatggaggttgcagtgagccaagatcatgccactgcactccagcctgggtgacacagcgaaattccacttcaaaaaaataaataaaaattaaaaaaaagaagagtgtatgtaaaaactggtgaaatctgaatgaggtgtgttgtttagttaatatagtattgtacctatgtcagtttcctggtcttgtgtgattaaataacgtgttatcattgcagggagctaaggtctttctctactagctttgctactccttataaccctaaaattgtttcaaaatgcaaaaatattaaaaatgcaagtcccctactttgctctgttcttccagaaaattatcctaaggaaataaagatgcatacagaaaaggccataatgtctaccataagaggttttaaagtaaattctcacccagctgcttggtgggtgagggcagtgggtcatggtgagtgagggtcagcttggctgggtgaccttgtactgcttatcttgctcagcctcagccgagctacttaatgtctctgtgccttgggcatctcatctagaaaatgaatgtaatataataacatctatgtcatcccatatttgtgtccagtctgtacatgtaatttgtgtgcaggatagaatctggcaccatgtatgcgtctcagtaagtgtgagctagaatcatgttcaagaagaacactcatgacatgagaaaatgttgctgttagtgaaaactggagacgagaaagccatacttatactattgatgctatttttgaaaggcatagagatgtgtataacagtggctagaaaattttgcccagatgttatcagtaggtggtgcatttttgttttcctttctaaactctgccatgatttctaaaaactaactcaatgagcactagtatgttgaattttaaaatgagaataaaatgtgactctgttaagtacaaatggccagataacatcgcgtctcagctgctttgcgtgtttaacctcagcccttatcattatttctgtgctgcctgtaagccgcagaatctgtctctgagatgctgcatttccctaagaaaggaggaggagtgagacgcctctggggtgtgtggttatttgctgttgttaatatcagggatggtcacgatcaccacagtccggaagtgcatgcagtctgctcgtaaaacatgtgcaacactctagagcatgcagggtccgggagccagcccagcagagtggtcagtcacctgctccatggggaccagggtctgctccaacttccacactctgaatccagccccagacaggagtctctaagcggacatgggctgacaaatggagctgcatcagcactgttccagggagagccttgtggggtccaagcccattttctttgcttccaaattttcctctctcctgtaatggagctagcctgcagtggctaggcttctcttctccagcctgtttgttctcctgaaggtctctgatgggcatttgtgggcactcaagccatttatcccactctcctccaggttgctggccctcaacaggctttggggaaggaacaaggggccacctgcccctgaaatttagggatcaggctcagcagagctgtggtagtcagttaggcacccagcaaacttgaacttctgtgatctaaatagacatcccctctcccttcaagagcctgctccaaccctgttggcaagtatagtgctagtgaagcccccagcccacccccaaggtctctctgcacttctggttctcatccaggaagaaacctagatgtcagactgcccactgctgtgcgactaggggagggagggtagagagaagatgggacccagtctcaggctgcctctgcctccatttattggagggtcccagagcccaccacatccaggctgaaagaagggagatcccccccatcccagattacattttgggaggttaaaaattctcctccttctacatcctgacaaccatcccctaaaccccagaatgagtgtctgcttgtagcacttcgtgtaaaactcaccgatggctttccatagaattagaaacgaaagccaattcctcaccaggccggctggctcgaatcctccgtgacttaccttctcccttcctggctctgctcagtccccttggccttctgtctgctcctgggatgcccacgcttgcccactccgggcctttgcagatgctgttccccatgcttggaaaactggcctcctccccactcaccagccaccagccaccactctgcaggatgggtcagtgtttatcaattcagagcttcgctgagttcctgtgaagtcacccccagttgctttcttcatagcactggtcacaacaggtaattcctttatgtctttgtttgattactgtctactcccccaccactaggaggtggctccatgacactaagtgcttgtccttcatggccacacacatctccccagtgctaagaatatgcagggcacgtagtaggtgctccgtaaatcattgctgggtgaaaaaaggatggaagaatgaggtcttcacttgatagaacacaggctcttggttgcatataaaaatttgcttccccagagaagaaagtgattctgctcatgtcttagggtacagggggcaggactgctggtcatcctagcctaagagagtccagtggtggggacagacatgacacaaaaaaggacaatagaggctgagaagggcaacagcaggaatggcccaatgtacccagaggagggtggatttgatttaattctaatggggtgggaagggggagttagggatgataatgctcagaaggacttggaaaaccaaaggtgatgtggcaagaggcatatgtgggaagggcaggctgtgaggccaggtcaaggcagggaagtgtgacacagcacagtgcatagtgggactacctgcagtgagccccagctaagagagtgggcagctggctggaaaataaggcagaagctgactgggatattttttcttgcttccttttctctttaacacttgccatcaactaacaactccatacacttgactcatttatcttattttgtttggtgtttgtttattttgagacagggtctcactctgttgcccaggctggagtgcagtggtgcagtcgtggcttactgaagcctcaaactcctgggctcaagtgatcctcttgcctcagcctcctgagcagctgggatgaaaggtgtgcaccaccacacctggctaatatttgaatttttttgtagagatggggtcccactgtgttgcacaggctggtcttgaaatcctgggatccagtgattctcctgccttggcctcccagagtcctggaatcacagatgtgagccaccatgcctggctcatgtatctatctatctatatctatatctatatctatatctatatctatatctatatatttgtctgttttaccactaggatggaaacactatgagagcagggatttcaccattttaaaattgtattcccaatacagaaattgtgcttgacacatagtaattactcaacaaagagctcttgagtgaataagtgctgccgatcttcggcattgaccagtgagtgttcaacaggcgaagcatcggtgcctgatagtcttaggtgttatgtgaataaatgttcttcattttcacagagatttttaaaaactcactttggtatgatataggagctggcatccaatctgtgacttcatagatgttattgcttagagtgaggccaaattaaaaaaaaaaaagttgagttcttttaaagaaaactatttgtatagcaaagtacaaaatccaggtggaaaatagcacacccaagacagatacaaccaaactaacattctagaaagatggctcaggcaataccctggggtgtaggtcagggtacaggagaggaggctgttccattggtccaaggcagaggaaatgaggcttgagatgagggctggggctgcaggcgagaagcagtggggtgaaaggagctggctggaccgggagcaggtgaggaagctggcaggatggcccagaaggtgtcgtggctcccatgggtatttatttatttatttatttatgagacagagtcttgctcttgtcacccaggctggagtacaatggcatgatctcagttcactgcaacctctgcctcccaggttcaagagattctcccgcttcagcctcctgagtagctgggattacaggcacctgccaccacgcccaactaatttttgtagttttactagagaccgggtttcaccatgttggccaggctggtcttgaactcacaacctcaagtgatccacccgcctcggcctcccaaagtgctgggattacgggcatgagccaccacgcctggctggtcttcttttaagacttagcacaggagcttctacatggtagctactcagtaaatatttaacaaatttgtggatgaatgagtaactgtgagtctcttcatccaaataatccgggggacttctcatgcccttctctgggggaaagatgcctctatagaggagacaattagaaggaggccagggacactgcagagggacggcctgccccgcctgtcaggctggctgcagtggagccctcttctggccagcctttgccgcttgcagagtgacaggttcaaagaatgagaagttcctgcagcagatgggaaaatgatgagggcagggcctggcctcaaagacaatttcattgacactcccattaatcacctttggccctgagtccttgggggcgttgggggtggaggttagtggaagggaggggccagaatgctcaactaactcagtcctcctcctgacagtggagagggctgggagaaggactccatctcttaagttgctcatatggacttttcacgagttattccagactggctgcagaaaacatcatgcacaatcctaggtgacattccaggagggaccaggacagtctgcctgcccccaggcagtcacattcagggcagaatggccagggagggggctaatatttggagagtcccttccgtgtaccactcaccacagcaggagctttacatatgttgtctgaggtcattgccacgacaactgtgcaggatgggtagtttttgcagatgaggcctcagaggtttgggggactgagctccttagtgagggccagacagccagtaggtatcgtcactggaagtcgaactgggctctttcgaattctaaaactcatgttctctctaatactcacagccttactctctatccaaaatagacctctgggctctgtgcctaaagcaatagaaaatgtagacaaaggacatgatacttgggacagaactattttgggatgtttttgtggctagatgctctggacctggggagaaagccttaagacaaaatctgttaggtcaagggcctcgggtggataccttatctgtttatgcaacccatagggaagggagctccagcagaggatacagcacacgcaaaggcatggaggtgtgacaatggcaatttgttcacagcatggaaatgagagaggggtggacgtgcccagagggacgagctgggctgctgggcccttacagtcttacagttccttctgtaagagcagaatctgctctgagccaggcaggatgctctagggaaggagtcaatgcttgcaccatccagagcccctttgttggtaatgggactcaactcccagccaatctaaatgggagacattctagaaaatattagagagttatctagaagctggtgggtgaacggtattgaaggggtgcagaaataaccgtagcatttttttgaagaacttaggagtggcatcttattctctcataatgtatgtttgcagcagagtaatgagtaggacaatcagatacacatttatcccatagctcgtgtcaaacaaaaggagcaggaattcggagacagtcatttcacccataggatgtgactgatattttccatattgacacagtgtggcccagtgttaatgcaggtcatcaacactcttttaccaagtttttaccgcttgccaggaactgggactaggcagtgaactaggcagacacggcctctcattgaacttataaccctggtatatctagggaggccgggaaatggataactaaacgcatcattgcatccaagagttttggccaagtcattgcaactttctcacgttagtcttcatagtcttcaaactggggaaattttctaagggaagtcaagacagagatggggaatggctatctatagttacaaatattaacatagcactttggaggatatgatttgatttccatatctggaagtgtcctaagagaagatattatctttgttcatgttctataaaaatccaagagtatttgtaatttgggcctgaaccatttgtccttgtcctaaaggggtggcgctcaggcagtgacgttctaaaatttaactttgtttcttcatgccaatacctttccccttgtggggcccaggattctctttcctcttcttccgttttctctgttcctcatgccaatcttagtcaaagtgtctttgctaattttgaaaccatagggtttttaaacctgtcattctgtgtttgcatgtggagtgggggaggaggttgtctcctcaaccttactttccctggtaattagcttggagattcatgagagttcattgccagtcaactccacttttgtgactggtcttctgtctggcaccatgtactttccaagagttctgctcttaagctgcagaacaggcatgaagcaatctcactttgttgccacttgctccacaaccaccatttctaggtggtcccacatcccttaatccctctggtctcctgaaagactggttctggtggctagatgtttgttttagcctagaaggaaaagtctagatgtaagctttcctgtggcaagagagccccaagacaaccagtagtcaaagcagacacatccgctgtgtctgtaaatggagaagactccaggggaatggaaaacagtcccatgaagattgaaatccctcctgttcatgaggcagaataggaagtggaagctttgagaagtgagatcatattgtaggatcacattgtaagcagagctgggacttgaaaacagatcttccatctcagtccagagggggcaaaaatagagaaaccttagcttgaaaaactcaggggatttggacagttgtaagggaactaaaaacaactgcctgcccttggaaatctgcatggcctcggagactgtgctaaacacattgggtgtgttcttttatccaatctttactgtaactaagcattttaatcaatggccaagtcatcagttaggttaaataacttgctcaaagccttgccctgagaacacagcagagtctatggccataccattctgaatgtgccctatctcttctgatcttgtgaagctaagcagggtcaggcctggttagtacttggatgggagactatggcgaggctgagccaggatttgaccccaacagttgagctctatcctctctcaaatgctgcttttgctgagtcagacaaaagaattatggctttcctcttaagacctagtcatcttttgggagatgtctttctccaggaagacctccctaaatgctccaagccacaaccagcacatctcccagatacaaatgtctaacctctaggaaacttactcagcagcccacctcaccccaccagtttcccatggatctgaagctccatgtcttcaagacagcggttcctgccttcgtcatacttttgagtaccagttccctccaccccacagttcccaaattttaattcagtaccaaattctcaggagacactcagagacttgcaaagtcaaaggggaagactgagaaagggaagctgtgggaaccagaactcgcctgtgactaatgctgatctttcactgaaatcaactctttaggaagctctttgaaaaaaatcaactaattttaagtcaagtaattttttttaactctacgaatttcctcatctgccatgggaggtaatatattcaaagcacctaggcacacatggatattgcataaatggaagtcattattattattattcaagatccattaatttcattggtcagttgaataaggatgtattccccctgtttaatctaaattcatcaagtgtaagatggtggccaaaaagtcatggtgtaaagacaatactttaatcctgactatcattcttaggcacataaatcagccctctctctgaattctcttagtgttttcacttgagtctcactccccaatagttggttgtggcaatgactgacctcccagcctcctctcacttctctctttcgccagggtcccgaataagtgactctaaggaagaaataagtacagcagttctcccttatccaagtacgatatgttccaagacctccagtggacccgataccacagatagttctgaaccctatatacagtatatttttcccttgacatacgtacctatgataaagattaatttaaaaattaggcacagtaagagattaacagtaataactaataataacagaacaattagaactatatactattcataatttcacaaacagaggattcactgttaccacagatcttagcaatctcagcacacaatgtttttcctatccttaagtccagaactttcaccttttcccctaaaggaagcactttacagcttctctttggcatatctgattgccagcatctcgactctagttctttggggctactaccaaatgaaataagggttacttgaacatgagcactgtgatacgcagcagtcgagctgatgactgagatggctgctaagtgactcacaggtggggagtgtctacagcagggatatgttgaacacagggagaattcaacttttctttttctccttcccttttcttccctttcctctcctctcctttcttttcttcttttcttttctttttctttttcttttatttctttgaggtctcactgtgttgcctaggctggtctcgaactcctgagctcaagtgatcctcctgacttgacctcccaaagtgctaggattataggtgtgagccaccacagccggccagaattcatgtcttgagggacagagccaaagctggagggagcaggatttgatcacactactcagaatggcacacaatttaaaacttataaattgtttatgtctagaattttccatttaatattttcagtccatggttgaccacgggtaactgaaaccctggaaaggaaaaccatggataaggggggactactgtaatataccttgaatccaagcctttaatagaggggttctgaggactcccagagcaaaggggtaggtcccaaaaggcaataagagcatctctggctgttattatcaaagtcagaaagatggaaagaaagaagttgataaccaagaaaaaaacaacatggtggtgtatggaacacttggactgggttgtctttctggaaatagccatatgcatgatatcaagatctttcctcacctctgatgctgcacttttattacttatataagaattaagcttccaagcttcaaccagcttcttcatcttgagacatgagggagagtagggtagagtgatggattgggctgggtggatttatttataatttggtcatgtaataaacattttttgagcaactactatgtgagacacaggatactgggcttggaaggcaaggcaccgaacatgatcctgctgcctgccttgttagaaaaaggtaccaaccagtaatgctcatgaagaggagatgaggagatagaagtgttcacagggtatcatggtaatgacatgtatctttcctttgattgcagggagactcacacattcctggactcaagcacagcatggagcacatggcagctctcaataaactgttgttgaatgaatgagttaccatagttatttactagtctgtctccactatggggctgtgaatccatcctaagtaataattgcttatgcatgtaatacactataaagtcaggatagctaagagaccccaacatctcagaagcctagaacaacaaagttcaattttgctgaagttacaggtcaccatggatcagcgtggaagttctgtccatgaagattcacactgatgaagcagctgccatcttggatgtggtggggtattgtgcccattatgaaaatcactctatggagggtccagctagcacttgcagttagatctgccagcctggaagtggttcacgtggttactgctcaggactcactacccagaacaaggaggagaggagatacacgaaaagtgtgagctctgcagattgttttaggtgtgtgtgtgtacgtgtgtggtatgggaaaggaggagtgaatgggccagtgaatgggaggaatcccctttgcccgctgctgcggggctgttgttctagggccaagtaccaagtgtgaagatacacagagggataatggcagaatggctcacggccaatcagctggtggcggacagtgcagaggcactacctctgggatgcaccgggtagtatgacatggagagagttcttcagtcttttgggcaagacacttcatctttgtgagcctctacctcctcttctatgaaatgagattaagatgaacacctgcttcaatggtgttgtcaggagtaaggggagaacacaaagagtgcagcgtacatgtgcccagtagatgtttatgatgaggccaggggacaagggtctggagggagcttcctaagtgacagattatttctttccactaagactaggaggtgggagtgaggatggggtgggctggggaatactccacctggcccgttctcaggtgcctgggggtgtgggcgggggcacgcctttcccctggttctccggcttgtgggacttaatcacacctcagttactggcagagctgtccgggtggcactgagtcacatcctcccctctaggggagctgggtctctgaactctcactgaacatctttactgttttgacccacacaataaatcccaagaaaaacaacatggcccccagagtggcctcgttgcttctgttatgccctccatgaccatggggtgtggacatgagcttcccagccctggggttggaatcagctaccccctctcccccacaaacaccggaattgtgcgtaactgtacccataccatgcaagaaaaatgtagtcgtctcagcctgagggttatgatcatgggcttgtaggaaacctctgttcatatcctgagtcttttgctcctggctgcaggattttgagcaagtcacttcacctctctaagcctccatttcctcatctgtcaaatggtcatagtaatgatggcactagcctgttaggattactgtgaaagtgaattcagacaatgcatagtaaaagtgcaaggctggaacgtaatataggttagcaattgtgaccacctttccccacagtagccacatttctgtagtcgaactaggacaacaggttttgcaacaacagacatagagttgtttaaaaattaaggaagaaacaatggcatttctcagctaaatgaaaagaactggaagaatgaattagccaaactgtaggctgaaagaaatcaaactacccaagaaacattgcaacaggaagcccaccaactccatatatcagtttcaaaagaggaccccaatcctgagaaagaaattctcactgtgctgccggccacctggggcagccaacatcatgcacacaagccgcattgtcagatgcttgtctgcaattcttccctgtgacttaccagtggtatagccctgggcaagccatttcactcttttgcacctctctttctctgcctgataaatgggagtaatgatcaggatctcttaggagtgtgagaattaagagataaaagctcctcagctgtggcttgctcatagtaggtgttttgatatttgctagtttccaatctttctaccttttcttggccaaatctttatggaaagcagctttaatgtcttgtaaccctgggacctgtctctatgttggtcatttggtctcaatgcttattgaactgtttaccacccaagatgtcttggtgtttgccttagagaactgaaatcagagtccaacgtggaatggaagctggatgtgatgtaggggctgtttagcaaaggagtgacttccagcagtggctatgtgcttctcgggcttgggtctgggcacccgagtgagttacaccttcctcctctcactcactgcccctaatggctcatacatggttgcaaatccagcctgtaggtttacaggtgtcaccatggccgtgaagcccttctcagtcaggaacaagattttacacctctttctttctctctggcgaatggaggtatgggtgggtgtggacagaggcttgaaccacagctcccatcccaaatgagccaacacccctgtcttgtcaccaggctttaaaaaaaaatctaagttgtgattaatggcatcttgaggttccccttgcagaaataaggtcatggtgaagaatatggctgatctgaaactccggtgaacttcaagggcaggagcagaatgataattattctggttttggctcatcttccttctctgtggcctgtgacttcaaggtcgggggctgtccctgcctctcagacttcctttcatgcaaatcgccctgagtgaggggtgaggggtagcaacaccagaaaaggaagcaaaggaatgtaatgaactccaacctccacggacctactttctattttataggcaagcctctaagggagaggtttggccttagctccatcgtcacccaagcaaggtcttgcatatttccataaaatcccaaacctagaagcaagctatggagacgaacctggtccattcatctctcaagaaatgaatgcattggtttcattccagaaagatcacagctctgaagggcttatgggtttttttgcaatcctgtttttttcatcctgcatgcttacgggaattcaagtctcctagctacctcttctcggggtgggtggaaggaggtgaagggcctagaagatcagggaataggcagctttgggacagaagagacaaaggaagcccctgaaaagcagatcccttctgcatctagctcccacagaaggtacccctttaaaaaagcatcctagtgtatgagttctattgtgtgctggcctgagggctgcagggggctttttctttgctggcttgagacagtgggtggctgtgtgtgatatatttcttgagaacccaaagtagtagcaaggcttgcagtcaaggagatgtggccaagggcagaggagcatgtgtggagtggaggaaggagaacagatgaaaagctaggaatcctgcctccttgaggcactcaacccagtctttgaaccatagattccccatctgaaagcaaggagctggaatccatcatctctctgctcctctgatttataggcaggataccaagggaaagatttagtcttagccccatcattgcttaggtagggctggcttgtttccagtgataatcccaaatctagatgcagtgactttctggcacaaccatctctcaggaagtaaatacactggtgacagtaggaaggaggagggtggagaaagctcccactggccctgatttgtgtgggctgaagtccaggcttggaaggcgatctcttcctggtgtaattcactgagtgcgtctaagcagtgtggcttgggaggtcaccatgcactgaccacaaccctatacacagacacagacagagacactcatacacactctgtccctctaatttgtgagtacaaagacatggccagagttttttttttttttaatgagacagagtttcactcttttcacccaggatagagtgcactggtgcaatcttggctcactgcaatctccgcctcctgggttcaagtgattctcctgcctcagcctcccgagtagctgggattacaagcgcccgccaccatgcctggctttctggcatttttttttattttttatttttagtagagacggggtttcgccatgttggccaggctggtcttgaactcctgatctcaggtgatccacctaccttggcctcccaaagtgctgggattataggcgtgagccaccgcacccagccatggccacagttttcaagtgagaaccatgttagggccctagctcactgtttccccatttacagataggagagtacacacctcacaaggcacataacctccattgggttactactaaataaaatttcccagcctcccaatgtatgtaaatacccttaaatctcataatacaaataaggccatttggtgcagctgcacaaatgcccggtaaccttaggcaagtcatgtaaaactttcaggatggaattcgtgtagctgcaaaataaagatgttgaattacctgctctccaaaatccctctgtcctctgtaagtatgcatgagtagactgtgacagcctctgggtaattcaagcattaaaataatatccacaacccctcaattgcttattttctctctcagatacaagtctgttgatattaataaagactgttgatattgatgaagaactatcaatatccatctctactgctaaggaacctaagttgttccaaacatgatttggagcatgtgatgtctctgagggatgtgacttgagacatctatccaggtttcttccttgcttagtcagcattttctttcaaatatggtataaaaggtacaatatggagcttggtggcaccaccagggaggtgatgaggaagaaggtgctgcctgtaacagtagcagaagaagtgagaatctccctgacccctctgcctcccctgcagactccaacagcaaaacgggggcccacacaggatatgggatccaagagggatttttctgcctgttgtggcctccaaattctccaaataggtccgttcacacaaacaagggtagtttgttctcccagcgacaggtacgtgtgagccaatacttgggtggggggatgtcaatgggggtaaaagaaaacctttgcctagtgggcagcaggcgggggcccccaccagggcgtctctgatgaaaacgttcagcttgatgtggcgtctctggttcctctgaacgcgctcagagacagaggcgttgagcggtgctctctgtgtttgaaggtgtttctctacagcaaacaccaggcggagaagagaaaaacccaaaccacttcaagtggattccgattttgaaagccaccacatgaaaagtgcagagacctaagccccctttagtacgagcccaagagtaacaggctcaggctggggcgggtcgcctgctcctgggctgccagccccctggaggccctgtgcgtgtgactctacggccaaagacatcagtggagggggaggtgggagctttcatctctgcacaccgacttgctcagaactagaccacagcgccgctccatgcggatgccctaagtaggacaactttcatttgtgaccacgtggccccacccatctctgaacttcctgaggtttggcacagacctgggaagagttatgaccttcagagaagaccgtaaagcacaccaagagccgatactctgagttaaagccattcattcattcatttgtccattcattcattctttcctcccaaccatatttttttaaacatctcaacacaacttctcctcaccacccacaattcggtaacgagaggagcacccgatatttttccctgctgtcctccacgttgacctgattcctttggtcttggcacctgtttgccaactcctaacaattggcttttgcttgattgacccccttgccaaagcctgatccaagaccctaaacttagaagagtttattttgcctctcctcttctgcatttcatgtaatccaaaatgtgtctaaactctaaattataaaatacagaagtaagaagtatgttaaaatgacattgtgccgaagttattgataatacaatgtgggaaaattcaccaaagttggaattcttgttttgctctgcggtgtccttgttttgctggggccctaagatacatttagtcagaccttcagggaatcccccacgactgtctgctccctgatccctgctttcaacccctagggaacctcctctggccccaaccccggctgagacacaatgcaacccaccagcttctgcagtggtcagagcatttatctaatctctgggctcagacagtgcagggaaagagaagttccatgactcgaaaaaggcatttaaagtggacgttagacttttcattgctgccatgtgaacctatgctcccttttatcctgatgagtgaaacgtccatttgctgctgtaacaaattaccacaaacttggtggcttaaatcaacataaatttatgtttcagttctagaagtcagatgcacaaataggtctcactgggctaaaatcaaggtgtctgccaggctgtgttccttctggaggctgtgggggagaatctgttttcttgccttttccagcttctagaggctgcaacattccttggcttttggctccttcctctgtcttcaaagccagcaatggcaggtgaagctcttctcatcctgtttcactctgacctcttctgcctccctcccactgtaaagaactcttgtgaataattatgcccacccagatagtccagggtattgtccttattttaacgtcagctgattagcaaatttaattccatctgtatctttaatttccccttgcaattcccatgtaatatagcatattcacaggttctagggattgggacatggatatctttgagggactagtattctgtctgccatagctggaggtctgcagaatcagctgggttctaggtacttcgtgtctgcctttttttttttttttttttttttttgagacagtcttgctctgtcacccaggttagagtgcaagggcacgatctcggctcactgcaacttccacctcccaggttcaagcaattctcctgcctcagcctcccgagtagcttggattacaggtatgcgccaccatgactggttaatttttgtatttttagtaaagatgggattttgccatattggccaggctggtctcaaacccctgacctcaggtgatccacctgccttgacctcccaaagtgccaggattataggcatgagccactttgcccagcctttttttttttttaattttcagaaaaaagaacaaacaataaagctgtggctttatggctcacaaagatccataaacccgtgctcactcagacactagtcaaaaatgcagatgtctggtttaccagctgagattcaggttgcgcaattccaggagaggcccagccatttgcattttaacaagctccccaaggggaccccaatgcaaatgcactaggagctgcaccctggagactctggtgtccagggagcactgacagcacatggactttcgggtcctcagtccacctctaagtacaaagtctagtcactgagaacagaagaaaggaccctactgtatagcccggcagttagtgcactccatagtccaggcttttgtggactgattctggagcccagggagatggggttcagggggttgagcttaagctgcaaagaatggtctttgtaccatcagcagtcctaccctctgccaagtcagggcagtcaggaggactatccccttgtaagactcagtgcaaggggtcaaggctgtgagtcatcattctatggtgaggggcttcattttgattgaacatattctagacagtccaacatggtatagaggaaaggataaggactttggcatccagttaggattcaattcaagttcagggatgagtagctgtgtgattttgtgtatgttgcctaaactctctgagctataacataaagactattgcatggtagtgaccttaactgagatatgcatatgttgagtttctgatatacagaatggacaaaataaaagccttcctctctacatctaaaaagagtaatagaggccgggtgtggtggctcaggcctgtaatcccagcactttgggaggctgaggcaggtggatcacttgagatcaggagtctgagaccagcttggccaacatggtgaaatcttgtctctactaaaaatacccaaattagctgggtgtggtggtgcacgcttgtaatcctagctattcaggaggctgaggcagaagaatcacttgaactcagggaggttgcagtgagattttgccattgcactccagcctgggcgacagagcaagaatccatctccaaaaaaagagaataatagttaactatttattgagaagttgcatgtttgttactctgctaaactcctgttgttcattattcattgaatactcacaactcttaaaatggaagtaatttcacaggactgacttcataaagatgagaaaacagagacacgagcaaggaaagtcacttgctcagactcaaagacctaatgatgagatgggatctgaactcagaggctaagtcagagtgtagtctcttcagcagattgtcttggacaatgcagattttaaacattctgccccattgtcagtcatggctactttttaatttggaatacatgctgctttttttatttggaaaatatggtcaatgaacagacaaaacttacagcctcatgatgttttacttccatttttgttgaggggaaaggcaagaggagaaccatagtgaagtatctcttctgtgcaaaaatggaaaggaagttcattggaaaccatgtattgattgaaaaatgatttgaaacaggccaggcagggtgcgggggctcatgcctgtaatcccagcactttgggaggtcgaggcaggcagatcacgaggtcaggagatcgagaccgtcctggctaacacggtgaaatcctgtctctactaaaaatacaaaaagtttgccaggtgtggtggcaggcacctggaatcccacctactcgggaggctgaggtaggagaatctcttgaacctgggaggcagaggttgcagtgagccgagatcgtgccacttcattccatcctggggacagatcaagactccatctcaaagaaaaaaaaagaaagaaagaaagaaaggaaagaaaagaaaacaggccacagactccaccctggagtttttctgccagcctgcaagtcctatctgaacagtgtgcattttgaggctttttatgtagcaggcccctgaccctttagactggtctaaataaatgtttgcagcaggccttcttgggactcggggtccccagcacagatttgtcatccaagaaaggagggttgtgaaaggagttaatgtttacccagcgttctgtggccaccatttttctgtctttctgtctcttgaaacatttccttagggacacgtctccattacacaagctggaaggagcttgggaaagcatcaaaaagcacaaatgtgtgtgaaacataaaagaaacttttaaaatttgggtggaaaccaaaccaggctgagatgggtattgcaagtgaagggctgggttaggactgagcaactttgacatcacccatcagtgccagaggtcactgcactgggatcggagtgcaggagccacatcttgtgctctgagaaaggatggtcatggtggtgatggtgatgacgacattgatgatgaaaaggataaagcttccctgttcatttcctgggattgcctaacaaatgaccataaaacgcatggcctagaacaacagaaattcattctccccacagttctggaggccagaagtctaaaatcgaggtgtcggcagggctgcgcttcctttcaaggctccaggggaggatccttctctgcctcttcccatgtctggtggcggcgggcaatccttgacgtactctggcttctggctgtgtcactccaatctctgttctcatttctcatggtgttttctcttctgtgtgcctgtgtatctaaatctctcttttttaattttgatttttattgttttttgagtccggtctcactctgtgccccaggctggagagcagtggtgcaatcatggctcactgtaacctcaaactactgggttcaagcgatcctcctgcctcagcctcccaaaatgctccttaggcagacgccagtaattgaatctaggacacgtgcagttcggtgtaacctcatcttaacctgattacatctgcaaagaccgcatttccaaaggaattcgcatacaggggtaccaggagctaggacctcagtatgacttttggggggtgcccattccacccacaaaagtttctaatcatgtttgacatttatggagctatgactttgttacaggactgtagcaggcactttgcaatgcctgggtcaacccatatggaattgctgcatctgtaggctataaattgttgaatatcaccaatttcatatgctaaacttcatattatctcatttacctctctaagattagtactattattactattattatctcatttaactctctgagattagtactattagtactattgtatctgctaacagaggagaaaaagagccacctacatttgtcagggagatgaagtagtggatggctttaggaattgtacagacactagtcaaactatcccttcctctctatgtgaccaggagggagttacctaatccccctgagcttctatgtgtctgtttataaaatttgagacaacttttctgtaataacgcctgtgtgtataaatacgacaattgcccaagccaataatttggaagtgaggagaagcatctcacaaggtgtctggtctttaggaggcattatatctgtgcctcctaaagtgtgatctggggaacactacacttgggaattggctgggagttgactgggggtggggcacatctgttaagaatgcaggttcctaggatctgcccagcgctactaatttgacatctctctaagggaaggcctggaaaagtgcattttaattggtgcccctggggtaatgcctgcgattgcaaacattataaaactgtactaagtgaatacaagtttgcttctttcctttcaacaggacacagctgtctaattaggactagattgagtcgtccaggtacctgccccctgcaagttcagagacagtctcgggaaatgggagaccagctgacagccatcctttgcccaaaaagggcaggttagatggcaaccgttcaaggggaaagtgaatctttagcaaaatctttagttgcatgttcctgacttttccattacttggatgaaaataaataccatgcttaaaaactacaggtttaaaaatcaatgccatctttcttctggaagcgaaatccctgtgacttgccaggacagagaggaaaaagaaacaaacaaggtctcttcccaagatttttgttttccctcctgcaaatcctccggcttgcttttccatcaacttgttctctcacctaagaaccattttctctcttgtgtacagaacgaagaggcccttgactttcaaagtgagcttttggaaggaagatgcctgcttgaagtattgctttttccgtgtctgtgtctgaaagcgcaagagctgtttctagcctccttgagtgccgggtttggggtttcgtgggtagaaggcactagcagtttcagaaaccaagccttgctctcggtgtgatttgcgtagtcaggaagcctgtcgagctacccaaacagggacccgccctgacagggggacaggagatggctccctgccttcctgcctgctggcccccaagtgtctgccccttctgctgacactggatcttcggggcaaaggcacagcctactgaacacgtctattaatgtgaaagtaggtggtgtaccaggttcctggggaatggggccatggaaaagttgtaggctggaggaggaggaattcagaatttggaaacttgctatacccctcaaatatatgtatacaggatacagcatgcttcctattttctgggggaatatgctaaagattctgaatatattttatcattcaattctcacctccagctgctccggaggtagccctgtcatcaacattttatagacaggaaccagtggcttcaggaatcagatgacttctctaaggtcacgcacataggaaatggtagaatgctgcttcttccctctccaccccctcattctcaccccgatccatgcatgtggggtcctagtcagctctccattgtttctggctgggtcactgtgacctccttgagcttcactgtcctcttttggaaagtgggaatgacagcaataccagcctagggtgaagagaaaatggggctgaaagttacaaggaggtttcacttctattaagggacacgtaaaggttagtggctctgagtttcattctgttccatgaacgcacactccatggacttgctttctgagtagctgtggggaatgggacctggggaagaggctgaagcggggagcacaggccaggacagaacagagatgcccactgcaggtggatcctgggctgcaggatgacgaagctggagagagggacattcaagcactgacccctcacccctgcaagtggctcagatctgactgtactaaagtgtgaacccccagagggcaaggaccgtggccagttcctctcctaatggcatatgttgcctcgcgcaggggttctcttacactttgacctccaagcctgggattcattcgagcagagctgctgctgcttctttttttttcttttatatatttttttaacaacctgcttattgtttttaaaataactctcccagagctttggcagagcactagatgatttggggaaagtccagcctattcttcataaaaaggcaatctaaattacactgatttggaaaatgttataaatacggggcttgcccgggacacagtttgtgggcaatggaagtgttctcgatgctttgatgtgaagcatggtttctgctgcccctgtcacaggctccaaagcagagtgattcttctgatgatgatgtgaggccacagcaggtaaggaaacaggaagaccatcagctcgataagctgccctattaaccagaagtgattttcagctctctttaagaagggaaaaaattacatttaggaaaatccagaaaaggttaagccagttgcacgtgttggttaaccgggcttgcagcagaagtcactctataattgggacttttttgataaatccagttttgtgtaaatgccgggagaagagaggtctggggcagactcacctcaacatttgtggggactggatcaagagtccagctgcagtctaagttttgaaaagggcaaatccaactaagaaactattaaaacataacctctatcctcctattttggcaaatacatgttcgcaactatttgaaggccaggttcaaatttaaaagttttagaacccctgggattctgcaacaaaacctgtatgcacaggccagcttggggggccaccacctaaactcattcttccaccatgagggatcacttgcatatgtgtcttttgagtttcctagggctgcttgaagcaaggaccaagaactggaaggcttaaaatagatatttcttctctctggggtgctgcagtgctattcacactccagggcccctgtgggctcagggtgatgctagacttcagctgaacccacatctccatccactgtcttgtccagcccctgcattactagctcctatcctggcttccctgtcactacactgctcaccaggaatcactctctcccattgtactcctcaggaactgcacctaagacagcgtgggaacattttaaaggactctgatgcggattccttattgagtatgaattgactctgaagatttagtttccctcttccttgatccattgtcaaagcagtctagtgattgccacccccgaccctgagaaaggagtgtctcccagatcagaatgggaggggaagaagcaaagataaaggcaggtgaaaaagcagcaagagacagggagaaaaagagacagaaggaaaaagagcagagaggaagaggaagaagagacgaagacaaatagaggatgaatgattatccagaggctaccagagggaagaagtagaagataggaggttggacggaagatgtgcacataccttttcttgtttttgcacatacatttaaccaatagtttcaatatgaaaaaaaaaaaaaggacatggagggtaatgagcaaagggtattaggtaaatgctccagctaatcccaaagtctagggggatgatcgtgaaagatgaaagaaagcctctaaaaagagttagaaaatacaatctatggtttaataaaagaagtcagaggtcataacaaataaaaaagagagccatagggtacttaataccaaatatttaaggtgagccttgctttaagcaagtgagctgtattcctgaaaaaaggtttgtaattcagttgtttgtatatgaaatcccatctcaagcaccttgagaaagctcactctttgaagactttttttttttttttttttttgagagggagtcttgctctgtcgccaggctggagtgcagtggcgccatctcggctcactgcaacctccgcctcccaggttcaagcgattctccttcttcagcctcctcagtagctgggactacaggtgcaccaccacgcctagctaatttttgtctttttagtagagacggggtttgaccatgttggccaggatggtctccatctcttgaccttgtgatctgcctgcctcagcctcctaaagtgctcatcggaaaatccattacaatcctttacgcctacagcacacactctcccctaaactcctgtattaattgtagaaccctgcatttctgtgtgtggctagcaaggaccacaatgaggatactgatctgcaatctcaccccaggatagtttgatatggaacaatccaacaggagtcctggtgtctgggtcttgaaggtaagagttaaaaaaggccgggtgcagtggctcatgcctgtaataccatcactatgggaggccgaggctgttggatcacgaggtcaggagttcgagaccagcctggacaagatggtgaaaccccgtctctactaaaaatacaaaaattagcctagtgccatgagttctagaaatgccaattaggaagccaaaagtctgtctaaactggggacacccgtggtttcaaagtggaatggagactcggagtggtattttgtaaatatccatggcccaggcattaaggaagccaccccaagttccctgggagaggagattataaaactgttaggaggttggtggatcaatttctcttttaactttgtgatcataaaaacagcagaaccagaataaccactaatgtagcatcagtgatgtgggcactagggtatccctcctctaaaaggaaaatattaatggtgtcaccaaagagtgggagcctgaatctttaaggtgatctgaatctttaagtgacagaagtcctgcaacttggagtcccaggaatacttataactggccccacagtcaccgcttccccaaaggctacggtaacagaatgaactcaactctctttagccaaagaagaccttttagattaggaaggtgcaaattctcaaattactcagtatcagtttgtcatatgatctctccaatcaaaactgtaagtagatctctttactttctctttagtttaataaatagcattggcaggtggtttcatctgggggtttaatattctcccttgaacagtattttatcgcctgaggagaatgattttgggtgcagaactacaaagctagtctcagggtggactgtgggctgtcagctaaacccattcattaatccaaagggtcctatttgcttatgagtttcatcaaaggcatgtttcaaacccatgaagcagcaaaaatgacaagttaggaagtcataaagctttgggttactcacaaatagtcaaaaccacaaatgtcaaacctgcacctgccaagggtctattgtaccagattctgagctccttgagggtggggaatagggaatgtttctgattcatctttgtatctctggtaactgcaaccagcacagtaccaggcattgtgaatgtccttcacatatttatggcgtgagtggatagatggacggatgaatggatggatggatgaatggatgaatggatagggtttgtgtaagataataatttttaaactcaatgatgaacaaagaaaaccatctttctagaaaagcacgccatgttacattagacatatgaaacttcctcccagttcacaataagtacattccagaaagtttacactttgggctagaatttgcaatatattctttttaaaagcttcttaaaattggtaaaaagttctcctcattctagagcagtgtaagcataaatctttgtattttaaaaagatcctcaaatgcttaatttgtagtcccaaattctacatccaacgcctttaggtcacctatatgcttttctgatgactgaaagaaagggaatgacaaacttttaaaaaacgattaaaaagatctcttaaaaaacattttgcaagtctttgaagctgtcataaaaatcttaggtagtttctgaaaattgtccaaatatggtagtgtcgccataaccaattgctcagcaatcattacagactctgggttagctctgacaaaggaactaatattctgaaaatgaaagtatctgagaactaagcacaggccgcacagaacctgcacgctgctttggcacttgcactacctccagagaccttgggcagatgcacctgaactttcaccaagctgcttggcctgtcctcaaacagacatgccagtgtctcctgcacggggtagctggggagctaatctgcttcactcaccttccatttaagtgaaaccataatctaccccctgcacctcctcctcaaaaaaaaaaaaaaaaaagacaaagccccatagtagtgattgatggcagaacaagggtccttttagcacaaatttacacttaccatgttcctcaactacaaggtattttaataaagttaatctcctgatatttgtgctagaaattgctggtattaagtggcgatttagcagaacaccactgacccttcagcaagctttgcgcccaggagcttaaagcaaacaagctatggcaaaccacctccatccgccttctaccccagcagaactccctttggtatgaaggtcttgatatgaaagatgttgcacttccttctttctgccatatgcattcttgcagcaagaaaaggtgaaggacgggtactacttccacaccatccaaaggcaaatgccccattcacttggcaacatcaccccttagagggttccactgggtaattacaaaatacctgagtggcaactatatgctgggcctaaagtaaggcatcaaaaaatttacccaaaacctttacatctagctcattgcagacgcctaacataaaagggcaccaggaaagagagcagagatatttctagttcggcagatgtctgccaatgcttttctcacattttgaccatcatcataataatcccaatgatataatcatcgataataataatgttagtcataaaacaagggtgactttttaagaaaggttgggaagttgtttcaaactgtgcagggctggtgtcacaggaaaatgtcaaactttccactttaacttccgtttttcaggcatgaacactttgctttgggggaaatctgggcactatgagggctcaacctgagaacaaacttcaagtgtgcaccgtgcctcttttctgctcatctctcagtcacctggactcgttaaaaatacagaactctgggtccagccagactgaaaatcagctctccccccagccaacagtccaagcctggatttccacgaaggcacgcggctctctttacagattgcagatttacatggtaaaaatagaaacgtacggcatcacatgtatatgcaaatttgccaaccaaactcagtgctgaaaatagttatttactatttggcttgcatattggcccagaaaaccttccatacctatttcatgctcatttaaattctttaagagttcctgacccatttaaattccttgagggatgcctggcttcataggcatttgtctgctgctctccccagcagcttttaaagaaatattgcctgtcagtgcagactggactttggaaaaaatatctattaaaaaaatatttttaatatatacggcccccctttcgttaggtctttaagccataatatatacggccccgctttccttaggtccattctgggcactgtttagccacgagtggccttggacctagaattagggcttccttcttgatagctcctttaggattagggacgagaatgcctaagctgtacagctggaaaatagggacagcagtttttccgaaaatttggtccctggacacctacatcagagtcccctaggtgtggggagcagggaaggcttgtgcaaaacgcaagctcctgactcctctctagaaccgctgactctgaatttctgggagtgggactctggatgttgcttttataggaagtttaccatggtgattctggtggcctccaggggtggggaatccattactcagaaaccaccctgaaatcctgaaagtgtgctgctcaggagctggattccgcaaggccagagggcaccgcaggactcaccaccaaatgagggcactgacgtcctgcaggaaggcgggaggtgacttccccaacgtgaccagcgcacactgaggtctgcactgccattctttccaggagcaattctggtgctcacagaagggaccactgttcctaagggcagtgtggcaaattattcccactgcacaactggctgagccaaaggggcaccatctctgcccccatatttagggacgatgactcagtacagtttgggttctacagcacgacagtgtgtgtttaaaccctggccctacctcccactggctacttcagtttacagaggaaatgataacagttcctacctaataagtttattgagagatcaaataagatcaatattgataggcatctgggtgatatgggccaactagtcagcccttaataagcagtagctagctggtttttcttttaaaatacttttaaaatactttttaaatacttttttgtttaaaaaccgtttagaatttacagcattccaaagactctccccagaaagtctatctaggtgaacaggcaagtttggtttggaaaatgaggtgatgatgcaaagtgaagcctacagaaactatggaaccttcttagaaaagtcctctgtactatcctctgctagagaaggaagctgaggtcacctgatattgaaaagttggccccaccatcaagtagcagatagtttcatagcataaattcactgccaactacttagtgggttcttgatacatttggcagtatgctgtttctcatcttcactcacacatttatttgccacaccattatccttgcatgcacacgtgtatatgtgcatgcacacttgaacaataatacttctttca

SEQ ID NO: 411 - DNA, 20001 bp, Homo sapiens
ctaaagatcaggttccagcacagataagtgttgacttcagcccttctgggagctgctgccatgcataccaacagggtcccggcgctgtgctgagacaacccacgcttctaacagggtgtttgtcaacaaaaggatctatgtggggctcgaggaggtcttgaataatgtataaaatccacacgttaaggttgattaaaatcctaagtgcattatccaactggagcaataaagctcttgagatctctgatggctgaaattcattgatcttcaaggacttttgtccttacagcactgtgagacaatgaataccagggacatcaaatccatggcgagtccagcactaaggtataacgcatagggacatctccaagtgaattcatatacaatgggaatattgcatcatatatttgatcctcatatagccagaaataaaaaaatgccaggagtttatctcttttgctaccttttcatagacacaaaataaaagaaaggaaagtgtgagaagccagttactagggttttgaggagcacgttccatgcctcatcatatgccacgtgcttgattctcaagatttctactgccatcagggaagctttgacctctgatctggctcgggagaaacagacccataaactggtgattcctgggagagtcttgtttcatggtgcaccaaataggggtgtggtttcccattagaaaaccactcacaggaaggccctgagaaaggcagattctgggatagccagactccagggtaaaaacttgacctttgccttggacactatgtatgtcctctgcctgtcccaccagtgcactttgaaagcagataactttttgtctgatttcacaggttcacagatggagaggaattttgctccaggatgattcatagcccaagtatcactcatacatggtttagacgattttagatgcaattttggatttagagttgaagctgaaatgggttaggaaatttagggatgcagggatgaggtgaatatattttacacatgagaaggacatgagttttggagagtaaaagggcagcatgttatgaattagattgtgtcccctacaaccaaatttatgtgttgaaatcccaaactccagttcctcagagtatgacctgatttagacataaggtctttacagagtgaatcaagttaaagcgaggtcattagtggaccctaatccaaatgactggcgttcttataacaagaggaaatttggatagagacatgaacatggggaaacatcaaatgaagatgaaataagagatcagggtgatgtttcttcaaatcaaagaaactcccaaccttctctcccaacctctgaacaacaagccaccagatgttgggagaggggcatggaaccaattcatcccggcagctctcagaaggaatcaacactgctaatattgtgatctcagatcaacaaaactccagagctatgagacagtacatctgcgttgtttaagccactcattttgtggtacttttatggcagccttagcaaacaaatatatattttggtatgttagctgagggattactttgttcatatgaaatttgataagtccatcatggaaagcagataaaatctctgggtgaagtggactttgagaacatagagactttcctcccctgttcccgtctccctaaagtggttctggggaggctcctgaggagccctgagactacagtttgaaaattgctgactgctctaaggatagtaaacaacgctgacataatttgacagcaacagccaactagtagggctgcagcagctcctggaagcactgtgtgaaggaggatttggaggcttcactcaggctcaagagtaaagtgtgcagtgacttattagtgatgtctgccacaggcatgggaattgtgaggggaataatcatggaacaaactaactattttccattcctggaccagtgcactcatgtggcagaaaggtcaagtgactgacttaaagctacatggctcttttggaatcagatgtactgggtggtgtttcaagaccagatgtgtgtgagatttattcctctgtctatagatccacactgagtcactgacaaaggcctggtcattcattcagtggagcccagctttccacagtcgtttgactctagggccaaggtgtgcacctgcttttattcttctcatattgctggttgtactgtcagaatttcctttatttttctctctctcaaatttctgtattgggctttttctgtacttgagggtactccttcccctccgggaagcattggcactagaacaatgattttcaactggggatgattttgtcaaccaggggcaataattggacacacgtttggctggtgcaacttgggagaagtgctactggcacctcctgaatggagattagggatgctgctcgacagctgcagtccccccagcaaggagtggccctgccctgaatatcagcagagccgaagttgagaagccctgctctatcgttagcctccctgctgcccatgcttccagaagttgccttatttttccactttctctttcccagagccccagttcccagagtgtcctctccaggcaccttcccataaactcgccagcgcacactgggcaggagcagggggccattctggagatgcctgagaagggtgtgtcttgccagtgttttgaccacacctctctgaggagaaccactaaagcctgggtcccttgaaggaacatattctgatgaaggggcatcacaaggactgtaaggacaagctgttctcctgaaagtcatcctacagactccagttctctcccagtggggcgtcactgccgtctatcaacccctggatattggtttaagaatctcccccaccggaggagattgtctaatttgggacttgggtaatggagggaggctttggttagccatcttggcttattccacagagcttcttgtctctatttctggaaaggaaaaattactttttagagaatcacagaattttagaaacaaaggtttttagaagctcctgttaggggctgtgacaaatccgaaggttgatggtatctgacatggttcatttacacgtctgttgtctgttgtctgtctccactactggatgtgagttcctgaaagtcacgggccacgtctttttcactaaagtatagtcaatgtccagcagtgcactggcatgcaggacgcacatatacaagtttgctgaattaatgaatgaaggcactgattaagtgggagctggaactaaaactctacttgcgtatgtgtgtgtgtgtgtgtgtgtgtgtctgtgtatctgtgtgtgtgttcagacataagaatagtacctaaatagatatttagtagggtttccataaatacttgttaaactaattgttggttgctgcggctgcttccatctctgtgctgagcatttgacatatgtaactcatttcattgtcaccctaaccttacaaggtgggtactagtctctccattctaaaagtgaagacactgtgctcagagaggtttagtaacttgttcaaatcacagtgccaaggagcaacagagctaagatttgagtcttgctctggcagtaaaatccaagcttgtgtgtgctactccccgactttggagttcaagcaaggacatttggggcccatcttgtactccgtgggaccattgggatctttgcacagagacaggcctggtgaaaccagcatttgggaaggagtattggggagcaagggtggatgcaggaaactgctgtcttaccctgggcagagttatccagacaggagcaaggggaaggcaacgagatgggtgggcgacttgaaagaaagaaagatttgcagaatgtgcagggcctgggggcttggaatgtggaaaataaagctatcctgggaaaagagagcaaagttaggagacatgggcatagggacagcaagatgctgagttgattttggagtatgttgagcttgaggctcgtgaaacatctactagagggagacacaacgaaggtaataggatacttttgctatcatacggtagaacccgttaaaaataactcatgcttaaaggagcatatgttggattgtataactgagaaagatgtagtgctgcctttagccatttgtggatctaggggttcaacgaagactccaggtctccagttttctccaggagatataagcttgaggcaactgatggccatgatatctgctcaggatatcatggccaccagttaccccaaacttacatcctagcagcctagaaacttgtagaggcagggggagagaaagagacagaaagtgaacaaaagaaatagaaagagatagggagagagaaaaatagagattgatggattacttgggtggctctaatgacagcttccagaatcccaggtctctggcagtcaatacccctccaagtgtgggagatagggatctctctactggcagcccctctagaatcacatacactggtcagttagcacgtccccagtgagaggcatgagagataggcagaaacataaccagcatccactctaatgcgtggagtggtgttcatcgttcattctgcaaggtgaacatcctagaaaggggatcatccagaaggcaggatcagaggagaggctctgagttcatgactttacctctccccggcctgattttaattttaagaagcaccatctctcagccttttcttgtttcccttcttgactttgtgtgtctcctggtcacagggcctgcttggcaaggaaggaatctaagaagaagagcctaggctattaacacaggtaactgagagtcgatgtatatgaaaaggcagcagcccctttgcagttttattgcttattttattcacagttacctgcaatatggcatggctgcagatggatagaaatatgcttcagtgtaacacatttacagcagggggagaaacggcccccaaaacacaacagctcaatgccaaaagcagactttgcatttcctagactgtgctgctttctgaatacaaagagacagatgattattgcagtaatggacaattaagctgtggtcagacactcaagaagtactttaaacagttggttataaatataacatcaaagtattatgattcacaggagaggaagtttacagcagatcccagtaatggtgtctgagatggcacgtagagctaggattcaaagctgggcaaatgtaggtctttggggcaaatggtgggatagtctgggttggattaaacctgaactttctgagggcgtgtgatggacatggagttgctcaccaatgcctgctttgggaaggattggtggccccagctgtgtggtcaaaagagccttcaggtgatcagcgttcttcgggggttgcctcagcaggagggccctcagacaagagtgattgagaggggtgtgtggcaggctgagccatggtgcccccaagatagccacaccctgatccctagaacctgtgaatatcttgctttatatgacaaaaggctctttgcagttgtaatgaagttaaggactttgagatgtgaagattatcatggattaactttgtgggcccaaggtaaccacaagggtccttgtaaggaggaagcaggagaggcagagacagaaaaggagacgtggtgatgcaagtggaggctgcagtgttgtgctctgaagatggaggaagggaaatgtaggcagcctctagaagctggaaaggatggatctccccagagcctcccgagggagtgcagccctgcagacaccttggttttagcccagtgagccccgttttgtatttctggcctacagagctggacgaaaataaattcatgttgttttaagtcactgggtttgtgataatttgttatagcagccatgggagatggatttaaaggcccagccattctagcccaaggcaggatgatcgaaaaggcagaccattctggctccagggtaccctgtggagtgagccggggcagttattgggtctttttccaagctcaacttctccctctgcccacttctttccatgcttccacaggttttgatcccaagggcaccctctaatagacatgccaacctacaaacactatatctgagttggcttccacgggaacccatgctgtgatattgtatacctgataggtagtatcctacagtgattcggaacatgagtgttgggccagtctgttctggctccccaacatgataaacttgggcatgtttgcttgtctttttaagccttagtctcctctcctgtacaatgggcatgaaaaccacacctgcaaagaagcttgtaatgaggatcaactgacagccacctggaaagcacatggttcaggcctgccttgagataagctgttgataaatgttactgatgagactgatgatggtggaattgacactgatggaggttgatggtggggatgctgatgaaggtgaagagagtgatgtgagaactcccagggcttgtggacacgtatctgatttacagaagataatctaaggagaaagctcataggttctcctattggtgcccaagagggcaagggagagaaacactgaggaaagaaccttatcaggctgatcttctaccttcctcctgcctattcttaatccagagatagactgctgagttctgggctggatcctagtctctgagctggaatccagatattaaataccaggttccagactggacatcagccaacctgggagctgttctttgggattccttctaagtttaatttctaggacttttctgtgccaagatcttgactcggattctactcccaaagacagagattagctgtgttgggtctaagggcattgaagatcatgctctaccttccccaggaggacccagagcctgtacctgaggctgggaacaggggtcatgtgaggatcatgtagacagagagaagacaggaggcaccttttaaaggattatctgagtttacatgacactttttcttttaactcgaaaagaagcataaactacgttcatggatctcaactgcagattctcccttctgccccccaaaaatagccctttgaagggtatgaaaaatgactctcctgcttttgttcctggcctcagagagttcagcctgtcagaaacgcacactttgccagtgagctaccagggatgcttggaacaagaactgcccccaaaatgccaggggacccaaacttggacttaattcacagttcgcaagtcctcaacatggggctagctgaacaatttcaactaaatgaaaccctgcatggttctcctgggctgggcctgtgggtgccatgccccagctgtcagccccgcttcacagctgaagataaatcacagcagaaaatggagtgtaatgaaaacactgacagacccttcaaagtaatggagctcgggggtctcccttttgttgcattccgtatattatgcaattactgccttggaaatggccttttcttcattcctgagaggtgtgtgtccggctatagaatggaaagatgctttcatgcttgggactgtgtgcaggttggattcagcctgggccagatctatccttcacaattggcagcaattttccatttcacggaggctgaaatcagccacgtctaatcactagaatcactacaccaggggctgggcagcgcaaacaggtcagacatccctttaatctgcaattgagttgttcacaccccaggaaatagattttatgctgctttcctgctctgtacaatggggtgtggttgaggaaagaacgacttcgcaaggatgcctgttgagttgaccgtgtcaaaagtcatgggtgggcggcatttagtacctttaggggagggtctgggcacagtggacactgtttcatggtacagctggggtgttccattaggacatgaaatctttaggaaactctgggctattgcctctctgtgacctgcctccggctttcttaactccccctgcctctggaagcctctaactctacaacaagggggcttcctgttggcagcaagtgaaaatgtgtccccgaggaagtgctggggttctttcaaaagggaaacacccttcaggctgacttcagttcaaaaacgaaatatatcgcataaatgtaaagttcattcatattcacgtacagctggatccagaaagcgaactgatggcttcttcatgctggcttcatgcccaggaaagccctttcccctgggccctggaaaatttcaggctcccatgctctcaatcccagaactaatgggataaaaagagatgatgtattcccaatagttctaacatgtttcggaactgagacccatgaactgactgggtaatatgatctaccctaaaccaattgctgtggccagggagatgcaatctactgattggccagggttagagctgtgcccatccctgagccaattgggtggtgaggaaattctggctctgactgaccaggttcaggccatgcctccttctgaagtaaatggtggtggagggagtggagtcagaccatttcaggacatagatggggtttggtagggtggtttcctaagacagtaggatgcagttacccagagaactgaaaattagatgctaggcatgcaaagatgaaaattggtccctggagatgacaccaggtctgtagaaggagctggcaagtgtttggatgattttcttcccaagcaggtggtcgccctcggtgttggatgtaaccttgacccctctcagattcttttttgactacctctgctttgttttctcccctatggtcacacctcacccacacttcttgttcttccatgtctagatgagcaggaggagcacactgtgggtcctgggatatggattcccgaggggctgccaaggggctggagggtgaaaattggaagggtgaggagttagctccctttgagggaaggggaatgggaggcatttggaggcaattggagacgtagatgttcctgctccttccccctctccatgagctccctttataacctccttccagagaagtgttggattcccagtgaacgtgcctgctaagagctgttctattagactcctcttgtggcaataataaattaccgcaaacttagtgacttaaagcaatacaagtttattcttgtatagaatatacaagaaagtataaaatggaagtcagaagtataaaatgagttggcagggttgcattccttttggaggcttaagaatccatttctttgccttttctagcttctagaagccatctgcattccttggcttatggccccttttttgcatcactccaaactcttgcttttgtcatcacatctcccctgactctgaccctcctccctcccttttataagaggccttgtgcctccactgggcccgcctggctaatctatggcacgagtcttcccattgcaaaagccttaatcacaggcaaaaatcccttttgccacataaggtaacatcttcacagattctggggattaggatgtgggcatctctggaagaccatcattcagctgaccacagcttgtgatggctttctgagcctcactgtgaagctctggacagtgcaggactgcattgcattgtactgtgttgcttttgtttgtgtttgcctcacttccccctttctttttcaacctgaccacctggggtggcgcattctaaacaatctgcttctctttgatctttgccccaggcttcattttctgaagcaacagggtaaaggaaacctccgtgggttcacagggtgccttgcatgtccttctcttgcagcacatcaccctctgcatgaccacttgttcattgacatgtctggacaatgatccacgtgcaaaaaggagtcctgtctttctcatctgtgtcttcagcccagggataatcaagtaggtgttcattcttgaataagggaatgaatgaatcagcctttaagctgccctggaatttttggttcaaagcttacttgctctggaaacacttccattagctaaacttctaccctttagtcacagctttcttgacatcagtgcttggtatgtgtgcacacattttcatgcttcagtgagtaataatgcacatacccatgctcaagtgcagagtcaaggaaaaggaggactttgcccctcctacctatatataaccttggactagttattttaccactctccacctcagtttctttgtgaaatggggctaataattacatttattccatagaactggtgaaatgattaattttgatgatacaatagaaagtactgaaggcaatataacccgtctgtagtttcccaaaatgccaatttcaagaacttcttgtgtatttgtagcacctaaatttagttggtcactgcaggataaatcttgtatgacttctttataaatatgtttcttcagtgacattttccaaatggactgctttctagactgtttgtcttggctagactgaccctcctcctccacaattctttcttttatgccaccttctggttagaggtagccatgtgtcagagtcctggacaactcagtataaaccaaaacctgtgggcagtgccttccagaaagcttttttattctttattgaaagggtcagattcagtcagaatatatcatcagcctttgcctccccattttcttcctgtatcctgtagacatgatgcctggagctcctgcagccattttgtaacatgaggccctgagcaccagaaaaaagagtaagaatcttagaggatcctgtccttgactgacagtgacccatgagccaacatcgccagtggtctacctcaagacttcttctttgtgccttttcaaggataataccagaaatttggaggagaggataggaaatataaatgcaaccaaaaagaaagatatcatcaaagaggtctgaatctctctttggattttaaagaattaaagaaagaaagggggactcaaaacaaaaacaaacctctacccatctcccacagtggagtggagccaacttgaaagcagtgaatgtatctatctggtggttggtgtcttctgtacttggcgttttgcctgggatggtagtgtttgctgaacaaacaaaggaatcttttttttttttttcctcacctcttttaactttggccaagtctgtctggcccaccagagcagctgtgatgacagttgtttggtgaatttccaaacactgtactatttaagtatggcacacagtcttagggggccaggcaagcaattggaaagctgaacctggctggccagacctgtgttaccaaaactcatatgtttcatttggatctttaagcagaaaaactttccaaacccttgctccaatatgtaattctccgtggctgatttctagcgaggaaccaaatttaaggtggatagaagaagcatattcattgaaggattggtctgtgttccaaggattgtatgatctaataggggtcatatacacgtcagtaattttcaggattctacctgactttttatcctggacaccaggtacagctgccagcatctcttcacagagcccctgtttactgtgacttttcaaagggcagggatagtttcctagtggccttggaatgccttctttcacagcaccaaccccataccttattcacaatgggggtgcacagccactctataagagagaagatcaaccttagaacgtttattaatatctttataatttcttatagttggggggaagcaaaggcgaaagaacatattcttgagtaatttattctgttccctggcattgatgaaagggataaaattaaatcagtgtttctactcaagttgtttgaaggacaagccaaaatcacaccattaaaagttaacatctaaaacagattgtacattactagggatgagttcagacccaaagtagaagaattggccaaatgaatctatagaatgttggttgtgaggaatttactaccctcatttccagtggttaaaaaataaaagacagattatcttcatttcaggccaggaaggtttgcagaaagagccaaggatatcttatccaagtttaacagggaatgaggtaaatggctaaggaaggtcagagctgcgaggtttttctggagcaccaaattcatcacaagtcatagacctgtgaaattcatgtcaaaattaccagattgtttcccttcttgaaggtacttaaactctagcggaaaataggaacatctgtttaatttctgatggcctaaacaacttactcagtacctattgtgtacatctattgatggtatctttgagtgtgagatccatttatctgtccattcatctattcatccattcatccaaccatccatccatccatccatccacccatccatccatccatccatccatccatccatccatccatccatctgtccatccttatatccattcatccatctatcccattcatccatccatccatccatccatatccatccattcatccaatcatccatccagcatttctggagtacatgtctgtgcttggccctgtgctgaggcagaagatacagtgttggatttgatagagactttgctgttcaagaaattacttcagtgcatagctggagagcagggattttcaacctccagtttgtttatattttgggctggataatcttttgttgtgagggctgtcatgtgcattgtaggatgcctagcagcatgcctggattctacctgctagattcaaatagcacctgccccacctcagtcatgattatcaaaaatatctacagatattggcaaatgtctcctgatgggaaagggcaaaattgccttcctggttaagaaccattgctttagagtcagaaacctaaattctattcctgccttacctctgactggttgtttatttgactaatggttatttaactttttcttattcccagcacccaacacagtttctggcagaaagtaggtatgtgtcagtgcttacagattaagtgaacaaatgagtaaattaatgaataagagtctatatttctaagaccagccttttcctaagcagttggcaggctgttaggaagaccttgagccttgaccatgcacagtgtcaagaaagcaacatattcactcaaaatgtgcctcaagtaggaaaaaaaatccactttgggggtatttagctgtgtaagcccgacagataattgagcggctggatttttcagtttcgacagattggtttgccattctgtagccacaataacagagcaaagtaacaatcgtgtctatgtttaattttctgaagagagctgcatcgccgaggctaacaatctggccaattaaatgtggccgattggcactcccacacaagtttgggggtatttaaaatagctctctgcacaagaaaaaaaacatccaagctgcaaagaaagttgtaactctaccaagatttcatatttcaaaagcaggcttacaatggtaaaattgttctgggtgacagataatagacaagccatctagtttgagtgtattagtgtcaaattgagagttgtctctgttgccagtgatggtgtctatttgttaaattggataatttttcatgttcaatgaaatcatcaagattccactccttgtggactgagtttatgggacttttaaccatgttaatcattcagaaggaccaagaggaccaagagtgtccctcactaagcttttttttttttttttttttttttttttttttttgagacagagtctcactctgtcacccaggttggagtgcaatggtgccatctcggctcactgcaacctctgcctcccaggttcaagagattctcctgcctcagcctcccagtagctgggactacaggcacccaccaccatgcctggctaatttttgtatttttcgtagagacagggtttcaccatattgggcagtcttgtcttgaactcctgatcttgtgatctgcctgccttggcctcccaaagtgttggggttacaggcgtgagccactgcgactggcctcacctagctttctttactaccttaaagcttaagtgaggagtagctgataagaatggaattaggttccctacctgtttcactctcaaatcttctaaacacaattcttgtaggctcgtgttggggaggctgtattagttacctactgctacaataaaactgagtaacaagcaaccataaagcatcattagcatagggcattaacatttgtttagcctggaaatctgcagggattagctgatcttgactggacttagctgattttgagtgttccatgtatctggggttggctgcaggttggttaatcggctctgctgatcttggctgggtttgttcacctgtctgggggttgaatggctgttggttgatctaagatagtcttggccaggttggccaagtttattgggatgcccttcatcctcctgggggatagctgggaaatgtacatgtggtacttgcaggtacaataacttgcattatcccattcgccaaagcacatcacatggctgagctcagaattaagaggtcaggcagattgctctgcccagatagagaggaccctgtaaagttacatggccaagggtgtgggtatccagaggtatgactaattgtaattgattaacacatttgttaattacaatttgtactattaccaaggctatactccagaaggtgctgggccctgacaataaagttaaatctaaataagaaaggtctttatagcaatgttgagagatagaggaagagggaagagagagatgtgtaacttggggaaggctcagccacccagctgttatttgagttctattttctccagcttggaagactgccttcacgctggaaaagggagagtactacaaaaatgaataagagataacttagggccttccagtgccttcacaccagaaaagagagtactacaactatggataaaatgtaacttagggccaagtggatggggaaatcatagctagttctttatagagtccgaatttgcagtcccatgggaattcaaacccaggccattgaaagacttgaccatggaactgtggttatgaggcatcatgaaaaatggtaggggctcctaaagaatgtaggttggtttttatttttttaatttattttgtatttttttaagttctggggtacatgtgcagaatgtgcaggtttgttacataggtaaatgtgtgccatggtggtttgctgcacctatcaacccatcacataggtattaagcccagcatgcattagcttttttccctaatgctctctctcactccccccagtcctcccccaacaagcatcagtgagtgatgttcccctccctgtgtccacgtgttctcattgttcagctcccccttataagtgagaacgtgtagtgtttggttttctgtttctgcattagtttgctgaggataatggcttccagtttcatccatgtcctgccaaggacatgatctcctttttatggctgcgtagtattccatggtgtttatgtaccacaatattttaattcactctattattgattggcatttgggttgattccatgtctttgttattgtgaatagtgctgcagtaaacatacatgtgtatgtatctttataacagaatgatttatattcctttgggcatacacccaataatgagattgctgggtcaaatgttatttctagttctaaatgtttgaggaatcaccacactgtcttccacaatggttgaactaatttgaatgtagttggttttaaatggtcgacccttgatactggaaaggagacatttgtctcactgtgacatctgcaaattagtcaattctcaagtacactggagaatacaataccccctaaagtgcagttaaactatctaaaaattcagaatatcaattgttttatacacatagccccaaagtcatttctaaagtgattaaaataaacacctctcaaattgtgattccatcaagtgtcttcttattcatgtcctctcatgataatatttatgtattcaacataataataatgtgaactaatatttatttccttctttgtgtcggccattgtgctaagccatttacatgcatagtctcatttttattctcaccatgatttcatgacatgggtattgttattattatcattttacagttgagaaaacagaagctcatagaatcatatccaaagcttataccacatctgcctgatgactgcttgtgctcttaatcccctcatgttggctacctcttgaaaagatgaattgtaatagggtgaaatagaattctggaattccaactcaaaatatcagaagtgcaaattcaagatttggaaaccctggcttgccagtaattgatgtgattaaataccttagggcttttttttttttttttggatcacaagttcaataggagtcaacagagtgaggatgctgcccagaacacccaagtaagcctccattcctttgcaaggatgcatgcgattctgtactgggacagcgccatttggggcacctgattcattcagtggtatgttggtgcaaaagtaattgcggtttttgcaatttttttttttttttttttttttttttggtggccaaaaaaaaatctaaattattttgagattgattgattgattaacgacacctgtagcttttgttttgcagtgacagaattgtaaggttattgacagtttggagggaaattgacattgacagtttggaggggagttcccactgaaggggaattaggtgaaaaggagttttggaaaccatcatttgtgagaaaaaatttaaacaatggaatatttgtaacctacaacccagaagacttcagggtgatacggataactttcttcggccactgaatgtattccatatggaagatgggacactcttgcttagattcagaaattatagataaaacttacatgatctgttgggacagtggttgcaacctgggtagtgaattggtatgagatgtggtgagctccgtgactttagccatcagacagggatgttttagagagggctgctgccctgaggaggttcttttctgtgtgctgagtcttgaaatgctgatttcagcactttatttagtttgcctgtgtgctcagccatcatacttaacatatagttagggaagtggtacttctgctcaacaaaatcacaaatgaaaatagcattttagaggacagatgttgactcctcactcttgatgtttcgcttcatggagggagctatggtagtttgacacccctgggctctctctccccctctactcacgctctaccattgaaggaagagggaggctagatttttgcactatacaaatttaggagtctgtagagtgcagtgacacacgcctgtaatcccagaactttgggaggcccaggtgggcggatcacgaaatcaggagtttaagatcagcctgaccaacatgatgaaaccccgtctctactaaaaatacaacaattagctgggaatggtggtgcatgcctgtaatcccagctactaaggaggctgaggcaggagaatcgcttgaacctgggaggtggaggttgcagtgagcggagatcacgccactgcactccagcctgggcaacagagcaagactccatcttaaaaaaaaaaaaaattaggagtcataaacataacattcttcgttcagaaacttcctattgttttctcaggagtgcatgagctgcaaaaagaataattcctctattcttttccaggctggaacatcctgtgccctcattttgggtggctgggtgcccaagttcagtgttgccattagtacatggataaatctgtcaaatttagaggttttgcactaaaaatcagctttgctttcacctcaacaatgccctccagtttaggcttatttgggaatgagagcgatgtgctgccttccatctgcctctccctcatcttatgtctcaatttgttcagaattcaggaggagaagaggatgctgcttagcagctcctgaataacccaatcaacaggagatggaatagaagttactgaggtgctacacattgaacgctgactctatgagtctcggggctttccctgcgctccttcctctaagtgtgccaacaatatcgctgcttttaccatccccagttcacagactagaatgatgaggcttgtccaagttagcaagtaataaagcaaatgtcagcccatgtctgcctgaacccctggtcaaggctttcaaatggtgtacaatgaagtgtcttgagccagagaggatattggctgtcagaaaacggaatgcctactagagctctgaggagataagaatgacaatgggccttagctggtcaaagtgattaatggaggaagagaaaaagagtgtggtcaagaagtagtattctctcccaggagtgacaacagcaggaatatcgtcattgtcatcatggtcagatttttcatcctcatctgcaccctaacagccaccatttgttgatctttttttttttttttttttttagatggagtcttgctctgttgccaggctggagtgcagtggcatgatctcggctcgctgcaacctccgcctccctggttcaagagattctcctgcctcagcctcccgagtagctgggattataggcatgcgccagcatgcccagataatttttctatttttggtagagacggtgtttcaccatgttggccaggatggtctcaatctcctgaccttatgatccgcccgcctcggcctcccaaagtgctgggattacaggcgtgagccacagtgccacactacagagtagtgcctactctgtaaactttttaactgctttattgtagtataattgctatttaataaactgtacatatttagagtatacaatttaatgtatcgacatacaaatcacccatgaaaccatgatcacaatcaagataatgaacacatgtatcaccctgaaaggtttctttatacctctttctactcccttcttttttccagtctcccctactccccagttctgtccccaggtaaccactaatctgctttctgtcactatagttacattttctggaacattatacagataaaattttggtttggctgcttttacccaacataattatgttgaaatttgtcatgtgatggtgcatatcaacagtttattcctctttgttgctgagtagtattccattatatgaatgtaccacaatttgtctatccattcacacgttggtggacagctggattgttttcagcatttgactatttacacataaagctattgcaaagacccatgcacacgtctttgtgtgtacataggctttcatttcacagcctgtgtttagtcttcacaacaagtgaaaggcacaatgcaattacaatcccagttacatagatgaagaagctgaggtccaccaaggtcaactacgctgcccaaggccaccagctaatcgacagcagggttaatgtttgagggcagagccttctgacaactccaggctcaaagcccctgcacaatactacaccccacactgagaggaatgctttcatttgaaaaaataaagatgtttattttttctctgtaggaatgtaattctcagcctatctctactccctgtcatggttacctatatcggctgcagcacacagaccctcagaggtcaagacgtaccttcccactgagtttttttcagtctacccatcaactagagataagataaatcctaataggggccaggatcttttgctgtcaagaatatgagattgtatcttcatttatggagtaacttttacaccctgaaaatgaggatgataaaaacaaggcaggtaaagaaacaaagacagtgtacacatccttgtgcatattcacaatgcaggagctgaaaattcggttgatgcaatgaatgtataaagaattcaagctcagctacagaattctggttgaaagttcaattgctgccaatccccttgggtcccaagcaagcattttgagggaagctggcccacatttccctgttcaaatctggtctctggacctctgtcatatgcaccttcctcattctgattacccagttgattgatggattcatgtacc

SEQ ID NO: 412 - DNA, 20001 bp, Homo sapiens
ggacctgacccccttcagggattggttttccaggtggatggatggatgaagtcaaagagacaagcacaccccacagacacatatacatgcacacactcacagatgcacacacataggggcatacaagtacagctggccctccgtatccatgggttccacaccagtggattccaccagcaacagatggaaaatattctgggagaaaaagtgtctctactgaacgtgtacagactttttttccttgtcattccctaaacaatacagtgtaacaactatctacatagcatttacattgtattgtattgggtactataagaaatccagaaaggatctattttatttcattttatttatttatttatttatttatttatttatttatttatttatttttgagaaggagtcttgctctgtcaccaggctggagtgcagtggcacgatctctgctcactgcaacctctgcctcctgggttcaagagattctcctgcctcagcctcctgaatatctgggactacaggcgccgcccccgaccatgcccagctaatttttgtagttttagtaaagatggggtttccccatgttggccaagctggtcttgagctcctgacctcaggtaatctgcccacctcggcctcccaaagtgctggggattacaggcgtgagccaccacaccgggcctagagagcgggcctagagaggattgaaaatacacaagagggccgggcgaggtggctcacgcctgtagtcccagcactttgggaggctgaggcgggagaatcgcttgagcccaggagtgcaacatggaagaaagcgtagcgctccttgtgtacacgcagcagcaagagctcacccagctccgctgagcagcgcactttgtacttctgtacctcaggggaccaagacagcaagcaggtgagaggcggggaactgccaaggcggtccttgagccttgcaaggtgcatctccacctaagcctattcgggcatacaaacctgagctgctcccagcccataccgggcttttgtatgaactagaaaaatgtgcccaggctggacgcggtggctcacgcctgtgatcccaacacacaagaagatgtgtgtaagttatatgtaaatactgggactttttttttttttttttttttgagatggagtctcgctctgtcgcccagagcgacatgcagtggcatgatctaggctcactgcaagctccgcttcctgggttcacgccattttcctgcctcagcctcccgagtagctgggactacaggcgcccgccaccacgcccggctaaatttttgtatttttagtagagacggggtttcaccgtgttagccaggatggtctcgatctcctgacctcgtgatccgcccgcctcggcctcccaaagtgctgggattacaggcgtgagccaccgcgtccggcaatactgggacattttatataagaaacttgagcatctgcagattttggcatcccggggaggtcctggaaccaatctctcaaggataacgagagacggctgaatacatgcaggtccacacgctcacataagcgcgcgcacactcggaggagcattcgcgcacacagaggctcagcggcagcgccgcctgcagcccaggcacctggatggcgatgggcatcatcttgccctcgggtccaaagtgcagcaggcagaggggggcgcagtggtgctgcttccggccgctgagctccacggtggggatgccctccatgatgcggtagtcggccaggtaaatgttccccttctggaggggagccgcgatgggtggcaagtaggcacccacacgggaagcccgtgacccgcgccgcaggtgcacagggcgctggcgactaggggcaggggtgggacggggacagggacgcggggtgcgggcttgcctgggactggcgcgggcgccggaggtggggagagacggggatgcccgcgagggaggccgggaggagggccggggtctccgccggagcgggcctcacctccagctccgcttgcaagcacgttccctcgcccaggaacggagccaccatgtcgtctgtgacggggaacttgtctgggatccgcgtgcagcggcggatcaggccggggttgacgccgttgaggtactggtacccaaagaaggtgtcctctgcccagtgctcggccacgtactctgcgaggacggcgcgagggcgtcacaaggaggcccggcccccctcggggacggagaggcatgggacagaagaagactatgggcaccgagaggagtcggggaggaaaacgaggcccccagcctggcgctgagcggccggaggagcccggtgcgacattttccaagaagccgccagagggcgcgcgcgcgcctcgctgcctctcccgtcccactgccccgaagtcgggggcctgcctagcacgccggagaccgcctggctccccctgctcgatccgggacgccccattccataccggagacgacagatttcttgccagggaaaattttcctaatgtccttcagcctcttccacgaatgtttgcagtccaacaggccgcggactttgaaagccagtgccctaggagatgggattccaggaagaggccttcagaggggctgccaagcgccggctggggcaggtggcggggccgccccatccacttaggtctctgggtctcagggtctgtgcgtcgcaaagtctctgggtcccatgtctcaagatctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacggactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctgggcaggccaggaagaaagactcgccagctgcaagggaaaccgagatgtcaccctcatgcccgtgcaccaccccagggcaaagggccagagccatcactgccccccacctccctggacccctgccgggcgcccagactctgccacccgccccctcactggtagaagtcctgcttggctctgatctcctcttttctgtgctccaggaggacggggagcgagtcatctgctgttgtctttcctgtagggagaccaaggagaggactcaagggctgacccttgcccctgcccacttcaggaagcaggagttcagcttctgtgccccaggtcgtctctgggggggcccatgaccaaggagtgggaaggctcaccttgggagagtgaaggtgcgtcctgtccggaaatatcagataaaagaatcacggacccaccctctttcctcttgctctactgtcaagctaagctctgctgctgcaaaaagtccctcctctagacccactgaaatattttttatttctataaattcatggagtacaagagcaatgttgttacatgcatagtggccaagttagggctttaggttacccatcacccaaataaagtatattgtacccattaagtaatttctcatcatccaccccctcccatcctctcacccttgagagtctccattgtctattgttttgctatgtccatgtgtacacattttttttttaatggagtctcgttcttgtcacccagcctggaatgcaatggcatgatctcggctcactgcaacctctgcctcctgggttcaagcgattctgctgcctcagtgtccggagtaggtgggattacaggtgcctgccaccatgcccggctactttttgtatttttagtagacacgtggtttcgccatgttgtccagggtggtctcgaactcctgacctcaggtcatctgcacgcctctgcctcccaaagtgctgggattataggtgtgagccaccacacctggcccatgtgtacacattttttaacacccatttatgggtgagaacattcggtatttgactttctggtctggcttgtttcacttaagataatgacttctagttccatccatgttgctgcaaatgacatgatttcatttttttcatgactgaatagtattccactgtgtatatataccacattttctttatccagtcatccattagggcacttagggtgattccatatctttgctagtgtgaatagcgccacaataaataaggcatctttttgatatgttgatttcttttcctttgggtatataccactgaaatattaataactgacagttgtttagcacttactaggtcccaggtattgggaaaagggcttgtggggtgcctgtataaactggccataaaaatatgtgacagtaagctgtggaaagtcacaaaaggcctctgaggaggaaagcgttcttatcgccattatgttcccatgctctgagcgttaacctgctgtcttatctataaacactgtgttcaaggagaaagacactcctttgaaacctggaaggtggacagacgcgcaggctcctagttaagcctgttcccactagctgctctccgataagttaaagatgtgctgtttgagcacaaaggagattcgtttaaaccgctattgctatagattacgcctgtgacgcactgcctccctttcagtgtttcaccctgaacatctgcttcttagatctaagtgactgtactcaataaatagtgtggagaccagaactctgggccttttgcagcctccattttgcaactgcctccctggcccccactctttttgcactcttaacctgtctcttctcattccttcgtcaccaccggactttgggtaccctacaggtggtgttgaggctggtccccaacaccaggcactttgtagacactttacttttattaatctaagcctaagaagcaccctatgaggcaggtgactattactataggctggtgaccccttcgtcacaactgcaaagtacagaaagctgtggaaatcaagtttgtctgtttgttccacaacaaattcattggttgacaaagcctgctgtgaatctccctgaggctatatacaatctttatttaactcactgggtctaactattcatagtttttactgggaagtgttagtatatttgattggggtgccctgtggtagatatagcacataatatatggggtatgtgtgtgatatagatttatagatgaagatatatatgtatacatatacatattttatataaacatacacacatgtgtacagatacatgtgtatgtagcttctcaataaaatccgaatttcaaagcacccctggaatcaacagtttcagctaaaggactgtatccccatgcccattttacaaggagaaacagtcgctattatgtattacgtggggacaaggctggatttgccccgtagtgggctgcttctgaccaccaacagttgttaagccttttaaaattctgttcaggccaggtgcggtggttcacgcctgtaatcccagcactttgggcggccaaggcaggtggatcatgaggtcaggaattcaagaccagcctgaccaacatgatgaaaccccatctccactaaaaatacaaaaattagctgggtgtggtgttgcatgcctgtaatcccagctactctggaggctgaagcaggaaaatcacttgaacccaggaagcagaggttacaatgagctgagatcatgccactgcactccagcctgggtgacgaagcgagactctgtctcaaaagaaaaaacaaaaacaaaacaaaaaaaaacaactccgttcagatgtcatcttattggattctcacatccaccctatgaagtaggttctgttgttatctccattttacagatgagggaaccaaggcttagaagaatttggaaatgtggccgggtgcggtggctcacacctgtaatcccagcactttgggaggccaaggcaggcagatcacaaggtcaggagatcgaaaccatcctggctaacacggtgaaaccccatctgtactaaaaatacaaaaaattagccgggcgtggtggcactcgcctgtagtcccagctactcaggaggctgaggcaggagaatcacttgaacctggaaggtggaggttgcagtgagccgagattgcgccactgcactccagggcgacagagcgagactccatctcaaaaaaaaaaatttgaaaatatgcccaaatgtccagctagtcagtggaagaactgagacctaagtccaggtccgtctttctccagcaccctggctggtggtccccaggctggcctgtgcctaccgctgcagcccatcatttcccctcaagtcccttacctcaccaccctctccctcctccacctgcctcagctcatgttgtattctggatgaacagtgctccctggagttgtgcaacccagagacctagctcgttttcatccccagggcggaagactcactcctttgagggccctatgggtgactcaagtctccctgtcctgttgcgtggcagcggccccacccaaccccattcctgcctggccaccagcatcaccctgcctgtcccctgcttccatgtcacccagacctgtcactgcaggaagatgctctgtgtccccagtgagaccctccccttggcatgctcaccatctcccaggctttcctcgcctctcctttccccagctcaggccctgttccccaatcctgggggaagattccagcacagggcaatgagaaacggaagagaggtagtcagctgcagggaggatggggcttcgggccctgggtgtcctcagctcagcctttccctcccattcgcctcaagggaagccaacagacactcaggtggtggaactgggagataagagaggacaggcccccagtcctcatgcagcaccacaaattaggaagctgaccccagcccaccacacaaggggctctggcaggggtgggtgcaaggagctcagccactccggtcctatgtctctcccatgggagtaaccaagcaagtggaaaacccactgggcagccttggccagccttaaccttggagaaaccctgacagtctatctgaataacagggcccctattagatagatccttactggattaaggggggccttttggagtaacagtgcatcctgttagagaaatatggtgtcctgttgggaaaatagggagtcctttggagcaatagaacatcccatcagtctaaaaaatgctcaattagaaaactggggctcatgcctgtaatgccagcactttgggaggctgaggcaggcagatcacctgagttcaggagtttgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtctcaaaaaaagaaagccagggcgtcataattataagaccgcagcaccacggagacctgttgaactcaaagggcttctaaatgggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacgtggccgggcatcttataggagtcagggaggactggagaggtagcggggagcgcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagaggcctcacggccataggatggagcagggtgatgagggcttacctgtggcctcccggagtgccagggtctcgtagccatccatccactggtaggcggggaagtggtagatacggccgttgggggcacagatctgcacatagttgcagtaccaagggtccttggggaagaaggcgtaccgctctttgtgcaggcggatgatgatgagctcacccaggtcctgagggcactgcacggtgtactggcccacctaggcaggatgcaagcctggctgagtgggcaggacttcaccccggctcccaggccgcccacccctctggcccctcacctaggccctgctcatgctgcgcaatgctcacctccctggactgacggagggacaggatattgacctgatcattgagcttccttctgacttctccagcttgggggtctcctactggattcctctacccagggctatgtaggactccagcccctccttctctccatccccagctcctgtcttctcccactcccctctccaggcacctgaggttgcaggaacccttcagacccctggggacttgggtaccactctacagttttcgagtggggagaggcccagccagccccttctcccattcatcaatgaagatgcagatattcagaatggccacatagatagagtgacctattaaggtcgcctagcagcaggtggctgggtctgactgaaaatcaggtctgaggacccgcaaagcgtgccttccactggacaggctggtctgatgccattttaagtcacagagaatccagtgcaaatgtgagacagttaggaggcagctgaattaggaagagtgactgagaatggaagagagagggatgcgggagagggggtaagacagaaaggggaggagagcaaaggggaaggaaagcaggtggaaaggattgagaaaagagagatgcaggataggcagagacagggagagagggctgaggaagagggagagagaagaaaaggatggggagggagatgaggaatgcctgaaagggttagagatgaaggagcaggatggagaaggatggcccagagatctgggacatgggcgaggggctggaagccagctctggacaaggcgtgtagagccactggggagcccactgccttcggagctgtgcctcagctctccagcctctcctcgccaagctcagctcacctggctccccctgcgcaccttcacccctcccggggccacaaagacacacagacacacacagacacacacagacacacacacacacacacacagacacacacacacacacacacacacacacactcttaccgccccagttgcaaagtctctcccaaagtggttcagcagctgcttatggctctctccttgtgtccccacaatggtcagtgagatggagtcccgtgttcccgacaagaggtcggtgcctgtggccaccctgactttgtaggtggccatggctgctcttcaggaggcaagaggggcactcagtcccagacaccgtggaggggccacacgaaggcccaaggcaggcaagagaagccaggcacagagtggagtggacagggctggcctccgaggtgcagtggtgaggtggcgaggtggggtgactaggcctgccagccaaattctggaaaagctgctgcccttggtggccggggtgggtgccgggcaggcccaggcggagcccagctggtggtgagtgagcaggtgtctgggctccaagccttctgggagctggtggggaggaagagcaggcagggcactgggcctgcctctgaaagggcggatagaagatgccgtggatgaaggcgccttcagggtgggggagccagtccagcctgagccagggccctagggaagttgcgggagggggcagggtgtggtccccagatctttatcagactaataagctccttcctcctgccagtccccattggctacagtgccaggcacccctactaagcagggccatgggcagtgagtgacttgcattggttctgaggccactggtgggcgggggagggtagggggaggggcactaagtggcagcgcagctggccagcctccaggccattcctctctgggaaatgggacaggtagtggccacagtgagaaagctggcctgtccttctgccccagggcccagagtctgtgactggaagggtgggaggtgttgaagctagggctcggggaccacatgggtgcccaaaggcctgaagatgctgcggggaggaacgatcagggtaggagaaggggatctgttgcttcctgtggggccaggatccactggtgagggattggagttggatataaaatcagaagcccaaaaaaaaaaaaaaaaaaactaaattagaagacagagtgaaatctggggcataagaattaagttaaatagctgggcgtggtggctcacgcctgtaatcccagcactttagaaagccaaggcaggtgggtcacctgagctcaagagttcgagaccagcctggccaacatggtgaaaccttgtctctactaaaaatacaaaaattagccaggcgtggtggcatgcgcctgtagtcccagctacttgggaggctgaggcaggagaatcgcttgaactcaggaggcggaagttgcagtgagttgagatcgtgccaccgcactccagcctgggcaacagagcaagactccgtctccaaaaaaaaaagacaaaagaattaagttaaataatggattaatatgatcaatattttgtggtataatcataaaatagaattctacccaggaataaaaagaatgaactgcaatgcggatgagtctcacaaagatgatactgagcaaaaagagccagacattaaaggggatacgttctgttatccattgataggaacttccagaaccagcaaaactgagcaattctcagacaacctctactggtgagtatccctggcagagggaggccatataggctgctggaggtgttcttatcttgatctgaggggcgtctagggtacttcattcatttcattatgtgttatcctttaatttcataaagtacataccctcacttccctcccaaaaaagaatgaagctaggaagagggctggaggcagggctgagctccagtggaactgtgtttgttgggaaccaggtcgttcctccctcagatatgtagtgagcacggtgcacggcgttctaggcactgcagaggcagagaagaaatgaaacatacatggagcttacggaatagctgggaaagaagtgaaagaaacagtaaacaagaatttgttcactataattttggatactaagtgctctgaagaaaataagcgtgggaggttgggattgggaactagttgctgatagaatcacagaagtcagagccgcaggatagggagaaggtgttaggagtaaggtgaagagcattatgagagagtcagagatagactctccaaagataggatttgggacccagggagagtgaggaggcaggcacgttcctattccctttttctggacctgtcctctttcctttcacctccgaggagcagcttctgtcaaccaggaagcatagccctgctttcctccctgatggcacgcttccatcaccatcgaaggaaggtcattcaatgcccaggccaagttagggtcagagggggctgggattgtgagatgaagagaaggttccagtaggttccagactggatgtggaatggggtcgaaactgcaattcaggtttaggttagagacacagatgtggctggagttggggattgaaatgatcttttccagacccaaatctgttcacatcactctctatgttccctcctcccaaccctgatcaagcctggcagtggctcctctttacctttgggacagtgacaccatcccctcccgtggcccccacggcctgcctgattggcttcacccctcacattcccctttgctctcttctgtctgggaccacgtgcctttcattcattcatcaacagacactggccgaacccctactgtgtgttcagcgctgtgtcaggtcctgaaaatacaatgcgatcaaagcaaacccctgcacccatggagcttgccttcaagtgagggaagcagacaatattacctagtaaccaaatacattaaatagtatgttaaatagtgataagtgctgaagagaaaagagagaacagggaaggataatataaaaaatagaggagtgccgggcatggtggctcatgcctgtaatcccagcactttgggaggctgaggtgggcggatcacctgaggtcaggagttcgggaccagcctgaccaacatggagtaaccccgtctctactaaaaataaaaattagccgggcatggtggcgcatgcctgtaatcccagctactcgggggctgaggcaggagaatagcttgaacccaggaagcagaggttgcagtgagccaaggtcatgccattgctatcaagcctgggcaacaaaagcgaaaatccatctcagaaaaaagaaaaggaggatattttagatacagagtggccaaggagggctccttgggaagaagacttttgagtaaagacctgaaggaagtgaagtcagctcgtcaccatcccagggccttggcacatgctgttccctctctacctctcaaactgaggtcacgtttcctcttcctcctgatcttagctcaataattgctttttccaggaaagccaaatttcactatacatggctctcacagcactatagctaacatctttgattgatgtctgttttctctaataaattagtccatacttttttttggttttgtccccatctcctggtgtcatacttggtacctgggagacaccgaaaacatagttgaatgggttaatgacaaggacaaggtcagggctggggattgaatcgatgatggctttggagttatggtgaagatccgaagagagctgacttgggctcagggtgagagaaggggcaaggcgtggtgtaggggagggaaaggggttgggtggggagggagggaggagaggggagaaggctgaggatgagggttgtgcccagctctgggtggcagggctggctgtcctgggctgcagacagaagccgtccagctggatctcccccctgggatctccctcctcaaccacctcgatgactcttggaggatgctgggagcctgaagatgcaaatcttaagatgcaaattccatgcaaattctcccagcttcctctttctaatctctcccctttgccctgtgtccccagggggctgctgaggcttggtgagaagcagggcagtggactgggcaaactgagtcatatcctgctaccaataggtctcctccaacccaaatcccagggtggccctgggtttgctcagggctccagtgtggagtgggaattaggttcctgagggagacggagatggaggcagggatgctgaggatgtcaatgtggctggggcagggacagggacgggatcaggcatgaggatgtagatggggcactccccagctatgaccaaaacgtagacgcgtgactcttgataggtgctcattgggctgaagaactggttctcctggaccaggggcgggagccagtgaggaggagaggtttctgggaaggattcacactcactggggttgctaactaggggccatccacacaggaagctgagttctcactgctggggtatcccccgtgcctgaccccaccccaagccctgcaaggcaaggagcaactaactcctggggacccactctcctaagacacagagaaagaaaaatcaaatcacgccactcccctgcttaaagttcaccagagcttaaaatggggttgtccgtagaaatgaatccaagggccaggcgcggtggctcatgcccataatcccagcactttgggaggccaacacaggcggatcatgaggtcgggagttcaagaccagcctgaccaacatggtaaaaccccgtctctactaaaaatacaaaaattagccgggcgttgtggcacgcgcctgtaatcccagctattcaggaggctgagacgggagaatcgcttgaacaggggaggtggagattgcagtaagccaagatagcgccactgcactccagcctgggcaatagagagagactccgtctcaaaaaaaaaaaaaaagaaagaaagaaagaaagaaaagagacgaatccaaggacttatcatgtctacaagaccatgccttcccgacacctttttccagccactctggccttcttgctgtacccagaacatgtgtccttcaggacccttgcatttgccattcctgggtttgtaatacccttcccccaagctgttcaagctgtttcaaccaagctgttcaagctgtttcaagagtggttttgtttgtttgtttgtttgtttgtttgttttgagacggtgtctcactctgtcacctaggctggagtgcagtggtgcaatctcagctcactgcaacctccacctctcaggctcaagcgatcctcccaccttggtctcccgagtagctgggaccacaggcgtagtccacctggctaattttttgtatcttttggtagagatgggattttgccacgtggccgggactggtctcaaactcctgagctcaagcgatttgcctgtctcagcctcccaaagtgctgggattacaggagtgagccaccgcacccgaccctaagcgtgtgttgttcatgtcatccaggtctcaactctagtgtcacctcctcagagtccctccctgaccaccgtccctcatgtttccccgccctccgccctccatcatgctaccctgccacctggttgtatctccaactgcacttgccaccgcccaaaaggatctttatctgtttattgatgcgtttattgtctgtctctccagcacccataagaagggtgaaagaaggggttgtgcctggggagctcacagctgctctcccaaaatctagaacagcatctaggcagacaagagccacgaagcaaagcgatgctaggatgtcaacgctggaaagggcttttcaggtcttctcgtcccactcatgtatctgacaggttgggaccactgaggccgagggacttgctcaagatcagctggggaaggaggctggtgtgcttcccattataccagttgaccttttagactgaccaaaaaacagtggagggcagagtgtaagctgaggggagctcctgacctcacagggctccagaaacttgatgtgagcctcctccccatgtcctgtccccagagtcagggcaggacatcctaagtgtaccaggtgtgtctgcccaataaatctctttccaagctgcctttctggaaaaccagattccaatgacccgccctggtccctccctctccggctcaggggcatttttcaggataggcatgcctactaatgctgcctttgtggaggcccaaggagtgttcatcctcttgggggacagggtgcctgagcatgcccatgcccttttcactgctgcttccaaccccagggtcaaaggggcctgcactgcgcacccaacaataatactggcagctgtcacttactgaggagctatcacgtctctgtcattgaatcagatcctttgcatacaccattttaaaatatgaaacaggccaggcgcggtggctcacgcctataatcccagcactttgggaggccgaggtgggtggatcgcctgaggttgggagtttgagaccagcctgaccaacatggagaaaccccgtctctactaaaaatacaaaattagccggggtggtgtggtggtgcatgcctgtaatcccagctactcgggaggctgaggcaggagaatcacttgaacccgggaggcggaggttgcggtgagccgagatcgtgccattgtactccagtctgggcaacaagagcgaaaatccgtctcaaagaataataaataaataaataaataaataaataaataaataaataaataaataaaacaaatacatagctctatttaaaatgcttggcagccaggcgcaaggtcaaaggggcctgcactgcgcacctagcctcagcctcaccctcacccctggtggccacaagggggcgcccctgagtatttcttagtcctttgatttgttctacagtgaacaaaactggtgatttgggataagtccttaggttgcaatctgcatgtgagatatctgcaaacacacctctttagcacagtggtatgaggatcctcttctccaaggatcacagatgcagaaagtgaaaattcaacagccaaagacagccttccccaacacacacacagacacacacacacacacacacgcgcgcgcgcgagcaaagggagaagtggtttggttgacaacagagaagattcttgggctgggatgtaatgggacagttggccgccccagaatttcaatatgccagggctttgggatggcaatttagttagggaggaaatgtggttaggcgtggagctcttcgtggagctgcggttgtactgaaaacacatgttgttttcttttcttttcttttcttttctttgagatggagtctctgtcaccaggctggagtgcagtggcacgatctcggctcactgcaatcttcgcttcccaggttcaagcaattctcctgcctcagcgtccggagtagctggaactacaggcgcacaccaccacacccagctaatttttgtatttttagtagagacagggtttcaccatgttggccaggatggtctcgctctcttgacctcatgatccacccgcctcagcctcccaaagtgctgggattacaggcgtgagccaccgcgcctggctgtatatttcttagatgatttaagatatttcttagattcttagatgatttctttgttttcttagacaatggcagccccagccaaggcagcctgtggatccccactaactccaggaacgaacactgaccatggtctgcactggggctgagacacactgcagcccgcaaagcccccagccacgtgaagctctgggtgggtcgcctattacgttgacactaaaaccatctgatccccctaccacgggcaccacagggatgggggagcagttaccctgtcattgtccaaagacactgtgatcccgccagagagaggccatgaccagggttgggtcaggcacagaatttgactcaggtggcagaggaaggaaggaaggtgggctggatctgaggtctggggaagcagaaaaccagggtgttgggcggctgtggattaagaagaccggggagactgacttgaggctgcacagatctctatgtttaagggctgtggggctggaagggagaaaatcagactccccatattaccagccatgtggccaggatcaactagactataccacagtaacaacccccaaattccagtggcttcacctgacaagtttatttctcactcagtccatgtctggctcagtcagcgggggcctcttctacagtcccttggacacacaagcaagtgccatctcaacatgtgcttccggaagggagaggcagagagaaggaaatcaggggtctccgtgtggcctggagacgatcctcatcccttctgctcccaactcaaccaaaactcatcctgtgactgtacccatccacaagagggccagaggctgagccttccatgtgtccaggaggagaactggatttcggtggcaacgttaacaattacccagactctgaggcttcacaaaatactcactattccacttctcagtcccctgaatccagacattccctcacctcctgatgatgcactctggaaggtgagggcaggaatatatggcttggctggatagtgcgttgagccgggacacttctgtctccagaatagatgatccacggatccactgctgcccctcactgcaatcccctggcacccccaacctcacccacccatacacacacacacatcaaagcagcaaaacaaaatgagagccaaatattttggtttttattgaactcactgggctcaaggacagaaagaaaaaaatgggatgaaagggagtgggatgaaaggggagttggatgaaatctttggagaaagacagatctccacaaacaccccaggcctgggaacctgttcctgagaacagccgttaggggtccaggcaagctgccctccaattcttcccctccccttaaaggtgctagggacaaaggggaccacatgttagacccaggcacacagtccttctgtgcccagtttccaggcttttccagagaaggaagctgggctggtggctctaggcttggaagaaagagaacgtagaaaggcatggtaggagaaggagtttggggattggggaggatgagggagaaaagctcagaaacccaagctgggcattccaagaggctggaacaagaggctgccccaagtggggcaagaagtgaagcggttccttcctttcggaggggctattgtgcattggactttggtcagcggcttttaacctggacgctgctgtgctggtctctcacagctcagggcccagtttgtatgatgtcagagccatcttggctgcaaaagtctccatgtgcagaagagaaggttcaggtgaactgagaacagggaggatggaagggtctggaggacctgaggaactggtcctcctcatgcttggacctttctttcttcttgggtggtatttgggggtggttagatggagacgctgttctcaatgaggggagggtccaggtaggtgtagggcagtgccagaccctggttccgctcctggatgtcccttgagatctgggccaggcggctctggaaggcggcgatgctccgcctcggggcctcctctgtgaagtgctcatctgggtaggtgcccaggggcctctgggaggacatcaggtaagaggtcaggatgacattcagatgggatggggaataacggaggaccacatgtaacagcaaatccagtcaaggtggcttctagtagcacaacccagttgcagccattgtaaacacttgccccaaactgccaccccatgatcctgacacgaggccccccagcacccaaaccccaaacagagtaggggacagactgtgacgtaggagccagccaacccaaattcagtactgcctctgctggcaagcctctgcctgttactttgactctttgagactcaattcctgcatctgaaaatggatgggttgaactagaaaaaaaaatttttgaggcaaggtctcactctgttgcccaggctggagtacagtggtgtgatcatagcccactgcagcctcaaactcctgggctcaagtgatcctcccaccttggcctcccaaagcactagaattacaggtgtgagccaccgtgcctggcctagacctttaaaggtccctttcatacctgatccaactgctctgtgaactaaaagaacgaaccacacctttcatacaaccgagatcaaagtaaacactgcccaggaaatatacccaagaatataacaattacttcataatttcacaaaattcaactcctaaaaacaaccagcatcctggttctaaggtaccttcacaatcaaccatcgtgatggaacttttgccaacacaatcaccatcatcctccactgccacactttacagcacagccaatcactatcgagaaatatcacaatgagctccagtcactgccatcctgtgtacaggactgtccctccctcatgatcatatcacacaaccagctcatcacgacaacgcagaggtccagcctcctaaccagcacacacttcccatttactagaaccttcatataattgttgccaatactactgatcttttttttttttttttttgagaca

SEQ ID NO: 413 - DNA, 20001 bp, Homo sapiens
gccttcaattttgcacccaaggtgccttgttacctcatgttagtcctagcagccctgctttaaagggccagctagtaaacatttcctcctttgcaggccacacaggcccatcaaaactactcagttctgccaatgtagcacagaagcacccacagacaatacataagagaatgggcatggctgtgttgcaataaaacttccttttcaaaaacaggcaactggcccgatttggccccaagtgatagtttgctgtccccggtgtaaacaacaaagttaattctttttcctgccacctatccattgtggatcactgtggtttattctccacatttctttctgaaccccaagtggatagagctgtcatcatcttgagtattggttgatgttgtgcaagagaaagaaaaggcttttcacttgccttagcaattaagggctcagagacagaagggacacattattttagctcatgattcattggctagaattagtcataggaccacaccttaccataaagcggcaatgagagctgtgataaaggttcagattaggtgttgaaagaatacagtgggccgggtgcagtcgctcacacctgtaatcctagcactttgggaaccgaggcgggtggattactttaggtcaggagtttgagatcaacctggccaacattgtaaaaccccttctctactaaaagtacaaaaaaattagctgggcatggtggcgggcgcctgtaatcccagctacctgggaggctgaggcaggagaatcacttgaacccaggaagcggaggttgcagtcagctgagatcatgctactgcactacagcctgagcaacagagcaagactccatctcaaaaacaaaaacaaaaacaaacaaaaaagagggtgggcgcagtggctcatgcctgtaatcctagcattttaggaggccgaggctggcagatcacgagctcaggagatagaaaccatcctggctaacgtggtgaaaccccgtctctactaaaaatacaaaaaattagctgggcgtggtggtgggtgcctgcagtcccagctacttgggaggctgagacaggagaatggcgtgaacctggaaggtggagcttgcagtgagccgagatcgtgccactgcactccagcctgggcgacagagggagagactgtctcaaagaaaaaaaaaaagaaaagaaaagaaaagaaagaatatagtggaagaagatataaaatctgattagtgagtttacagaattggtatttgttctgggcttccaaacatgaatgtgttccacagatctattttgatattaatttagcaaagacagtagaatttattttctagatatgttttaattagagttaataaaaggtatattttcatgtttttatttattaattttttcacttttagtttcaggggtacatgtgcagatttctgcataggtaaattgcatgtcatgggggttttgtggacagattattttgctacccaggtagtaagcatggtaccccataaggcaatttctccaacctcactcttctccctctctccaccttcaagtaggccctggtgtctgttgcttccttctttgtatccatccatatttactcagtatttaattcctgcttataagtgagaacatgtggtgtttagttttctgtttctatgttagttcagttaggataaatggcctccagatcctgctgcaaaggatgtgatcttgttcttttttatggctacatagtattctgtggtgtatatgtaccacattttttaaatctagtctatcattgatgggtttagtttgattccacatctttgctattgcaaatagtgctgcagtggtgtgtctttatggtagaataatttatattattttgggtttatacccaacaatgggatttttgggtcaaatggtagttctgttttgagttttttgagaaattgccaaaatgccttccacaatggctgaactaatttacttttccaccagtggtgtataagcattcccttttctctgcaaccttgccagcatctattattttttgacttttcaataatagccatcctgactagtgtgagatggtatctcattgtggttgtgatttttatttctctaatgataagtgatgttgagcattttttaaatataattgttggccacatgtatgtcttcttttgagaagagtctgctcatgtcctttgcctgctttttaatgaggttgttttttttcttgtttatttctttaatttcctatggattctggatattagacctttgccagaggtaagtttgcaaatattttctcctattctgcaggttgtctgtttactctgttgatagtttctttcaatgtgcagaagctaagctatgtttttttatgctaagttggtttagtgtagacagagaatatttgggtgctgcatatctattcattttgaaaatttgtcttctaacagtgttataacatttaaagtaattactaaaatggatgatagattatctcgctagctgttttctatttgtttcatgttgaggatcttttgttctcttttcttttgcctgtttttggattgattattttttataacccttttatcttcaatattagcttataattcacacctgtttcaaaaaattttgctgtttttttcctggggtttgtagcatatcaatttaattatttgcatcttatattccagtattattataatacttcacatatataataactttaacttgtttccaattgcccacttttaaagtttttgctattcttatgatgcattttattttcatatattccatatatccaaaatacattgctatttttttttttgccttagtcaattatcttttagagtgattaaacatagggaaaagcttcttttaaaatatttacatttttttctgttataaataaatcagagtctctgtagtgtagatatgctaataataaattctctaaaattggccaggcgcggtggctcatgcctgtaatcccagcactttgggaggccaaggcaggcagatcacgaggtcaagagatcgagaccatcctggccaacgtggtgaaaccccatctctactaaaaatacaaaaaatcagctgggcatggtggcaggcacatgtaatcccagctacttgggaagctgaggcaggagaatctcttgaacccgggaggcggaggttgcagcgagccaagattgcgccattgtgctccagcctggacaacaagagtgaaactccatctcaaaaaataaataaataaaataaaaatcaattaattaattaattctctaaaattttgtcttaaaaaagggcaatttatttttgaaaggtattttcactgttcggaattctctcagcactttaaagaagtcattacattgtctcatgaagtttgctacattcttatacttctttcttttctgttttttattctgcttgcctttaatattttctttttatcgttgttttcttcagcttaaatatgaagactttaagtttttgcttgtttgtttttgtatttatctggcttgtggttctctgagattctagaatatgtttaaccatgactccttcacatatttctctccattttctttctcttcttctcctgggattctaattgcacatgtgaatgttggattttgttcctcagcacttagatactgtattctgttttccccaataccacattgtctttctttttcagtttgtgtagcatctactgagcttatagttccgggttcactccttctttcctttgttgtgttgtctgctggggagcctgtggaaggcactcttaagctttgctactgtgtgttgtttttatgcctagcattttcattttagtctttattatagttccgtctctgctaaaattttccatttattcgtacatgtcatccgtcttttccactaacataataatagttaattatatcaataattattcttttaaatttcatatctgatggttccaacatctgggtcatctctgaatctgattcttctaatttccttttttcttaatagaaggctgtttgtccttgcttttttgtgtgtattattttttattgaacgctggtattttgtgtagaacaatagagacaggggtaagaaatatatatttctgggctggccacagtggctcacacctggaatcccagtgctttgagaggctgcaatgagctgcgattgtgccgctgcactattgcctgcatgacagagagagatgctgtctttaaacaataaaaataaatatgtattcctgagctgggcatatctcttcttctgctcagctgttattgcggaatgtttactaaatttagttggtagttgagctagatttagattttgttgttatgcttaccttcagtataccactgaatttaaatttttcaatctttgctttgtacttaggctggaggctgctctgctggaagattttccctcaatgttcctgattaaccctcagctttaggcctcccttgttctctttccccacgtagaagagctctgtattctcctgagctccctctatagtaggctgctgctggttgtgactttgtgctcactggcccgatgattagggccagaaggcttcttggttatccagcctcagcctcagtcaggtcttgtgttcctgggtctctggagaatgcctttcccagtgatcttgcctctctcaaacagataggagatcaatgatcagaacctaggatggtttcttgtcttttacccattctatactttacctgcagctgctagaaatgttccagtgtcctgagaccacagtatttgacgctcttcccacagcagcttaaacctttagtttttgaggggaaaagaacccaagaaggaattttcttcctttcccacatcactggtctctactctcccaaagattcacactgctgatgaaagttttctctggtttcctgcctctggcattttcatgagcccccactggagacctataaagaaaagtcagcaagtgaatgataactcactttgtgtttgtgactctccacaaccagtgtgtctataccctcacactattccacattcacatccagcagttcattgaaagttttaaccaatgttttaaaatatccatttgtgtggtggccccatcttcctctgtgctctgctgtaggtgagccagcatccaactttgctggtagacaggacagctggttgccctgtaacctaagctctttgatgggttcaggaaactttatgctttttctagactataaatggctgtttttgtttgggaagagtaatgctcttcctaactttacatacccaaggcagaagtcagaaatctgtgttgttttggaatgacctcttttctccatgaggattatgttccgctttatacacatgggccaacactggttgagaatgagatcattttctatggctttcctagaacatctagtttatacacgaaccgagctataattatgctgtgaatttatgtgaaattgctttgtcaaattatctttaagcaaatttgattgagcactcttatgtagttaaaacaaaagcttcctccttagatgtctaaaaacttaggtcatgatcctgtctctgtcattttatggcttagtgatctttgagcaagtcactggacctctttggctttcaactttctgtaaaatgaggatgctgaactagtagtttctgtggcccacaaattactctaaggtcaatgatgctgtgtaaattttcttttatccatataattacagtacaggtgttattctcattttacaaagaaacgattttttaaaaagccaatattatacactttggcattagattctaagtatagcagaatgctgaattgtcaaacttgattttgttctcgaagaagggttgggttaaaccaaaacacagagcaggtggtatattttcagcacctggaatttcaacccaaagttttattctctctcttctgcagaaggcctaattcagctacccttaaatatggtgtataagttacatgctatcgagtatgtagtcaaattattataataacagtgtgtgtgagagaaagagagagatgaaggctattaatgagttatagattgggtacatttgaggacttaaagagttggaataagatctcaggtctttccattttaataccagtgtcctttttactagggcatgttccctaagtgggggtttctactaccaccactgagctgtctttaaaaatcagagccctgtgactcagaaagtttctaaatgttggagtatttgtctctatagccatcttcgttacagagcaggatattcagcactgaatcaactcccctgtttggaatcacatttcaaagaaaatagaccatagagatatgatttgtcccctctttcattcagtggttcagaataagaaaggtcatctcactggctacatagtaagtgtgtggaagtgtgagtgagtgtgttggtaaaagccacaatgttgacttcatatgggcattcattctcatctccatctcaacctgtacaaaatttatacatccttcaatgtccaattcaaatcttaccttattgtaaaaaagctttcttgacctattctagaactaataaaaatttagttctatttcttaactcctataatatatattattcaaatggtttagtatgataaattagtagaaattgacctgttaaggaatttcatatttctacctttacatcctcagcaaatgaatgttaggaacataggaaggactcagtaaataatttctgaagcttacttttgttgagatttttaatcttgaagataagaacaataccttcttctttatattatatttaaataaatatctattgaccaataactatgttacatcaattttcctagatagtagcgatacagaactcaatgaaataggcaaattcctgtcctcaaggagctgaagagacatggtaagagcattgaaatggtgatatagtttctgaagaaaaattaaacagggtgagtgacaggtctagacaatgactggagcaggagtttcttattttgtacaagaaagcttctatgactacgtgacatttgagtagagagctgatgaaaatgaaggagcaagacacatgaagatctctggaaaatagttcccatggtaatattgcacagttgtgtgtaaaatatgataaaatattgcattatattgaatccacgtatattaatggattagaaaaggttgaggtgattgtgttatctctgttttctctggattagggatttgagataatgtgtcgtaggaaatctgcttttcctatttctagaaaccagagacaataggcatggagaatttgtttcttagtacactgatcatattaatagtacttctagtgagcaagccattttttccccaaagaatgcgtttacctgagatataatgagagagttcctgtcacaacaaattcaaatggaaacagtagtagaatgagagaaaggctcagtctagaatagatcatatacgaggtggacagtgtcactgcagaaagcaaaataagcagaaggcttgctttaaagcctaaaaccataaaatagaaagattcaaacagaaccagtggggtcaaagatatgatagctaatttatcagaaaaactagaattcaaggctatgggagtcattacagagtaaagcaattgaagagaaccaatcaccacaatggggacaataacatgaaaggcaaagctggacctagttctcttgggccagcacactgtcagttgttgcactagttccctgaattaagagggcttttggcaaatttaattgcagatatagtaatataagctattttagttatgaatgttttatgttcatattttattatcatttcattaaggaaatagagagtagcttgtttagcagttaagagcactgactccggagccagactgcctgtgttggaagcttagttcttcccctagttagttatgtgaccttggcaagttactccatctctctgtgcctcagtttctccatctgtaaaatggaattagtatagcacattatctcccatgtttgtaatagaggattaaattatctaaagtagctaaagcacttagatagtattatttgtattaatcccttgtgattatggtccagtttaggaagcttagcatgatactggccagcatgaaacctaagtctgcatgcgattttattaacctagttttctacattgatatccaggcaaagaatgacaggctgcttgaatctacctgttcataatgactgaatacaaagtggattgagttataaccattttttttttttacttaaagaggaatgactacaattgcacaattataatttcatcattagtcactaaaatatattagcagtctccagctgcctgaaacttggaatgataaaggtgttaccaaaaataatataagccctaccaggacaggtattatgtctatcttggttgccattagctcagcacctagcacagtgtcaggttccgaacttaaatatttgttaaaataattaattcattgtgtattttaaccaatatattaaaacttagaagtccaaaagtcatctctaacagaagctatatgtgaccccaatcatgtaagaatgacccttaaagccagatttcaaagcagaatacaaaaccagccacatttatatcaagaaaagctatcatacacaagtgctgtcacctgatttggattattaatcttattcactatacttgaattattataactaaatggatgtttttaagaaactaaattacccctcaaatatcagaattgattatctgatgggttctttaagcaaatgtgttttgggcagtgaaagacttctaaatgagatcttacagagctggaatttaaacactggaggaaagagggtgcaggcttttacaggagctaatttgaaagtttggaagcaaggatggtattttggatatgcgattttagaatgtttaagagattgaccatgctattgtgacgccttacactgcatttctgaggagaataactgagaagaggtgtgagttttgagcaaatgagtgatttttacataaagctcggaaaacactggggcccttaaatatgatagtatttgtgaatattggtgaattaaacttttttaagtgggtacattataacagatggaattatcttttaaaatatatcctaggcattatttgagaatgaaaaattttatttccagcttagttccctgtttcaagattgagataatttatgaatgaaggctctatgttcagttatattagcccttggtagattggtggtctggtccattctcaggaattaaatcaattcaattttgtagtgctgatgaccagattgattagacagtatatgatcaggtcaaatagaaattaccacttggaatcaaccaatacgagtgattaaaaatggaattgacctcaaaatgtttaatatagtgcccactatagatagagacttcaataattattatctagggcagaagttccaaactttgggtgcacctgactcacctggagggcttgttgaagcactttgctggactcacccacagaatgtatgaggctagaaaatttaagcttctaactagtttccaaatgaccctgaggttaccccctgaggatcactgctctagagagtaagctttatgttagttgagtttaacatatcaaacagacacaggttataacaattattttttaggcaagagattagtgctatagttatatttagatatagaatgagggctagggaatatgcaatattcacaccctaatatattcaatataggtagcatatttttttcagcaattataccccaaactcttattccataatcagaaatttctgttgactgaacgtaagatagagtacatttcaaataagatgtttcagatgatgtaagctattagtaaagaagaattcagttttggtgaaataaatgagcaatagtaagtatacacaatgaaataatgcacgtgttcatttgagaaagtatttgactacacacacaacaccatgctatctactgagaagattttgaaggcttgtaggccagtcattgtaatcaatctagaggcccgtgatctagtgaagggaacatgtttcagacatatgcactgatcagcaacactacggagccacacattactggtgccagaatggttggtgccaagggtccgttttacagaataccaaggcaaggggatgttgggaacttgagtgaccaggtcaggccttgtgaaggaacagatgttggtttttactcaatactattcaccagtgataccaaattaaaccagtaattgaggggattctgcctgagcgacttttgcttctgtacgttttcttctgaggagtatttccagatttccagagaaatgaagcaggttaattaagatgctaagaggctggcacaatttctgagcggattaacgtcatgcaaaatttcagtgcaactaactggtgtttgttcctgcttgcaaaagctgtgtttgtacaactggggcagagtccaaaaggactgaaagaagttaattagttcaacttgccaaagccttgtcatctggtttcaggactagggaacaggacaaacccaatgaatataaatctgtacacatatgcagaaggttgtgattatgattaatataactattcatttccatgttatcaaagctgtggtttaataaattgttagctgaaaatggaacacaggtcaggagttttatggtgaaaaagtgaagaatggaaaatgtttatactgacatcagtagttctctagccatggtccagtgccttgaaagtcacatgggatgtttgaaaacaatacatattccaggctatcactgctagagttttattcagagtatatggaatgtactggaaatctgtatttttaaccagttcacctagtgatttggttgcatggccaggtttggaaaatattggtcaagatatgcacaaaatatgtgcacagaacactctgctatgcactgtactcaaagagtgaaaatggaagtgggaccagttgctgttactatcagtaacctactagcagaattttggcttcctgttttcacaattttatgctatcctggcctagaggactttgttctagaggaaactattcttctaccaggagacacaattcttccattgaactgggttaagactgtcacccagccacttagggttctatatgcctctgagtcaacagacaaataagggagttatggtactggctgggttcagactgttaaggggaagacggactactgctccacaagagaggtgaggaagagtttataatatgagagattccttagggtatctcttagtatgaccctgtgattaaggtcaatggaaaactacaacaacccaatccacaaataactactaatggcccagacccttcagaaatgaaggtttgttcattatgtattataaatttaacatcatagttttgaagttacaaggtatcaggagaagagtaaagatcacccaagaacttccttctcttttggggaagggattaatgtatttttggttgtatgcaggatggttgtgtcatattaaggtggaattatgaccttgtcattgcctttattgagagactaagtattgtttaaggagatatgtatagtgccagattaacaagaggaagactcatgatggttaattttatgtgtcaacttgtttgtgctaagagatgcccagacagctggtaaaacattatttctggatgtgtctgagagtgtttccagaaaaaaatgagcacttgaatctctagactcagtaaataagattgctctcaccaatgtgggtaggcattctccaattccttgagggcctaaagagaagatggatggcctatttcaagcagtgaatttgctctctctgcttgagattaaacaaccatcttctcctgccctcagacatcagtgttcctggttctcaggtatttggactcagagtgagacttacaccataagctcctgtaattctcaggcctttgggcttatatggaactataccactggctttcctagacttctagcttgcagatggtaaatcatgggacttctcagcttctataattgtgtgggccaatccctcataatatagctctatatatctgtataccctattggttttgtttctctagacaaccctgactaatacagttgcaaagccaattttggagaatattggttgagatatacgcaaaagatgtacgcataacattgtgctatgtccttagaagatttaaaatacttgtaggttagtcctcacccaaagcccacagtctagtaaaagaagcatgttccagagtatggagcagtcagcaacactatgaagcaatggtttactgggaccatattgtctgatactgagtttctatttgggagaggaaaatgtaatactccaggaactgatcattgagcagtaggtgaccagtttgttttctagtgatcacagtcaaatgatggctaatcggggagctttaatattttctgcaacagagcatagtagaggagttattaggcttggataggtgtatatatatacacacatgtgcgcacacacactgtgcttaggagagcatttgacacagaatgggagctcaatacaaatgcacaccataatgaacaaagccaccctagtcattaggcattgccagaagaaccaaaatgacataagctcatgaaaatgctttggatagttcaagtgctttatcaaaacatggacagtattgccactaattatcattatttatattaattttatttttgagccaattagtactctttgttcatcacagatgacacactcagttggtgtcactgtgccatgaatcgatatactgagagcttaatacactgttagcagtttaatattttatattcattgtgatcaggcagtgaggcattcccactaaagatatggcgaatcaaatgcttcttaccagcacctcagctgcgactgtagacccaaagaggaggggatgagagcacatcatagagtcactctgtctctctggtcacactcccttgctccccactactaggtagttttaatggtgttacagctgtaatcggtaccttcatttatatcatctgtggcttggtgttggagatatgctctcaagtctgtgggtgggaggcaccctgagggcacaacacatctattaccctggagaaggtataacaggaaacaaatgataatggcaaaatgctaatgacttaaatgagctgaaaatgatgatatagcacttggagctttccagtttttcttgtgatgaggcagggcctatcgttagtttgacatataaatgtgccttagagaagtcttgcaggattgtttgtccctcagtggtagaattcattagcatatggcagctctctccagtgaagattacctgaggatgtatgtggaccgcctttgcacagatattgcaatgcaattgcgcttaagggggcattttgacaaacaaggcaaacccattatttttatccatctacaattgcaaattaattgaacaattagtagtaatagcttgaatgtacataacaaggcaccttgcatcccaaagtactatcctgacaaaatatgagcactaattttccactagtgagagatggattcctctggagtaggcacaacagctgttgaacaatcatagcaacctttttcactattcctgtcggtagaaagagaatggtataacgagctgaaaaggaagatatagctgcccccatgggtggttactggatagctgcaaataaagtaaaatacacctttcatttgttgattacaggaagaggttgacatcactagacaggttcgatggaactctaaatataacagtagaattgaagctaatactggagccaatttccgtgactctatgtcttaaaatgaactatttattgacttgggggctagacgggaagaaaaaaagtgaaggttgggggagagggtgggcctacattttcatattaaagcaactctttcctcacaaagatttttaatcagacattttgattgcaagtcaccctgtgattgtcagaagtaccatgctgtgattggaagagctcttcaaacccccacgttctctagcagactctgtgtcatggctgctgacagctcaccaacacagaactgttaacaaatgcaattagcatatatccctactctggagagatgtccccaagctctagaactcaaatattataactcatagcactctggactttaataagtttagaaaatattatttttcaaatgaatggatgatataatattttcttttgctatagattgatacataggaaacacctgagttttatgaatggttggctattttttcccctaaagggaagaataaataaatatcaccattggcaccctcttcacagcccatccataaattcctatatatttgcacaatgccagagagtagagggaatcagagctaaactgaatatctttaccttgggctaagactgtgatacattctgttctaaagaaaaaagccttacagaataattactatccttaacatcaggcatgaattaagttattttctttgagttctgtgacttccatatttcatccaaatatttaactctggttgatgtgacatttcccaaactatctacttgggtgttatttctctatccaaaatattataagttttctccttgccttaaagaatcagtccaatgcatataatctttttctcagttttattgaaataatctttccaaaatactgctactacagtctcattcatctattataaaactctcatgttttccattgcctcctagatagaatccaaatgtgccactctgaattccaaaaccttatataggctggtgccaattcatcttcctagaattttgttgccagtattccttaggacaaacactgaattctaatcagactgcttgattaccatctcttggaacctccacttacattctgctttctgtattcttagctcatattgttccctgtgatttagactatctttctccttataatctagttgtcttatataaatcttgtaaacattttaatattccacttaaatacatatcaagtgctttgtgggagttaaaacacacttgttctagcagggaataaggccaaatagccagggagcaaagacccaaaataacatggagtttttagcagtgatggtgcttgagagataaaaaaattgtagttcaaaacccaccatgaatgaggagccctaagaagccttccagattctcatatagatattcccttggagtaggaacaattctgaagtagactgagcattacagggtacaaatcagcctcatgttagttcaataccagattagacaaatgatatgcactcttgctgctgccagagatagaatgaacctacttgggaggaagaaaaacttaccagagcctctacaaattttcacaaacaggattccatcaaaatatgaaacagctgcaaaagaagacatagacaatagaaacaaacccacaagtgacctaactactggacttgtcagacgtagcctttaaaatagctataatgaatatatcaagtataatagatgtgtgtcatttcatattaaaattctcaacctaacagaacagcataatcctaaatgtgtatgcacctcgtaactcaaatatgtaaagcaaaaagccaaaactcaaccaacctgtcaattttgaaagtattataaagatattttaaactataagagttcagaacatttatctcttataaatcctttttttgaaaagtgtgctcaaataaaactaggaagtttttgtgtgaagaagcaagaaaatggcacaggatattcaggaaacagcattgaatgatgacagtcctgagcaggcctggagatcaaccaccccagattgaagcagaaggacaatgactctgagagacacttctcagacaaggggggcactggtagaatatgtgtcagggaactaaaaacattagatgggagacactggaaggaagattttttaaaaggcaaggaacttggaattacaaaagaaaaagtcaaatgagaaaatactatgtatttatgataccttaattggctctgcagtcaataaaaattatgtgtcatactgaaacatttttataataaccaaaaatgataaaactacgttaggaggatggagccagagaaggtgtattgtgtaagagatgtaaagtgacatctttttgtagtaaggcaaagagaatgtttaaaattggtaaaccagccgggagcagtggctcatgcctgtaatcccagcactttgggaggctgagtcgggcagatcacttgagatcaggaattcaagaccagcctggccaacatggcaaaaccccgtctctgctaaaaatacaaaaattagccaggcatagtggtgcgtgcctgtaatcgcagctagtcaggaggctgacgcaggagaatcacttgaacctgggaggtggaggttgcagtgattatgcagagattatgccactgcactccaacctgggcgacaagagcaaaactctgtctcagaaaaaataatataatataataattagtaaacaataagtagcatgatatacaattattagttagcaatataaagataaatatgagaaggaaaaaaactgagttaatagtggttgcctctgggagcaggattagggtaagggtgggttaattcagaggacagctttttacagtgtttttgttgctatgattactactttgagataaagattaatatctagtctttaagtgaaaaaagtggaaaaagcatcatgctaattataagaagtctaagaaatagaaaatgataaaatcattctaattctaccacccatactagactgttcagtttttggtatattccctcaagtcatttataaaacatacacacatactttttaaaacaataaaatcaaaatgttaccgcattagtttttatgcctaaaatcttgttgtgaatattttcccatcctatcttataaatcaaaaacatgcagttcaatgtttgcagttttccatatctcatgagattttatttaatcattaaccaatgatggaatatttaaggtgtttctaaattcaaaagtattataaataatgttgcaataaatatccttttacacaaacattacatatccttttatctaatcagaggttttttaaaaatgtagccaaagttatcttaagcaattaaaaatgcttaagcttattaaaagtactgattctttgaatgataaaacttaaaaatagaaatgctcactcaagtgtatgactcattttaaacttcttgatacatagcattacaaaatagctttctataaaagttgaatgaataatactattagagaccaaactgagagatacagagaatatgtgatataaagggaggggctgatcagagtggactggagggagcaggcagaccaatgctccatgcataaacttaggtttgacccttgcgtcttttgggaaagtacaccgtaccactcaacagcgatgccaaatagaaccaataaatgaggagggggtgaatttcttgcaattcctttggcttcacatttcttttgaagaatgctccgtaagaactgtagcaggttaattaggatgctaaggaggctggcacaatctctgtgcagatcacatcactcaagacattcctgtaacaacatgggtttcttcttgcctgcaaatgctgtgtttatacaactggcagagagctcgacaagaatgaggggaaaaaaacagggcgatttgtttggtttgctgcagtctcgtcatcttgtgtagcccccaaagctataaagctgcaaacatatgagtataattattagtataattcttcattatcactttagaagagctttggatgttaaaaaaaaatctattgatggaaaataggatagaaattggaaaaacgtataatggggcatgaaggatgatttctaaactgtggtgacctcagacttacttggggagcttttaaaaactatagtatcccagatacatttccagatattttgatgctctttgtatagtgttgacaaggcccggaaatctgcatttttagcaagctttcagggatatttatttggatgcaccagacttgagataacagatcatgaaggaagtacagagagcatattttgctttacacttaccaatctttgactgtgtgtgtatactggttttatagagcaactaaagatatttgcacatagttgaaatttgtatttcttttggttctagatagagtgaagattttcatttatttttatctttacattgtctctttacattttaaaaaatcattttgcttctaggatatttgtaattttcttttctggtttgtaagagctcttgaaatattaagattttgttctatttcctaagaatttggaaatagtgaacataaatttagtcgctaagaatgcaacttaaaaattaacatataatagaatagagtataaatatgaaaaggtagctttaagaaaaagaattgctacctggctgccaagagttgattgaattattgaatttattaccatatttaaaaaaatcatggtatttgtaaaattacctatgaaaacgaacaaaaaatgtgagtttaagtggcaaatattaggtggcccagtcagcattgtggtcttgagcaggtttagccctatgttatcttagttcagtgttattaaagattcaaatcatgcagctaactaccattgatttgattttattctccccaagaaactccttcatttgctccctgcatgcctataggaaaggatgtgttaggcagagggcagattgtttgatgtctcagcagttttgattcttattacaaattaataaactggtgtcttggttatattttgcatcctgggtaagaatgtgttggttggcatttaaaattgactagttccttctgcagttatttttttataattaaatgaaaaaatctccctctgattttatacatcagtctcacaagcttgctaaatatgagttaaaccctgaaaccctgataggtttactcagtcactaaaaaaatccaaaactcaaaatagcaaaaccaaaaagcatcctgaaaacatgaaggtgtgggcatccaatataggacctctgaccttggagattatcaggttttcctgcagacccctgcaacttcctcagtgttgtgcttaatgaatcttttacagtatctaaagcttcccctattaatctggagataatttgtacagtttattatttgattttcattttgtgtatagtgttaaaattactcaaatatgtgcaatgtaggatacaattatgtattcataattttatgagtatactcatattgcatgtttaacttggtattctgtggatgctcaataattcttgataatacccaaagaacctatcatctgtgcagttttaattatttcctgtgaaactgatttcctctaagaaggaaaggaattgaaaacataaacttgagcccagaacctggtccatgcttccacatgtacctttgtctggtcttcatggtcttgcggtactatgaatttagttgttctggtaaattcaagaattcaagatctgatataatgtgtatgaaaaactacaggcagtttggtgttgatgtgggtaaaataagaggcacctgatgatgggaaaagaggctggtgaggtcagtagtagccagaagaggacatacctatgggacatgctaagatgctcggaatttattctgagggaaactggaagccatcgaaggattttggagtcaaggaatatcaaaatgagattcgtagttttcaacccaatgcagcaaaattggagaatagaagagaggccagtcagggggctgtgacaatcgttcaggcaacaaaagagggctcagaaatggcatgaagaaataggggtggctctgaaaaaatatttggagtggg

SEQ ID NO: 414 - DNA, 40001 bp, Homo sapiens
acaagcatctcacaccatgtttgcttctctgcagaggccacaagaggaagctgaatgaagaggacgccgccagcgagtccagcagggagtccagcaacgaggatgagggcagcagctccgaggccgacgagatggccaaggcgctggaggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctcttctcgtgggtgtgtggcagcggtgagcacccgcctcctccctcgctgggatccagctccttagctgtgaaacagaaacgaaaaaattcccacggacaggaccgtgtggaacggcagaaatggaaaccgcagaactgcgagcgtgatgatctcagggtttcgcctctgagcataagaaccaggcttgtagctggtattttaaaacggttaagtgtgaagaattactctcttgcattattttcatccttcccttttgtttgtttgggatgcgggggcccgagagctacaggtaggtgctgggctatggccgccgccaggacccctcccggccagcagcctcggctcacgtcccctcctcctcccagcatcagtcccgcagcgtggcggtgggaggctgcacctcgaggccacggcccttctccaaaagcacacactcctgctttccgacggcaccctcccctgaccacagctcgggaggtggcacgtgtgagaactctccatccacaggatgtggctctcgcgggacctccaggctcaggctgtctccgctgggtgtgggacctttcctgtggggttttcgatggaggttggctggggagggaggcatcctcagtgggtagaggaccccagggtcctggtgctgctgtcgtcaagatgcggcgacatggtggcagaggaaaggcaccgttacccagcagcacgccagccccgggtgactgtttcctgtactaactaggttatttgcagcgccgagtgaagaggcagcttcaccacccaacccacctgtgggttctccggggtctgcagtctgaggaggctgcaggatgaccagacgccggtcagggagttcctcctgtccagagaagcaggaggtgaactgggcccacctcaggtccgatttcgccacgagcaagaatgtaagatgaattggacagaaaacaaaaatagatgtacaagttgatacccaaagaaagcagaagattctacagtttatagggaggggcacaaaacgtgcagggagtaatgtgccggggggtgggggcaggggccgatgaacgaggccttgatgctgtgtggagacctctgggaaaggctgggagaccttccctccttccacagtggtttctccctgaaggcgattctgcgtgtggttggtcctgctgggaccaaggtggccccttgttctgctcttggccgagtcccctctggcttcatgggggtgttaatgaggctctgcaaggcctccttaaacacagtgtggaaatacaggtggtgctgcaggggcagcgagaacggggacctctgctgctgggtctggcctaggggtgaagaggacgggaggagggtggcgtggtagctggctgcgcggggcctggtgacgggaggggccggaccgcatgcagcattcaggaccagcgtggccctgggtgttcgcctgttctgaccgtgtggtcgagtgaacagagcatgcaggggagatgcagcaggttctccccgacgcggaagagcaaggggtccccggttcctggaggagcagcgggattgccccaggctctgggatcgcccacgggggcagcgggccagcacccccagccgcatctctgcacagccgtgctgcacaccttctccgtcacgtgttggaggtgggtctcagcaccagcacatccacattgatagcttaaaatgggacttttctcccgcctgtctcactgttggcccgcccccatgcagcggtggggaccccactgcagggactccaagagccccatcctgtcctcggctccagcctccatcagcaccagccgtgtccttgcagccctgactggagcaactcccaaactctgctgcccggcaggtcttctgaccctgcccgcggtgatggcaccctctggaaggctggcccaggacggcacctccatgctggcagcccctgagtgtagtgtgtgttctacacaaaagagccaggaagtcatctgtgatcattgtttaagggactgtgattaacgtttatgaaatgttctgtgctatgcgaagaaaccactgaatgttagggaaaatattaaatactgaataattatacaactgttccaaataaagtcttaagaagaaacttgaacttgcttcccttagtataaatttcatgtcaggttttaagcttaaactggctgtaaggaaatttgtgatttaaaatttgaagaggtgactccttaaatttcgagatagtcgttgcataaatagatgataaattttagaccattcaaaaatctgtaacagttaaatttaatgaaatttccttccttttctcttttgagaaatggaaagttgaaattttgtataacagcatgcacagatttcatatctgatcagtttttcatattaagttttcaaaacaaccatgaagctctaatctgcacgtgcgcttgctgtgagacggtgcctggcagacgtggagatcgggaggtagtggttctccacctggtgcccacccagtgatcacttttagcgccagacatgccataggttttgacaaatgtctgatggtgtatccaccactgtggtgtcgcacagaatcgtgtccccgtgtatccaccaccgtggtgtggcacataatcgtgttatatgactggaattagtatgtagccttttcagattggcatcttccacccagtaatatgcatttaagtttcctccatgtcttttcatgacttgagagctcatttctttttaccacggaatcacacaattcatttatccattcacctactggaagataatcttggttgtctccaagtttgggcagtgatgaacaaagctgctctaaatatccatatacatgtttttgccaggacataacttcttaatcccttagggtaatgccaaggcatgtgactgccggatcctacggtcacagtgcatttagaaactcagattgtctcccaaagcagctgtgccattttgcattcccacccacagtgaatgagagttcctgttgctctatgtcctcactggcgttcgacgcaacgcagagcatcttttcatgtgattatttgccatctctgtattcatatcttctttgacgaggttttaaaatctttagcccattttgaaatcagttcgtttctaattgttgactttctctgttgtttttttttgtttgtttgttttttgagaggctgagtttcaccatattgcccaggctggtctcaaactcctgagctcaaacaatctgctcgcctcagcctcccaaggtgctgagattgcaggcatgagccaccacgcccggcgagttttgatttctgttaggaaagagttttgtatgcattctggagaacaatcctttctcacacatgtctcttgcaagtcctgtctcctagtctgccttgtcttctaattctcttgacagtgtctttgagagggcagaattttttcattttcatgaagttcagctcatcagttacttctgtcatagactgtgcctttgctgttgtgtgaaaaggttcaccatcatacctagatcatgtaggtattccctaggggtttcatagttttgcattttatagttaggtctctgatctattttcagccaatttttgtgaaaggtgtaatgtgtgtgtcaacattcatttctttgcttatggacatccagttgttccagaaccatttgttaaaaagactcttttctccactgtattccctttgctcacttgtgaaagatcagccgactgtatctttgtgggtctgtttcatcaatccatttgtctttctttcaccagtacctcagtgtcttaattactgtcgctttagttaagtcttgaggtcgggtactgtccatcctccagcttctttcttctccttcagtattttgttgggtattcggggtcattgcctctccatataaactttaaagtcagtttgtcagtatccacaagataacttgctaggattttgattaggattgcattgaatgtgtagatcaaattgggaagaactgacaccttgaaagacttgattcttcctatccatgtacatagaatatctctctgtttcattcttccttgactttgttgatcagaattttgtagttttcctgatagagatcttatctatatatagttagatttatacaaaagtattttatttggcacaggtaatgtaagtgatactatgtttttaattccaaattccacttgttcattgctggtatataggaaagcagttgactttgtgtattaaccttgcatgctgaaaacttgctgtagttccaggaggcacttggtcggggcagtccaattcttttggattttctacacagacaattatgtcatctgcaaagagttttatttcttcgctcccaatcagtatactttttatttccttttcttactgcattagttgagacttccagtatgatgttgaaaaggagtggtgagaggatgtccttgccttgttcctgatcttaatgggaaagctttgcatttctcaccattattatagattttctgtgtcaagttgaagttcccctttattcctagtttgctgagttttatcatgaataagtattgaatttttgtcagatgctttttctgcatctgttgatacgctcacgtaatttttttgttgttgctgtgatgggttacattgattttcaaatcccagtagtctggggtaaatcccaatagtcttgctgtagaattctttttatgcattgtagctttcagttggataagatttggttgacgattttgcatctgtgttcatgagagatattggtctatagttttcttattttcatctggtttgtgtaatagagtgatgctggtctcatagaatgagcttggaagtattccctctgcttctgtcttctgaaggagatgatagaaatttcatataatttcttccttaaatatttggcaaaattcaccagtaaactcatctgggcttgatgctttctgctttggaaagttgtttattattgattcaatttcttcaatagatattggcctatttagacaaactggttcttatatgagtttcagcagattgtgtctttgaaggaattggtccatttcatctgggttatcacatttgtgggcatagagttgttcatagtattcccttattatccttttaatgtctatgggatctgtagtgatgtcccctctcattttttgatattagcagtttgtgtcctttttttttttttcttaccctggctaaagagatatcaattttctttcttttcaaagaactagcttctggcttccttacttttctgtattgatttcctattttcaatttcattgttttcatctctaattttttttatcacttctacttagtgattgttgttttttgagatggaatctcactctgtcacccaggctagagtgcagtggtgcaatcttggctcactgcaccctccaccttctgggttcaagtgattctcctgcctcagcctcctgagtagctgggactacaggcatgcaccaccacgcccagctaatttttgtatttttagtagagacggggtttcaccacattggccagtctggtctcaaactcctgacttcaggtgatctgcctgccttggcctcctaaagtgctggggattacaggcgtgagccaccgcacccagcctattacttctactttgaatttaatttgttattcttgtcttattcaggtggaagcttcagttattgattttagatcttttctaatatatgcattcagtactctgaatttctctgcagtactgcttttgctgcatcccacaaattttggtaacttgtgttttcattttcatttacttcaaaatatttttaaatttctcttggtattacttctttgtcctgtatgttatttagaaatgtgttgtttaattgctgcatgtttttgtgatttttcagttatctttctattactgatttttgctgtaatttcactgtgatctgagagcagacactgcatgatttctcctcttttaagtttgctgaggtgtgattgatggcctgtctgcatgaatgttcctgtgagcctgagaagaacgttactgtgctgctggtggataacattgtctgtagatgttaatgatatccagttgattgatggtagtgttgagtttgaccatatgcttactgattttatacctactgaccaccctgtctcctcccctccttatagcccttgctgaatttggggttgttttgatttttgcctttttgttttgtttttttggctgactgcaccatgacagcaggaatgcagtctggttggttgatgtagcttctactctcaacacagaactggctcataatatctgttcaacaaaagtttgttgaatgaataaatgcaggttctcaattcccagtatcttgcaggcatccacctaatgtggctcagtctccaggactttgtattttcctttgatctacttcccattccacgctgcccactgagtttgttttttctctgcctccaataacattttacttgctaagatcacacttgcccagttctgattgcctgtgccagttaggaaggcagtggtgaggaagagtgcacaggtgcctgcctgtggtttgtgaaaatcccttttagatcctggcagtgggttgtgggctttggtcttggtgttactcttttttcctttgcctgtgtctttgtaactactttagaggggagattgtggaggctgtatcaggaactgttagccagaagtcttttaaaaaatacttaccatttttactttttaatggaaaatggaggctggatatcccaagaatcagaggttatataaaatatatgaaacgtgatttttaaagaatgaaaatgaataaaataggacagttaggcaagaaaaagaaataaaaggcattcatattggaaaggaagaagtaaaacaatcttcacaggtggcattgtcttgtatatttaaaaagcctaaagaacctactaaaaaacaattagatacagtaagttcagcaagggtacaggatacaagatcagtatacaaaaatcaattgtatttctatacactagcagtgaacaacccagaaaagaaaggaaacaattccatctgcatgcaaaagaatgaaattagaccgttacctcacaccatatacaaaaactaattcaaaatgaatcaaagacctaaatgtaacagctaaaaactcctagagaaaaacagacataactctgtctcttgggtcagtcaaggatttctcaggtttaacaactaaagcacaggaactaaagaaaaaatagataacttggactttatgaaaattaccagctgttatgctacaaagaaaactgtcgagaaaatgaaaatacaagaattggaaaaaatatttgcaaattatctatctgataagggtctagtgtctgcagtatataaaaactcttacaactcaacaataaaaagacaatcagatgtaaaaatgggcaagagatcgagacattcccagagaagatgcccagacgtcctgcaggtgcatgaaaagcttcccatttcattcccacttctttgggcaggaggatgtgcagtgaggagtcaaagcagatgagtgtggggtttccttcaggggtggtgcaggtgttgtggaattaggctgtggtaatgtttacacaactgagaatatactgaaattccactgaattgtacacattaaaggggtgaactcatggtatgtgaattaaaatagtttttaagagtaagtaaaacccagccaggcgctgtggctcacacctgtaatcccagcactttgggaggccgaggcgggcggatcacgaggtcaggagatcgagaccatcctggctaacacggtgaaaccccgtctctactaaaaatacaaaaaattagccaggtgcggtggtgggcacctgtagtcccagctactcgggaggctgaggcaggagaatggcatgaacccgggaggcggagcttgcagtgagccgagatagcgccactgcagtctggcctggacaaaagagcaagactccgtctcaaaaaaaaaaaaaaaaaaaaaagtaaaacaaccacctgttaacccagcaccctgtgtaagaaacaggattctcggagcccttcctgtctgggtactctcctcccccgccatacccttagacaaatcctgaatttcatattaatcgctgattttttttctgcgtaattttaccacatgtatatttatgcttaagactgtatgtttggttttgcccatttttgtactcaatacggtcttcagcttaccatggtttgacaacagttttttgactttagactggttccaaagggatacacattcactagaatctgtgctccaagtatgcacacagccattctgcttaccagtttcagttcagtagtcagtacatcacgagatattcagcacttcattataacataggctttgtgtcagacaagtttgcccaactgtcggctaacatagggttctgacacgtttaatctgggctgggctaagccatgatgtttggagagttagttaagtgttcaaatgcatttccaacttgggacacttgggtttatcaggacaggaccccatggtaagtagggagggaacctgttctttctgacttctcgtgtgcttcagggttttgtccgtgcacacagccgtggtccatcactgccctccgtgctcagcgatgtttctgttccacagcttgtcctccttttgccggacgtttgtgttgcttatggctctttttatgcaaatgcagctgcctgagcattctttacctatgtcctgatccattcgtgaatgagcctctggggttaaatacccacaagtagagttactgggactggggggcaccccagtgcagttttcctggatagtgtggaattagtttctcagtcattgatgctggtttgcactccctcccagtcagtgatgctgcttcacactcccagtcagtgatgctggttcacactccctgccagagatgctggttcacactcccagtcagtgatgctggttcacactcactcccagtcattgatgctggttcacactctctcctagtcagtgatgctgcttcacactccctcccagtcagtgatactggttcacactcactcccagtcattgatgctggttcacactctctcccagtcagtgatgctacttcacactccctcccagtcagtgatgctggttcacactcccagtcagtgatgctggttcacactcccagtcagagatgctggttcacactcactcccagtcattgatgctggttcacactccctcccagtcagtgatgctgcttcacactcctgcccagtcagtgatgctggttgacactccctcccagtcagtgatgctggttcacactccccacacctggtcagccaaaaacggcttttccaacaacagaaggacctgaagggaaacctcacagcaagcccctcccaggtgggcaaagttatgtcttcagagagaatattctaaaccctcggagctgcagagccagaaagctggggcccaggcagtgtcgtcagccttcccaaagtgtctgcacgagctcattcccacagttgatggaatgacatttaactgtcacctttctctagaagtgactgcaaagcacagagattggtcttcaggctcctggacagttccctgcagggcctggtgggtggtgaccgtgtggctggcagctcgcagttgatggagactgtgtagccatcagatatgatgtcaacacaagacaccagtttttaggaaacagcctccaaggtactgcttgatgcattcaccatgggtcgtgtgcctggccagcctctacctgcctgggaagctccttcacctggggatgcctctgctggttttcctgagacacagcccttgggggcactgatggtccccgggtgaccagggtcaccagcagcgtagtcccaaccccatgtgtgagtgaccagggtcaccagcagcgtagccccaaccccatgtgtgagtgaccagggtcaccagcagcatagccccaaccccatgtgtgagtgaccagggtcaccagcagcatagccccaaccccatgtgtgagtgaccagggtcaccagcagcgtagccccaaccccatgtgtgagtgaccagggtcaccagcagcgtagtcccaaccccatgtgtgagtgaccagggtcaccagcagcgtagtcccaaccccatgtgtgagtgaccagggtcaccagcagcgtagccccaaccccatgtgtgagtgaccagggtcaccagcagcgtagtcccaaccccatgtgtgagtgaccagggtcaccagcagcgtagccccaaccccatgtgtgagtgaccacggtcaccagcagtgtagccccaaccccatgtgtgagtgaccagggtcaccagcagcatagccccaaccccatgtgtgagtgaccagggtcaccagcagcgtagtcccaaccccatgtgtgagtgaccagggtcaccagcagcgtagtcccaaccccatgtgtgagtgaccagggtcaccagcagcatagccccaaccccatgtatgagtgaccagggtcaccagcagcgtagtcccaaccccatgtgtgagtgaccagggtcaccagcagcgtagtcccaaccccatgtgtgagtgaccagggtcaccagcagcgtagccccaaccccatgtgtgagtgaccagggtcaccagcagcatagccccaaccccatgtgtgagtgaccagggtcaccagcagcgtagtcccaaccccatgtgtgagtgaccagggtcaccagcagcatagccccaaccccatgtgtgagtgaccagggtcaccagcagcgtagtcccaaccccatgtgtgagtgaccagggtcaccagcagcgtagccccaaccccatgtgtgagtgaccagggtcaccagcagcgtagccccaaccccatgtgtgagtgaccagggtcaccagcagcgtagccccaaccccatgtgtgagtgaccagggtcaccagcagcatagccccaaccccatgtgtgagtgaccagggtcaccagcagcatagccccaaccccatgtgtgagtgaccagggtcaccagcagcgtaccctggccccatgtgtgaaagtgtggttttgtcctaggtccaggaaacccatttccagccccgtagggtggatcccagggctctctgagtcagagctgcccagatggccaggactgcttctttggaaaagcaacaatgattagtgagatgatgcagagggcagatgccacgtctgccttcagccctggtgttgggaacgtggctgctgtgcccacaccccaggcttctgaagagaggagagctgggcgttggcaccatttgagcccctaggattattttttgttgttagaactagtttctaaagattcatttttaacattttgcagtgaagaaggaaggaaagatgtcagtgagcgccccgtgaacagtcagctcgtgacacctgccggggataacgaagacgctgtcagcagctggaggctgagctctaagcagtgctttcccaaggaggcctggaaaggcagttgtctgaaagtcagaaactggctcagcccgaactgacagaatgacttacagatgagctgccttggccagagataaacatccctgtggttgggttatgtatttgtcaaggacaattaagaggcactttctttaaaaagcacaattctccagcaacctcgagatctttggaagagtcgggaaagtgcagtgatgagttctgctgcaccctgagacagacagaaggcgacgaccggacagaaaatgccttgaaagtcattcagatgtcacctcaaacctcccttcattccaggcagttcccggaagatgcattttgatcatcgaaggcgtgagtctgctgcatgcgttgccttgacacctggcgccaacgctgctgtttcttttcaggtgagagctcaattaggctgaaagctgtacccacctctcctgcacttcccaggcctagagcagcagggtgcctgcagcggggcctctcgtgcttgagggaggcacaggtccggaaaaggagcctgacccgccccaggagggccctgtgctgcccgagctgagaccccaggacacccctcccaggcccggaccctgcggccctcatggaactcaccagtgtgcacgctgggaataaacgtggatgtgcagcctggaaccttcgtctctaggtcaagagggaacctagggtgtgtttccctcctcttccggcttagctgggggttggaaggggctgttggtccttctctcttctccccattgttatcctgttggtccactgcagcctgggctcctggagagaagagcgcagcccagcctcctcttctgctcccgttgcccacccataagaagtgcttgcacaagctttgtttctcccatgttcctcctcccgtccatgcctcccacccgcagtccttctccttccagctgtttcccatccttgctctgcccaccaggagagctctgctcatcgcaggaggccagactcctggaatgtttctcccaaagtccgccacttccagccttaattccatctcaccttttttattaaaaaaaaaaaaaatgttgatggactccagaatggcttgttagacactgctaggaaccccacaactgaaaatcgctcactgtgttgaatcatgtttttagatgagggaagctcccttgagggaccctgcagagccctgaccaccttgaactttattctgacagctttgcccagcatccaggtaaggcttccagcaggaaacctgctggccacgagctcagagagctctcctctcggtgcaagactgaacaaggacgaggcccttcacgccaaggacatgagtaagggaaattgcctgttttggcctcagcttgggcaaaggaaggggaaaagtcctctgagaattagtgacaacaagctggttcctaagccgagatttatgccatgtgcataatctgagaaacctcaagtggataatggggttgacgggggcgtcctcagtggccagcagaagtgagcacacatcctttctaaaggaacacaacttagatctcaactaattccccagataaaatgatagataacttgaataataaagatcacagaacaccactagggagaggcaggaaaacggcaaaccacagtggcaggtgtcggatgcttgatcgtcacagaagctgagacaagcaggtttgatctatgtaaggaaataaaggaaaggggtgtgtgtgacagagactattagaacatcatcacacgagccaggtgcagcagctccgcctggaaccccagcaccctgaaaggccagtttgtttgagcccagcagtttgagaccagcatgggcaacgtgatgagaccttctctttacaaaaaatagttttttaaaattttaaaatcatcacacatttttggagatgctttttcactttaaaaatcctatttagagttcatctgaaatttaaaactcaatggacagatcaaaaagcacattagacacagctgaagagaaaaccagtgaactggaagccaaatccaaagaaatcattcagaaatcaacgtggcaagatgggaaatattggagagaagataaaacacatggcagtcggaatgggaaggtccagggtgcatcttgaaatccaggtttcaggaagaattgaagatatgatggctttgaattttccaaaattgcttaaagaactcaagccttagattctagaatctcactgaatccaaaataatataattaaaatgaaatcagaacttatagtggaattcagaaccaaaatcctaaaatttgcagataatttagattctctgaaacattcaatggaaacaaatagaagacagaagacagggaaaacacatcttcaaagtacttagaggaaataactatcagtctagaactgtgcccagtgaaattattgtttgagatcaagggtagagtaaaacactttcagacaaaagctgtgagtttgccaccaacagacccccatgaaagaaaatcctaaaggaggttgtcatggccctgtgaaccccactggagtgcattaccctactcaatattggagatacatatcgctaataacagagatccaaaaataaaaggtacctacacatattagagctgtgctgttatgagcaaaatctgatgagaccataaaaagaaattgacaaattcagcagcattttgggagattttaatacctctttcaataattgataagacacacacaaatcagaaagaatacagaaaaatgaccaccataatacacaagtttggtgtaatggacatatatagggtatttccagagttttctgatcgtttagaaaccaatgaaatgttaactagaaaaacctctcacatttggaaatttatattaactcgtgagccaagaatcagtcacagtggaaactgaacagacatctgtgtgaaccgcatttgaactacatttcaaaacttgtggcaatgcagcctaagtgatatttaaacatttggttttctattttataaaacttaacatccattcatgtttgaaaaggggtctctaaatttaccaagaatagactcttccttaacctaatgggcagcctcataaaaatctacacaaacttgtagggttttttttctataagtaaacttgcagtatttcttagacacaaggtcttgctctgttgcctaggctggagtgcagtggtccaaccatagctcactgcagcctcaaactgctgggctcaagtgatcctcctgcctcagcctgcctagtaacagcctacagtgtggaccgccacactcagctaactttgtaacttttagtaaagatggggtctcaccatgttgcccagtctagtctcaaactcctggcctcaagtgatcctcctgcctcagcctcccaaagtgctgggattataggcatgagccactgagcctggccccaaacttgtaattaatactgaaatattaaagtatttactgttaggttcaagaaaaaccctacgttgtattattagattgcatgcttgcctctaatgcccccaaattataaatgattagaattaaaaagcatttatttggtatctacacacaaagtcagtgtacatatgtcatttccacttctaggaactagaacaagcaaaatgtaattttaaaaaacttacagcatcaaaaaattgagtactaagactatatctaatttaaaaactgaaagttctttgagaaaattctacaggtttactgaaagtactaacatcttaactggagagtggcatggtcatggatagacttcgtatcttaaaggtgtcatccaagtgaatcccgtttcgttacaaatgtcaggttttcagtggagaagccatagtcagctttcgctaagctgcgctgcagtaacgagcgatcccagaacgccagtggcttcccaccgcaaaggctttcttcctggctgaaggtgcgcgccatccccaagctggcggccactctgctcctgcgtccattccaggcagagtctgacatggagccagggtgtgtgggacccaggtgaggcggctcccacagggacactgcacaccaatcagtcttggccagccccgacgtggaccggaggtgaggaacagtgggtaggaaccctccgaccatgggcgcagaacaacgcggcatgataatcctggagattgctgttcgtttaaagtgcaatgtgcagacttggtgctggaggcggagctgggaagcaggtgtctgaacgtgagatggaagcattttttggaaattcacttcctcaaatgctcggactggctgtgggcagcggacagttaaggatacccagtgaggcccccagatccccagccatcgggcagggcctgagcccacggtgagccagaagaggatggggggaagatccccagggtgagcagctctgggggcagcagggaggagggggtggccccggagccggcccagcacggggagggggtggtccctgcacgggagcctccgtgggctgctgaccaggtgggatgtccttgtgggagccggtccagagggaggaggtgcggggctgggaggcacagggagccctgcagcctggcctcggcaccacgtccttcccccactgtgacaagttcacactttcctctgcagcctctgtgactcgcctcagttccccaggacactgtggcgccatggaggtctgtcccctccctcctcctcacagcagagacccgggggcatgaggcagcgtctgctccagagtgggcccgatgggcctgtgggccgggtgaaaccatgtgcacagaaagcttgcagcagacaagaaacatagaaaatgtcttttattctccactgcttttcacactcgatgtcagctttcagctggcgggatctggagtgagcgtgtgagatgtttcccagcgtgaggggagcaggtgctgcggtgagctccccagggctggggtcggaatccaaaggcgcagggcggcctcccctccacgccgtcctcccctccacacagggctcccctccacaccgtcctcccctccacacagggctcccctccacgccgtcctcccctccatgccagcctcccctccacgccgtcctcccctccacgccgtcctcccctccacgccgtcctcccctccacgccgtcctcccctccacagcggcctcccctccacagcggcctcccctccacgccatcctcccctccacaccgtcctcccctccacgccgtcctcccctccacgccatcctcccctccacgccgtcctcccctccacggcggcctcccctccacgccgtcctcccctccacgccgtcctcccctccacgccatcctcccctccacgccgtcctcccctccacgccagcctcccctccatgacatcctcccctccacggcggcctcccctccacgccgtcctcccctccacgccgtcctcccctccacgccggcctcccctccacgccgtcctcccctccacgccgtcctcccctccacacagggctcccctccacgccggcctcccctccatgctgtcctcccatggacccggctctcaggctgccctcagtccccggcgtcccaagcccgtggatgcctgcagcttcccagcccacagggaggccccacccgcccatgcctggccgcctgcctgcttcacagacaccccgaggagcagcaggggcacctggagccttggttgtcttgggaggctggtgcacagcccgttcccagagcaagaaagcgtggagccagcagccggcctggcagaggctggagcgtgggagaaagaccccaggacgggtggcgtccggaagagaacacggaatcagggtggagggcggtgctttgggaagaacggcactgggggcttcggcctcctcctccctcctgttcctgagccttctgtactgacagcagccacgtggctgcccccctgcagactggggaggggaatcactcctttccccgggtgatagggaccctggaaccttctagcacgttgcctttaaaggctaattattctgacggtcatttctttcctaaatacctgagggagggagggaggtgtcgttcccgcaacggagttcatggctctgaacgcatgcagtggccgctgtgtcctcgcccccgcaccaggccccgaaggcggcagctcccacggcctcgtccatttctaaaagccccacctccgagaggcacaggagggcaattcacggagggtgttttcgaaccgggacagacggcttcaggaagcctttaggaactgttctgcctgtgagggccgtgaacaggggcagttaggaccctgctgggtgagggaggttttgatgggtgcatctcggcaccaggacacctgcacagcacacaccacggctgttgtttcaggcgtctggggacgtcagacccccaggtcatcaggcaggcgatgcgtccatgagggaggtaaggagaggagggtcgggtgcagggccgggtcctgtcctgctgcgtccgtgagggaggtgagagcccgcctgggcacagggcctgggtcctgtcctgctgcgtccatgtgggcgacgtgaggagaggcgggttgagtgtagggcccaggtgctgtcctgctgggtccatgggggaagtgaggagacgctgccgcccgctcactgccgggaacctcatccttggctgggaaggaaagtggagtcaggaggctgtggccaccagccccagagacccccaggcccgagctcccctcccctggacaccgggccgcccaccccttgcccaggtaggggcaccgttgaccaagactcccagggctgccagctggaaagcagcaggaaggggcacatgacgctgtccagctaccacagagaggaaggcgctgtgggtgtagggcaggtgccaccccccctgcacctcacacatgaccccttctttccctgctcctgagggtgcaggaggagcacctttctctaccgcactggcccaggcggctctcagtgtcttctgaccttgctgtggcagggatggcctctgagtcactgggagctggagcttcagagccggggcaccctcttcccgctgactgcaggccggacccctctcccaaaccagcactcggcctgcccagccaggtcctcctgcccaggtgctgccctggccacccaactatccagatgtcacagtctccgacaggcagaacgtaccgcacttggaattgtgtggtttccgatccttccagtggcttccctggtcttggtgttagaacacgtaagcaaagtgaatttggcaaccaaggttaggacagagacaagctccccacacccttgcattccccgaagcacttgcctcatgtcccaggaaagcctgctatctgcaggcgacatcacgtgtaaaacgcattcgtttttggttttgatgaacccttcggctgtccttttcctgcacggacgcccgacgctactggaggacctctgactgttgatcctgtgggaagagccgcaggcggtggacgcctcggaggaacgagcactctttctccccgagctcctcggcaagggtttcatcacagagtggaggagaaagacccacagaatttacccatctgaacaacccagagaaagcaggctgaggaaaatgcgcagatattcgtatccaacatgtgtatcttcagagtcccagggtaaggggaggaacatgaggctgaaagtcggggatgtcgtggccaagactcagcacgtttggcaaaatacagaaacctgcagatccaaggagctcacagtgccaagtaggacaaacccagacacaccagaattaaacatctaaaaactaaagatgaagatgaacgcttcgcacagcctggggaaggactcacggcctgcagggaaccccagctcaagtggtagtgggttttccatctgcatcgtggggcccaaaggaagtgggactgtttttaggcaccgaaagaaaagaagctccaagagtcacatctggcaaaactgtcctccctggagcccagggcagccacccgcattcccgggatgatgttggacgtgcacatgtttctgcaggggctgctgggccccactttatggacctggacgttactgtgagtcaaagaggaagatgcattcacagcaggtctgtggctcgagaaggtttgcaccttggtaaaatgttaaaggaacagcagcaaacggtgactgagggtgaagaggcgaagctgcaccagcagtggaggtcacgggcgagggtgccaggtggggcggcggcagcagtgagccccaggtactgcccacctgcagcagggacctcacatacctgtggcccggccagtgggcccccacctgggcgaccgggtgaacggacaagccccccgggaccatgcaggcacccaccgtcagcgggtgtcgtgtgcacaaggcttcacacggcccagcccatcctacccagactgcagattctgagcgaatgatgctgttgcttgtcagccactacgttttaggcttttgtgggggttttgttttgtttgggacaggatcttgctgtgtcgcccaggctagagtgcagtgttgtgatcacagctcactgcagcctccacctcctgggctcaagtgatcctcctgcctcagcctcccagctgactgggactacaggtgcacgcacaacatggcatctggcccgaagggtttttttgaacccagcctgataccatcatactcggaacacttttaaagaaaccatgttcctctaaaacgtaccaagcgagggcagccccctcaacccagtcccggataaatcaacccaatggtgtttcggaaccccacagaggcaacattaaacccaaaccttaaggccatttcaggtcacaaagaaagggtcttattccagagcgtggagtgttcagtccggcacatcaatcaacacctgaatgttcctgtaaagggaggtgtcccgcaccgttcccgtcgcatgatctcacgcgtggagtcaacagaagtcgaactcaggcaggagtgggagggtgggctccagggtggggaggggctggggagagggttggtggaaggaccccatttctgctacatgggaggggatgctttgagtccgtaacatggtggcccctgtcctcaggggacacattccgatcccctacacatgccagaagcccgatacgtgtgctatgcactgatttctttatccttgttaatagtttaaccaatagaagattccttcttttggtggattcttagcaacctcagcatgtgactttttccctgtctttcctgagccgagaactttcacctttccacgtaaagacagcactttaggcttctccttggcagatctgaattgccagcatcattgctcttgtgctttggggccaaacattattaagcaaaatgagggtcactttacaccagcactttggtaccgtgacagtcagacaactgagacggctcctgagcaaccaacagcaaggggcgcctgcagcgtggacgatgggcgggtcccgtcctgggtggggcagagcgggatggattctatcgcctgctcagaacgctgcacgatgtaaaactggtacttgccagggacaagaaggaccattcagctttgggacgtgaccaggaggtctcagagagaagcaaacagctgcgtccctgtgctgaggccgctggcgtgggcgcctgtcctggagcccggggtattggcagcgcccagggggagcccagcgacccattgtggctccacatcccacaggttcaccggagacaagcctttgtttttgcagccaccgtcttggcgtagcagctacaactcctcccctgaggtttctggcactccgttctccctgcgcactccccaagcacctcactgaagcccccactcccggcccttcctgtctccgtcacggggcccagcacagagcgggcactcagagtctactcgctggtgcagaagagacagcagcattgagaacgggcgcttctggctccaggagacagcaggggaaccatccaagagggtcctgctgggctccaggctcaggacgaggccctcgcaggtgcctgggggtgcagaaagaccaggaagatcaggggtggcgctccagtgcccccggcacacccatctgtcggtatccaggctggatctccatacaggatttggattgaggaaggggttccctgatagataaaagtagtaataatgacaacattgttataataatgaggacgtttgaaatatcactggtctaagtgactcaccaggtacttttggcaccaaaaaagaagaaaaaaaacacacgacattgtcttttctttttttgctgaaaaagccgattgtttcaaaacacaggtggagagcagcccagcctggccagagcttctgtgcagcctagaaacgcaccgctcagctcattcattcccatccaggacgcagccgccccccttagtgaagaagagagcacagcctggccaggcgcggtggctcacacctgtaatctcagcattttgggaggccgaggtgggcagatcacaaggtcaggagattgagaccatcctggctaacacagtgaaaccccgtctctactaaaaatacaaaaaactatccgggcgtggtggcaggtgtctgtagtcccagctactcgggaggctgaggcaggaggatggcatgaacccgggaggcagaccttgcagtgagctggagagagctctagggtggaggactgtcctggaggatgaagacagctctagggtggaggactgtcctggaggatggagacagctctaaggtgaaggactgtcatggaggatggagactgttctagggtgcactgttatggaggatggagacagctctatggtggaggactgtaatggatgacggagacagctctagggtgcactgtcatagacaatggagacagctctagggtggaggactgttctggaggttggtgacagctctagggtggaggactgtcacagaggattgagacacctctaggatgtaggactgtcatggaggatggagacagctctagggtggaggactgccatggaggatgaagacagctctaaggtggaggactgccctggaggactgagacagctctaggatagaggactgtcctggaggattgagacagctctagggtggaagactgtcctggagggttgagacagctctagggtggaggactgtcacagaggattgagtcacctctagagtgtaggactgtactggaggttggcgatagctctagggtggactgtcacagaggatggagacagctccagggtgaaggactgtcctggaaaaagggacagctctagagtggaggactgtcctggaggatggtgacagctctagggtggaggactgtcatggagcatggccatagctctagggcaaaggactgtcacgaaggatggcaatagctctagggtggaagactgtcctggaagacgaagatagctctagggtggactgtcatagaggatggaggcagctctagggtggaggaattatcctggagggtggtgacagctctagggtgaagggctgttctggagggtggtgacagctctagggtagagcactgtcacggaggatgcagacagttctaagatgaatgactgtcctggagggttgagacagctctagggtggaggactgtcatggaggatggagacagctctagggtggaggactgtcctggaggatggagacagctctagggtggaggactgtcatggaggatggagacagctctagggtggaggactgtgctgaaggattgagacagctctaggatggaggactgtcctggagggttgagacagctctagggtggaggactgtcctggaggacggtgacagccatcgtattgaatggctcccacacagttgggaaggcagcaggaaatgaggttatctaaaaaaattcaagtgggacttgtagacttccgagagtggtggatattttggggagtgttggtggggtctgtgccgtgtaggtgagcctcacactgcacagccgttcacattcgggtgttagctgtcctctgggttggatagcctgggaaaacgatatttaatatgaagacaggaatgaaaaggctgtgcacctgcatgcagaggcgaaacctgtctgcagctgtgtctgtctttggttctttttctgcaagttcccgctcttcttcctccatgctcctgtcccttcctgatttgagaaactcctgccccaggtggttctcatttctcctgctcgccacagccttgccctctgtgacctctggtccgtggcctccccgtgcggctgggcagcctcatcactgccgaggccggggtggtgctcccttgaggcacgagcatgttgaagcattagcagctccaggtctgcccagaggagggcagggggcgtgagctcttcttcccggattcctgactctccaactcttacatgactaggagtccacacagctgacaggccgtgcaggggccggaggctgaggccgaggccacgctctctgcactggagtcgtcgtggttgccctgctgccgtgcggggagccgctgtgtgctccctgtccctgctgagccctgagccccgatgcagagggagaggcctgctccacgatctcacgacgccaagtctgtgctcaccggctccaagaagcactcgcggccgcctggcccaggggctctgatctcagcctgagtacactgggtctttcttaaaaaggcatctctgaggagggagcctcgaatttgctgcttaaccttctgtgtggtttagtcagacagtgaggggtggggcggccccggaccccccagtgcaaaaacaagtgtccagagataaagcctcctcagggctgcagctcccaggagctgtctgagaacagaaggtaaagagagagaagaaaacctgaggaccttcatcagaacagcacacagagtaacaataaggggttcttgttccaaagttcgttgtctttaaaaaatctgttatgtgaagtatgtcaaagagatcaggtattaaaaaaaggtgtatgctgaagacagcataagctacagatgtatgtatttagctgtggttttccatttcagcaacagaaaaagatacaaatatgacacccacgcgcataggaacttaaatttgtttgcatatattacattataaatacatatgtgccttttaaaagattattcctggacccggccccacgtgcagcgtgcggagtggttgttgtcttaagagatccacatccccctcggcttggaggaaaacaggatgacacgttcccagccattctcccgttcagtcacgtggggtcggtgggccgatcactcgccatgggctctgaaaatacgtgtgtggcttaatttcgagttctcacaactcttgagaaaagtgctgtgggtgggttgcaacagcccacacccccttcaacagtaaagccctctggaacagcgcccacgttgcagaatgcctgcagccagcagccgccctgccggcctggccgagcccctggccccaaacggaagcatctgcctggtcatcacccaacgcacaccgcccacgagccccccaggggcgcgcaaggcagtgtggccatcggaagactccatcatggagtgcacgttgtcaggtccctgcacagactccaaagcccggggcctcagcctccgccgtggtttaaaagcctttgtcagccatccttgggccaatcacagtcctctgccactgaaaacgtgtggtttgatggagaagaagtgatttccaaagggaggtgctggtcctatgagaagggcggtttagggcaagaaaaataactgacgtcactcccccgcacacaggcccagactgggaggtcggaggccggaggtcggaggggacgcacaggagaggaaatccaagtgggtctttacaaaaggaaggggtcacctgtgcaaagtgtgggcgggcccgccctgacctggcaccagaatccggagccagaggccgtctgggaaggccaagcacagacactggccgtggcctgagaggactcagctctgggcactgaagaagccagaggattgggaaggagcaccccagatccagccttggtgaggaagaagcagcgacccctgtgaacatcagtgctggccgggtgcacactgtccgccctggtccagccaggactttgcttcctgcatcttagaccctgctgacctcaccctccagaggctgccctgtgaacatcagtgctggccgggtgcacactgtccgccctggaccagccaggactttgcttcctgcatcttagaccctgctgacctcaccctccagaggctgccctgtgaacatcagtgctggccgggtgcacactgtccgccctggtccagccaggactttgcttcctgcatcttagaccctgctgacctcaccctccagaggctgccctgtgaacatcagtgctggccgggtgcacactgtccgccctggtccagccaggactttgcttcctgcatcttagaccctgctgacctcaccctccagaggctgccctttaatgctagtcaggggcttcccggactgggaccctgttagtcacttaaaaatcctaagtcccggccatgcacagtggttcacgcctgcaatcccagcactgtgggaagccaaggcaggcagatcacttgagtgcaagagctcaaggccagcccaggcaacatggtgagactccatctctacaaaaaataaataggtcagccgggcgtggtggtatacgcatatagtcccaactacttgggaggctgaggtgggaggattgcttgagcctgggagtttgaggcagaagtgagccgtgatcacctccctgcactccagcctgagcgacagagtgagatgctgagtcaaaaaaaataaataaataaacaaaatgaaaggcaagacactgagcactgggtgaggttccacatttcacgtccaggcagggaggcaagagcggcggaccccgcttctctcacctgcatctcaatctgccctcctttttctccctatgaagcttattgcacattttcaggtatttccagtttactcacacatgcacatacgtattaagcaaacggtaagaattataaagaaatctgcatgtaaacagaattccccaagaatatttggccgtgtgattacctgatatgagacatgcaaaccagttataacaggtgagcctgagagccttgagcctccagaccgtttttccttcagggttccatttgagtgcagtaatccgcccatcactcacaggtcaagcaggaaaagcagtgtcaccactgtacaggcatcaccactgtgctgctaggcccggctccaaaataaccacagcttgacctgcaccctccctggagttaacaccacggtcaccacgtgccccgccagggctaagccaatgagaaggtccctggtttcagaactgaataaacagccacctcgtggcatgaaacatatcatgtccttgaaaactggagctgctctaaggttgcctttgcaaatgaagtgacctcctgtccctgctggtctggagatatctcgccaaggcccgggcgctgagaactgcgtgccacctcctatgtgacttttctcctcagtcgtgtcccaagcatgcagccccggcctccacaccaactccgcatgttgagcatgcctggtggggggggcggccaggaggaagcagagccaggactggctcccagcatccctgatccccccaaggtgccctcctcgccagggaagaagtcccagctaagcatcaatgaggcttatccttgagggaaaggcctggagacctctgggagcaccaatggtggcccaggccccgctgtctggcagggcacgtggcactccagggctcatcttccaccataacagatgcgggaatgtggggacctttaaatcccgctcgggttttgtacaaaggacatcttaggagagaccttctccctctgcacgcttcacaacaacgctcatctcccatgagccctggtgtttctctagatccaaagggctgtacgaagggcaccttaggagagaccttcttcctctgtgcgcttcacaaccacgctcatctcccacgagccctggtgtttctctagatccaaagggctgtacaaagggcaccttaggagggaccttctccctctgcacgcttcataacaacgcttgtctcccacaagccctgctgttactctagatccagagggctgttgcatttccttctaaaattcaaatgttcccctttataacttggcagagtccaatttgacacaaaaaaacaaaaacaacaacaaaaccccacattttaaagctatagcagcatttggcattttttctcatcagtggcaaacatctccctggtcgctgcacctgcctggagattccccagcagccctccccagcatctcgcagcgcccaccatcgctctctgtacctgtttgaaaagctgcggagcctttgtatttttggtcctgataatctctggttcataagtgttgaggggtaaggaaatgtagtaaaatatgtgggcaggggaacagttcagatgccgggcttctaccccccagcgtgcagcttccctctcaggctgaaacgccgactctgcagcccggcgactgcttcccaggtgactgtttccagagtcaggtgttggccgtggtcaggttgacctgcctgtttgttttctataagctgtgtgtgttgtgcccgggtgtagatgccctgaggtttcacggccccccagcaagcagccccaggcccggcaccggatgggcccttcatacccattcactgtaacagacaagcagacggatgaggccatcgtggtccctctgaataaacgatgcttcacagaagtctcccctttcaaaacacgtacagcgaatgactcgggcttcagagccaccctggggtgccgtcggctggtgggtgatggagcggctctgcctggctcctctcggctctggcgcggcaggtcttcctgctttccaagcccgtgtccctggtgccagcacagaactgaactccgcccttgagtcgtgcgggacgagaccccgtgctgcgggcgcagtgccctctgtgggcggcgcgtggtggctgtcctccgtttcccacccggcgtctactgggccttgtccagtatcactgggagctgcaggctcggctagcaggtggctcccgtgccatccccgtgagctccgcctggccctgctgctcccgcccggaaagctcagacccataacccagcccacttggcagcagcgtgccgcctgatcggcaaggtttactccctttgaaaatctctgttgggtggccgggcgcggtggctcacgtctgtaatcccagcactttgggaggccaaggtgggcagatcacgaggtcaggagattgagaccatcctggctaacacggtgaaatcccgtttctacaaaacacacacacacacacacacacacacacacacacacaaaattagcctggcatggtggcgggcacctgtagtcccagctacttgggaggctgaggcgggagaatggcgtcaacccgggaggcggagcttgcagtgagccaggatcgcgccactgcactccagcctgggccacagagccagactctgtctgaaaaaaaaaaaaaaggaaaaaagaaaatctctgttgggcacatctaaacgcacccaagcttcctaccgcacgtctctgcgaggagccgggtctccgaggcatggctcctgtagtacccaggagtccacgtgtcacgggcgtgcgtggtgctaagctcatgcctcagagctgatgaacactgggaagcctcaaaaatgccctccagctaaaggggtctttttaaagccacttcttgttgatatttatctcaccatccaacaagcaaacatttgtatgcaaagcaaactcagaatcagcattcccgccagttactaaggaaaaatttgcccttgtgatgcttcacctggtgattacatttcccacttctgataacagatgggaaaatgcacaccgctgggggaggagggggaggaagaagagggggcaaagggcagcaaaagcagcctgcagccaaactgtggcgtcctcagacccccacaagcagtggcgcctgtccatggcaccgtgatgtgcctgttccacaggatgacatcacacaggatgacgtcccatggatgacatcataaggatggcgtcacaaggatggcgacactttcaacccggggcgtagacttgggaagagcgtctatacacttggtgttgcccagtgcatcctacaagtaggttacgaaagggcgaccggccccacgacgtcacgtggaggcactggggcgacgcggaggggaagaagtggacacagtcggcgcgctgggtgggaacgagggccgaggctgatggcagcctggtaactttggggcctgtgacaggcaggcgctggggttgaagtgtagaaaagacgaactcagtgactgaggagggaatgacaaatgggagccgagtttccagaaaaccaacccctcttccctcccactgcttcacccaaaggaaagaattcggaagtgaagccctccccacatatgggttcaaagttgcctttaaatgctttgtacctctcgccggggccggtcccccatagggtgtggatgacagacgcagccctgcccttggctgctgtgcacgccatgcctccctgcgtggtcacgcctgtcacctgtctctgtgccgtctcccacacggtcacgcctgtcacctgtctctgtgctgtctcccgggtggtcacgcctgtcacctgtctctgtgccatctcccgcatacaagcggaaacaccttgatcacagagaccctctttgtcacagctcagcatacggccctggactgagggggtaactagggaaagctcttcagtgaatgaaagtgaatcgttttacaataataggaaacaactcacggtacctgtgtccctgtggacaaacagtgtttccggggtgggtttgagccgccagcgtgtggtgaggcagagcgtcccgggtttgcggcttggctgacttctgagtcagcggctggggcatcggcttgtgctccgcaaggacgagcaggggtggcccctggccgagccaccgcacgctccccttccgcagttcctgacggcatccgctgtatgcagatgctacagaaacgcgtgttcccttcccagtgcacccggcggtaacgctgcaagaattttaagtgctgggtcccgctctggaccccacaacttaacagcgtgggaacactcggggtggacttaagccacagccacacggattactcaagtgttggcagataaatctcatgaaaaattgctgacagaattggaattactcagcttgaagaaaggagatgttatgaacatattcataacagcccacatctctatttttagcccctgcaattcccattttgggggccgggaatttggagggtggtcagagcctgttcactctgggggctgccgctgcctgccagggagcctggtgggggctgctcggcagctcctgagccagctgcaccctctgaacctgttttctccagtgagccggccgcaccccctgaacctgtcaggatcacattctcctttgtggccatgaatattcagcccccaaacaatgaacataaacagggttttgccttttctattcctctaaattgtatctgaggcctcactaaaccttcctcacctgtgcaatgagaagggaccagatgacttctaagattaagtagaagcaactgaaatctcatttcagctctaaaatagcccgatttcctttattttaacacagtttggggtgggcatgcaggtgcatggtcccctcaggtcaaccctgccctcatcccaccccaggggcactggcaatacctggaggcagttctgattgcacagcatggcggggggtcccactggcatcaagcgggtggggccggcctgctgctggcaccccgagacacacaggatgcccatgtggggaagcccagccacaggcctacatgccgtgccgaggcaggacagcctggcctgctgtcactgggtcaagtccctggcactgagctgtcacaggccacagcgctattccccatggggtcccacagcacggggctcggccagacccgaccaccactgccccggatctcagctattccccatggggtcccacagcacggggctcggccagacccgaccaccactgccccggatctcagctattccccatggggtcccacagcacggggctcggccagacccgaccaccactgccccggatctcagctattccccatggggttccacagcacgggacttggccagacctgaccacgactgcccgggaactcagcccggttcatcagggtcgttggtgcccctggccacaatagccatccttgagaacacggcacctgagccacaccagccaggtagttttgccagaaccttctcttcactggagccactaagatggagcctagaaccatcagcctctgtctccctgcatgagcacctgctggggcagggccaggacggggcagcagtgccagacacagggagagggcatgtgccccgcggactggtttgagccggggctcaaagtaaaggggcaaactatagaaataaaaaagtaaaatcatcactgtctagtagcctcccaggcgaatgggaagtgtttctgcaaagcctacgattcttttatctgacctgaagttggaaatacatcaaccagaattatttttccttccttccccttcctttttttatgtgaggaagtctgaaatttagggtcttcctgtttaactttattccctcagttgttctgtggtcaggagcagcactttaaattctcagtattttacaaagttgtgaaataacctgcttgtaaaatgccattggggtaaatcagcagctttcacagcttaaaccccaaaggtctgacgtgggtgagcggctcctcctatcccagcgaatgtggcttcagggacagagaccagagagtgcccagggtcccctttcctcaagtcgtatgctttccatgttttatgactgtcgaagttacacaagttgtttgtagaaaatatggaaattaccaagaagcaggaaggggaatccgaatccctcaaatgcagcggggagacggtgtgactttgcctcctgttctccttcgttcctgctgagtgtgagaggcctgcttaggtgctgagaggtgtgaggggcactaagcctccaggcatccagcaaccctcggccgcgtgtcgcacacatcccgggtttcggacgagtgtgaagctcacggaaaagccaggtgggttctccaaggtggagccacagggggacaggagagcgtcggtgaccagggtcagcatccggtgaggtgcagttttgtcctgcctttcacctgagctcctgaggggtgcccggtgcagaaaaagtcttcagagacccccccagtggccgcgcgcaccacgtggttgaaccccgaagaaggctgaactccatccaagcccctgaggccagacatctccacggttcccagttttccaatactgcggaggtaatgcctgttaacgttcttggaccgatactttctcggctctcgtttatttccttaggagagaatttcagaaccggatagccggggcagttagaagatacttgcctaattttacgggaaaagtgtcattgttttaatttgcattctttaattataagtgagcttgaacagttttttccaatgttcgatatttacattttttgtcacttttattttagtcctccgcgaaggagcctctcaaatattcccggagcacaggctaatttagaacgtgttatcctgacaaggcggcccagccagggaggagacgccggggtccgcgccgcggggcgggcgcttccccggacccgggggaggcgggacgcaggcgaaggccgccccgggagagcggggtcccgggagagcggggtcccggctgtgggggacgcgggccgaggctgtcgcgaagccgctgacggccgaggcgctcccggttttcgcggcgcacaagggttgcccgagcgctcagagcaggggccgccacgcgggcgcccggtccaacccgcggcctcccgggtccctcctagcggggccgcagacgcccgcgagccgcgtccccggagcgcagaagatccccgcgcacagcgcaggccccgccggcccggtggacccgcttgaggacgcggagggggcgcgtttcctctgcggcgcccgcacggcctctgcccgcctgtcccgcgctcccgcccggcaggcccagctcggacgaggctcagctgccgcccccgttgcctttgtgggtttttctgcggaagccccttttcctcgggtggatgggaccctgcgcgtggaaccccgcacagcccccgctccgccgcgggccgcaggacccattccttctccacggtggcgctggggaggggctgcttccacccaggagattcgcgagggagagaaaacatgcggctcacatccggacggcagccccgccccgcttagaaacaatatggccagtttgctaatgaaaggtgaaattaatccatttcttcggaacactcggggtcgcacccagggcgcaggtgggtctgccctgtgcgaatgacctccgccccccgttggccccccgcgcagggaaccgccccgcccttcccggccacccccaggagcaggggctgctcttccttcgcctttgctcctcatgggccctccccggcggcggtcgccgcgtccctgtgggatgctgtgtcggcccggctcggggtctctgggttctggggaccggagccccggtggttggacagggcaggtgcaggccccggggcttctcccacagacagcgtggcctttgctctggcagcgcccgagagcagcaccgcgcaaacgccagcccaggcttcgggagggcgcctggttccagcgctgcacacactggggcgaggcagggtgagagagcacgcacatatatgcacactcacacatacagacatgcacactcagactcacacatgcacactcacacacgctcacgcacactcacatgcacgtgcatgcacacacgcacccacacatgcatgcacgcacacatgcacacaggcacgcactcacatgcaaacgcatgcacacgcacgcacacacacatgcacgcacagacatgcacacacgtgcatgcacacatacatacaccacacccacatgcatgcacgcactcatgcacactcacaccatgcacatgcacgcacactcgtacacacgcatgcactcacacatgcacacacgtgcacacacgcactctcacacgtgcacgcctgcacactcgcacactcaagcacacttgcacacgcactcccatctcacagacctgggcacacaggcacatacgggtgtgagtcagcagcacgggtgggctcaccacagaatctgagcgaggcacctcccacggaacctccgtgccctcccaggatggaaaccccacggctccgctgctcccagggggccccgcatgccccccgccgcgggggcaagacgtgaacaggccaagcactgccctgagcggcacaggaggccctggagcccggccggctcaggctccccgcaaggaaagcagcccatccacggaccaggccttagagccacgggcgcacagcgcggtgcacacgcgagaggcagaatgaggaacgggctcgcgggctggacgctggcggggacaggagcctccacaggggccgctgcgggaaattcccgggccccaggctttttgcgcagggacctcgtcttgtccttggtattccagaggccatgaccagactctagtctcataagaagtacagaaattcctaaattgctcagaggtgcctcctgtgccaaggaaggggacgtccgtgcccctccttgtcccggggagcacggctccatggcgcccgctgtggagctgcggttctcaccatgggcaggtgcgaggccgtagactggtgtggtcagaccaggggactcctgcgttcaccctgggccccggagactagtgatcccgctccccagcagagcaccgccaaaagccccgggtgccggagctgtcctgcaagaatgaacgggcaggagacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcatatgtttaaaagatgagcacacaaaggactgtgcacctgccgcggagtggcgtcctctgggagaagctggagagtttgaaggggtggacaggaggcgggagacaggggaagacggagctcagacctgtaggggctgctgtgctggcccagagtgtccagggtttgggagtggaggaaggaggcaagtcttttccagttagggagaaaccacacagaccctgaaacccggtccccacatgcagacccaaaacccagtcccatcccaggaggctgggccaccaccgttgtgggtgctgagtcccttactttctgcctcacccgttccactgagcctctttcgcgccaccctcactgtcatttgcaggaaacacctgttctctccatgcacctgctctgatgcactgacttgttaccgggaaggtggctgcttccaaggcaggccaagatgcctgcggcttgttattcgtctgagaatggctccttgctctaacggggtttgagggacagacgggactgcttccttccctccttccttccttccctccctccctctctcctctctctccctccctgcccccccccttctctccctctctctctccctctctggttttctctccctccctctcattctctctagcactttctccctccattctccctctgattctccctctttctcagtgctgcctcctgcctctatgatctgaacaaattttctgtggagatcgaagttggtagggggcagggggtggcagcctgtgtttttggtagaatttcaagcacgttttacaggaggagctgacactgtcgggccattatctttcctgagcaatgacagcagcacctcctggccttgggtcttatcatcatattgttcccgagtgtggctttcaatgcagctaattacataggttgttgttttcttccacagagttttccagcctctccagggcagaggctgtgtctggtgaatgtccaggcactgcagcgcctggcacacggcactgggtaggtgcttaacacaacatgtgaacaaatatttattgaactacataaaggtaaaccactccattcacagaagagaaatatctctgttgagaatgtcatggatgccacgtaattggggagcaaaaggaagccccagtcacccacaacctttcacagcacacggtgcagggctggacagtgcaaataacttacaggggtttcctcatcaaatccaaggccatttcccagaactgtgacagtagtgaaatggaatgttacattcacagcacaaaattgacagagacagaaaggacgtctgcattccactgtgggtttaaatgaaacggtgagatgctcggaggaagcgccggctgcttgctgcatcaggaacgtttcgtaatagcaaaggcactatcgggaagcgttacgtaagctgtccattaaggacactgattaggaacgttcagaaatatgaaaaccgcatagcattgtttgctggcctcaaccacatgcagcttgctttcagcaagagggaaggaagtgatcacagaaggtgcaggtcactgctgggatgccccctgggctgagataactgaacgtatgaaactgctcccttgccaacagctcggtaagaacgcaagtgctcgcgttacaaaagaatttggcatgaagagctgttcgtcagagagcccaccagagtcgtgtatacgtttgaatccacttccaacgttttaatttacacaaatttcaggagcacactattagccgagtggaaggtggtcttatcctctgcaccacacgtgggtccgagaccccagagcacagtcgtctccctcgccaagaatgcactcggcagccagggactcgcagagtgaacgtgtgcgggtttcagtggaccgcttcccatctggagctcaagttaagatgaggaagtagaatcacagtaaatgaggagttagggaatttagggtagagattaaagtaatgaacagaggaggaggcctgagacagctgcagagagaccctgtgttccctgtgaggtgaagcgtctgctgtcaaagccggttggcgctgagaagaggtaccgggggcagcacccgcctcctgggagagggatgggcctgcgggcacctgggggaaccgcacggacacagacgacactataaacgcgggcgagacatcagggaccgggaaacagaaggacgcgcgtttcgagcagctgcccagtgggccacaagccccgccacgccacagcctcttcccctcagcacgcagagagggaggctgcagatgccagaaacgggcccctgtctcccatgaacaagaaacagaaaaaaaggaagagagcagagagccaggcagatgttcaggagaatgaacgtgtccgaaagacagacagaagcccggggactgacgtccgtgggagctcctcccgcactgcagaaggtgagttcctgggtcccctcagtaccacgcacggggaaggcagcgggcggaggtcgggagggctgagggacacaggtttctcggtggggtggtgaaaatgctttaaaatggatgtagcaacggctgcacgcgctgaataaactgaaaaccactgaatggtgcaacttaaatgggtgacttgtatggtgtcaatcctatctcggaaaagctgcagaatatatcatcttattttgaaaatcagccaagatatgaaaattatagtaaatgtctagaagaaaatgactaatttggaaaatactagtaaagaaagtaatttgacatctaagtttatgacagtaccacccacttcctcatttccaccttcagtgaacacttgcggacagcatgcttcagagcccggcccatgccaaggcccaaggacacagataagaaggtgcccctgcccaagaggcttagcacccaagacagataagccagtggacacagaggcttgctattcgttttcttttcttcctttctttccttttcttttttctttttaatttttttctttttttttttgagacagggtctctctctgtcacccaggatgatgtccagtggtgtaatcacagctcactgtagcctccaactcctggggcttaagtgatcctcccacctcaacctcccaagtagctaatattacagggatgtgccatcacattcagccaatttttcaatttttttttttgtagtgacagagttgtgctatattgcccaggttggtcttgaaatcctgggctcaaacaatcctcctgcttcagcctcccaaaatgct

SEQ ID NO: 415 - DNA, 20001 bp, Homo sapiens
aagattgcttgaggccaggaatttgagaccatcctagacgacatagagaccccccatctcaacaacaaaaataaaaaaattagccaggcacagtggtacacatctgtagtcctagctacttgggaggctgaggcaggaggatcacttgagcccaggagttcgaggctgcagtgagctgtgatcccaccagcgcactccagcctaggagacagaggaagaccctgtctcaaaaaaaaattttttaaggaaaattttttaagaaaaaaaatgaggggagcctacagaaataactttgagtgtccacctgtgcaaaacccatgtcatggggacacagggacatgttagctgtggtgcagatgagtggtccgggctgcaggcctgtctgactcaggtctcagacatcggctttggcctgagggcctggaaccagcttggtccccatatggcagtggccccaagccaggggccttcacctgtgtgacctggtgacagctgctggctggctgctgcccttcctgacctttgctctccacacctgcccctctcgcaggcctttcctctgtctttcagtcccgctggccagtgcccttctcccaacaaccccaagggctgggggacttcattcctgtttcccagatgacacaagtggagctcggggaggttgagccagtggcctaaggctacacagatctgagcttgggtttgggggacatgagactcctcaggggctgccacctgctctggggtctggagcaaggaccctgagacttgaaagttgaaatggcgcctggaaccaggtggtggactaagcaatggcgggcaggtcggtgtgtccccaggagtcaggagaggctgccacaagacaggagtgagcaggaccttaaagctgaaacgccggatggtcagggcatgatgggacctgacacggcctggactaggagggggtgggaagaataatacgggacatcatatgtggcagggggtcatgcgctttcccatccagccatctaggctggctctcctagattctttttgttttgttttgagacagagtctcgccctgttgcgcagctggagtacagtggcaccatagcctctcgagtagctgggacgacaggcgcgcacccacacccagctaatttttgtattttcagtagagacgtggttttgccatgttggccaggctggtgtcaaactcctgacctcaggtgatccgcctgccccatcctcccaaagtgctgggattacaggcatgagccaccaggcccggcctctcctagagtcttgcttccatcaagtcatggagtctccttttccttccctggagtttgagtgtacttgggactcactggtaaccaacagagttcaatggaagtgacatcatgtaactactaagagtaggtcacagaaagcacagcttccgccttgcttgctcgctcactcttgaatcaccagctgccatgtaacagcctgacttcctggagcctgccattttgtgaggaggcccaaccaagcccatgctataaggccaccaagaccacgggaagagaaagcaatggctgccccagccctagccctcagctgtcaccagctgcatcagagaccctgagcccgtaccgccgagctgagcccttcccacattcctgacccttagaaaccacaagagctaataaacacattgttttaagccactaagctgttaggcagcaacagtactggaacatcataaaataattttttaaatgacagggatctaattaaacgtggaaggatcttgagaacattgttgaggatagaacagcaggctgcacagtgaagcaaatgtccagcaagatggacacacactggatcctggatatgtgttctggaccatgtcactagtacatcacatttagagaaagctgtgtcaggacccaccccaaacacaaaacagcctgaactgctgctgttacccttggcagtgggggagggaagggtggcgttaagagattccccaagatggtgaggtcacctggccattttattttttatttttattttttatttttgtatatatatatatatatatatatatatatatatatatatatattttgagacagagttttgctcttttgcccaggctggaatgaagtgacgcaatctcagctcactgcaacttttccccccaggatcaagtgattctcctgcctcagcctcccaagtagttgggattataggcacccgccaccacgcccagctaatttttgtatttttagtagaggcggggctttgccatgttggccaggctggtctcaaactcctgacctcgtgccacccacctcggcttcccaaagtgctgggattacagacatgagccactgcacccggctgcctggccattttaagagccactttttgggccgggtgtggtggctcatgcctgtaatcctagcactttgggaggccgagttgggcagatccctttttttttttttttttttttttgaggtggagtcttgctcagtggcccagccatgagcgcagtggtgcaatcttggctcactgcaacctctgcctcgggttcaagcgattttcctgcctcagcctcccatgtagctgggattacaggcacgtgccaccatgcccagctaattttttgtatttttaatagagacagggttttgccatgttggccaggctggtcttgaactcctgatctcaagtggtctgcctgcctcagcctcccaaagtactggcccagtttctgtatgtttgaatagagacaaggtgtcactatcttgcccaggctgatctcgaactcctgagctcaagggatcctcccactgcagtctcccaaattgctgggattatagggtgtgagccattgcgcccagccagaacctcttcttgattcctcaccaatgttttggtcaacagcacacttggattctagtttctgtcatggtctcaaagatttctactgaaataagaccgttcttggtcgtgccttgtggctcaagcctgtaatttgagcactttgggaggccaaggtgggcggatcacttgaggcaaggagtttgagaccagcctggccaacatggtgaaaccccatctctactaaaaatacaaaaattagcggggcatggtggtgcatgcctgtaatcccagcaactcaggaggcagaggcaggagaatcgcttgaacccgggaggcggaggttgcaataagccaaggtcatgccactgcactccagcctgcccaacacagcaagactatgactcaaaaaaaaaaaaaaaaaaattcttacctgctggagcgttaatatgaatgaggtgtccagagcccagctcctcctgatccacccatgtctgattctgcttctgtgtccccacctcacaagtggccactggcctacaaggagtccatgtcagctgccatccctttccatcaggccacaccagccgatcccccctcacccactcattctccttcctaaatatcccctcaacccacccacctctctctccacccttgaccttcacctgcaccagcctcagcctatagctggcctagaccagcatggtcaactccttggtttctccgcttccacccacgctgcgctccatgtggccagagggttctaaactcttgcagttcctcaatgcacaagggggcctggtcagctgagcctggcacctgcccagccttctctaagcctcagctaaaattctataccacatacttctagacactggcatgcgcaggggcctgttgttgcaacccctcatgtggtgaatctccctcagagccctcagacatcagttcccgccccttcttgccttctttggtaatctggggcaggaagcacttggggcgggtcattgtggctcacgcgtataatcctagcactttgggatgctgaggtaggaggatcgcttgagcccagacgttcaagagcagcctaggctctacaaaaaagtcctacaaagctcagttttcaaagcatatttctggccgggtgtggtggtgcacgcctgtagcagccagctacttgggaggctgaggcaggagaattgcttgaacccggaatgcagagagtttgcagtgagcccagattgcaccactggactccaacctgggcgacagagcgagactctgtctcaaaaaaagaaaaaaagaaaacagaaaaggaaatgctagtgtgtatgctgaataaataagcactttgagaagttgacagggaggctaggcatggtagttcacacctgtaatcccagcacactgggaggctgaggcaggaggagcacttgagcccaggagtctgacatcagcctggacaatatagtgagacaccgtgtctacaaaaaaaaaaaaaaaaaattatccaggcatggtggtgtccgcctgtagtcccagctactcaggaggctgaggtgagaagataacttaggttgaggggggcaaggctgcagtgagctgtaatcccaccactgcactccagcctgagtgacagaggaagactttgtctctacaaaaggaaaaaagagaaattgacagaagagaagttcctcctacttctattttttttttttttttgagatgaagtctcactctcgtccaggctagagtgcagtggctggatctaagttcactgcaacctccccctaccatattcaagagattctcctgcctcagcctcctgagtagctgggattacaggcacccgccaccacacctggcttttttttttttttaaatagagacgggattttgccatgttgatcaggctggtcttgaactcctgacctcagatgatctgcccaccttggcaacccaaagtgctgggattacaggcatgagccactgcgcccggcctcttatttctttagaggccccaaaaaagaactgcaaagaagaaacacgagtgcattagaaaaactgttcaggctgggcacagtggctcacacctataatcagtttcagaggccatggcgggaggatcgcttcaggtcaggagtttgagacccccttggggaacatagtgagagtcctgtctttatttatttattatttatttatttatttatttatttattttcttgagacggagtctcactctgtcacccgggctggagttcagtggtgcaatctcaactcactgcaagctccacctgccgggttcacgccattctcctgcctcagcctcctgaatagctgggattacaggcgcccaccaccacgcctggctaatttttttgtgatttttgtagagacggggtttcaccgtgttagccaggatggtctcgatctcctgatctcatgatccgcccgtctcagcctcccaaagttctgtgattacaggcgtgagccactgcgcccagcctcctgtctttatttttaaaagaagggcgcagtggttcaagcctgtaatcccagcactttgggaggccggggcgggcggatcacgaggtcaagagatcaagaccatcctggccaacatggtgaaactccgtctctactaaaaatacaaaaattagccgggcatggtggcaggctcctgtaatcccacctacttgggaggctgaggcaggagaattgcttgaacctgggaggcagaggttgcagtgagccaagattgcgcctctgcactccagcctggggacagagcaagactccatctcagaaaaaaaaaaaaaaagaagaagaagaagaaaggggggaaaaaaagccgggtgtggtggctcaaacctgtaatcccagcacattgggaggctgagcaagaaggattacctgagcccaggagtttgagaccagcctgagcaataaaatgagaccttacctttacaaaagaaattcacaacttaggtggtcatggtggcacacacctgtgatctcagctactcgtgaggctgaggtaggaggattgcttgaatccgggaggtgaagtctgcagtgagctgtgatcacatcactacactccagcctgggtgacagaattagactctgtctcaaaagaaaaagaaaaaaactggttataaatcctcttaataagtaaatgatagctggacatggtggtgcatgcctgtaatcccagctactcgggaggctgaggcagaagaattgcttgaacccaagaggcagaggttgcagtgagccaagattgcgccactgcactccagcctgggcgacagaacaagactctgtttcaggaaaaaaaaaaaaaaaaaaaagacgttctcctatttattagcatactgttcacaatagccaaaatatggaatcaacctaagtgcccatcaatgtttgaatgaataaagaaaatgtggtgtatatacacaatgtagtactacactgccattaaaaagactgaaattttggccaggctcagtggctcacgcctgtaatcccaacactttgggaggccaaggcaggtggatcacctgaggtcaggagttcgggaccatcctggccaacatggtgaaaccctgtctctagtaaaaatacaaaaattagccaggtgtggtggcgggcacctgtagtctcagctacttgggaggctgaggcaggagaatcgcttgaacctgggaggtggaggttgcagtgagatgagattgcgccatccagccggggcaacaagagctaaatccatctcaaaaacaaaacaaaacaacaaacaaacaaaaaaacaccagcatcactgaaatggatcataaactatgttcttttattgaacagaccagaagaaacctactttaacctttaaaaaagaaaaaggaaagccaggcgcggtggctcacatctggaatcccagcacattgagaggccaaggcaggcagatcatgaggtcaggagttcgagaatagcctggccaacagtgaaaccccgtctctactaaaaatacaaaaattaccagggtatggtggtgagcacctgtagtcccagctattcaggaggatgaggcaggagaatcccttgaacctgggaggtggaagttgtggtgagccgagatcgagagccactgcactccaacctggcaacagagcgagactccatctcaaaaaaaaaaaaagaaaagaaaaataacttgcccaaggtcacacagtaaaagacagaggtagggtttctgctcattgtgattctaaacggctgtccacaaaatcaaagttaaggtaaaatactctctcagaaggccccgtaagggcaggtggcactttttctttgaagcctgtatgtcagaattgcaatcagttacaccaacccatttaaatcagtaggattgcccgggggtggtgagtggtggctcacacctgtaatcccaacactttgggtggccgcagagggcggatcacttgaggtcaggagtttgagaccagcctggccaacgggcgaaaccccatctctactaaaaatacaaaaataggccgggcgtggtggctcacgcctgtaattccagcacttggggaggccgaggcgggcggatcacgaggtcaggagattgagaccatcctaacacggcgaaaccccgtctctactaaaaatacaaaaaattagccgggcatgtggcgggcgcaggaggctgaggcaggagaatgacgtgaactcggaaagcagagcttgcagtgagccgagactgcgccactgctctccagcctgggtgacagagtgggactccatttcaaaaacaaaaaacaaaaaactaaaaactgtgtggtggttccctctccagaaaataagtggaattaccataggacccaagcagttccccttttgggtatatcaccaaaataattgaaagcaggatggccaggcgcagtacctcacacctataattgcagcacttggggaggccgaggcaagcagatcacttgaggccaggagtagttcaagtgcagcctggccaacatggtgaaatcctgtctctactaaaaatacaaaaattagctgggagttgtggcacacacctgtagtcccagctactgaggctgaggcaggagaatcgcttgaaccccgggaggcggaggttgcagtgagtggaaatcacgcgactgaactccagcctgggcaacagaaagaaactccgtctcagaaaaaaaaaaaaaagtgggagctcaaagagattatttgcatgtccatgttcatagcagcattattcatcacagccaaaaggctgaatcaacccaagagtccgtggatggaagaacaggtaaacaaaagatggtgtatccattcaatggaacattatttggcctttaaaaggaaggaaattctcactgagcatagtggtttatgcctgtaatcccagcactttgggaggctgaggcaggggggagggggcggttcacctgaggtcaggagttcaagaccagcctggccaacatggtgaaatcccgtctctactaaaaatacaaaaaaattagccgagtgtggtggcacacacctgtaagccaggctacacgggagactgaggcaggagaatcgctggaacccgggaggcagaggctgcagagagccgagattgcgtcactgcactccagcctgggtgacagagcgagactcttgtcttaaaaaaaaaaagaaggaaggaaggaaggaaggaaggaagttctgacacaggctccaacacagatgttatgctcagtgaaataagccagacatgaaaggacaaatactgcctgatctcattcataagaggtccctagaattgtagaatggtgtgtgccacgggctgggagggggtgtggccagagtttcagtttgggaagttgagaatgttctggagatggatggcggtagtggtggttgcacaactgtgtgaatgcgcttaatgcctctgaattgtgcagttacaagtggttcggatgggccgggcgcggtggctcatgcctgtaatcccagcactttgggaggccgaggcaggtggatcatgagatcaggagatcgagaccatcctggctaacacggtgaaaccccatctctactaaaaaatacaaaaaattagccaggcatggtggtgggcacctgtagtcccagctacttgggaggcggaggcaggagaatggcgtgaacacgggaggcagaacttgcagtgagccgagatcacgccactgcactccagcctgggcgacagagtgagactccgtctaaaaaaaaaaaagtggttaagatgggccgggcatgggggatcacgcttgcaatcccaacactttgggaggctgaggtgggtgattacgaggtcaggagttcgagaccagcctgaccaccatggtgaaaccccgtctctactaaaagtacaaaattagccgggtgtcgtggcacacgtctgtaatcccagctactggggaggctgagttgggaggatcacctgagcccagggaggtccaggctgcagcaagccatgattgcaccactgcactccagcctgggtgagagagtgagaccctgtctccaaacaaacacacatgaaaaacagattttttttgccaggtgcagtggctcacacctgtaatcccagcactttgggaggccaaggcgggtggatcacgaggtcaggtgactgagagcatcctggctaacacggtgaaaccctggctctactaaaaatacaaaaatttagccgagcatggtggtgggcacctgtagtcccagctactcgggaggctgaggcaggagaatggcatgaacctgggaggcggagcttgcagtgagctgagatcacgccactgcactctagcctgggggacacagcaaaactgtctcaaaaaaaaaaaaaaaggtttttttaatttaaaaaggaaagaaaaggagagtgctcgtgtggcaggcacctagccctgtccagcgcaccctgagacagggatgatgtctcctccttgacctaagaccacaagttctaaccaattcaaccgaggacagagccccaattccaggcagggcaatggggtcgccttgtgaactaagatgcagatggagaagagcagacacagacacaggtcttggggcccctgcaggggtttctcactggctttttccccctggattcctatgggttctggggaacagagttaggtcggctggcaagacagatgcatgaggctgtggcgcccttgacattgagccggagggccagagttcgtcattgctgacgcagagaagctgggagccaaggttagccagatggtttggaggagttttaaacaatcttttcttttctttctctttccatctgtctgtccttctttcctcccttcctgccccctttcttttctcctttctttccttcctctctccttcctccctttttttctttttttttggttttctttttgtattagtattattattttttagacagggtcttgctctgttgcccaggctggagggcagtggcacgatcacagctcagtacaccctcaaccttctgggttcaagcaatcctcctgccttggcctcccaggtagctgggactacaggcgtgtgccaccacacctggttaattttttttttttttgagacggagtcttgctctgtcacccaggctgcagtgcagtggcgtgatctcggctcactgcaacctccacctcccgggttcaagcgatcctcctgcctcagcctcccgagtagctgggattacacgcgcccgccaccaagcccggctaatttttttatttttagtagagacagagtttcaccacgttggccaggctcgtctcaaactcctgacttagtgatctacccaccttggcctctcaaagtgctgggattagaggcgtgagccaccatgcgcagccaatttttgtatttttagtagagatggggtttcaccatgttggtcagtctggtctcgaactcctgacctcaagtgatccacctgcctcagcctcccaaagtgctggaattacaggcatgagccaccgcgcccagccctcttaaccatttttaagtgcacagttcagcagcattaagcacattcacattgttgtgcaaccatcagcccccgtccatctccagctttctctttttttttgtttgttttgagacagggtcttactctctcgcccagtatagagtgcagtggtgcggtcttggctcgctgcaacctctgccttccaggttcaagctattctcctgcctcagtctccccagtagctgggattacagacacacatcaccacgccctgctaattattttgcatttttagtagagatggtgtttcaccatattggccaggctgatcttgaactcctggcctcaagtggtctgctccaaactgctgagattacagccgtgagccactgctcccagccatctgcacctttctcatcttcccaaatgtaactatgtccccgtgaaacactcactccccattccacctccccagcccctggcaccccccattttattctggtgctaggggaatttcaaaccaggcaagtctcaacacatgctcgagtgtaagaaccagcccacagcctcgttccctaatcacggtcaaaccagaattctactccaggttctactctgtgaatctgctttctgtgaatctgttactctggggaccgcctataagttgaatcctacagtgtctccacttcagtgactggcttatttcacttttctcctctttatttatgagacaaaatttcgctcttgttgctcaggctggaatgcaatggcgtgatctcggctaatttttttgtatttttagtagaggcggggtttcaccatgttggccaggctggtctcgaactcctgacctcagacgatccactttggccttccaaagtgctgggattacaggcgcggcccacctttctcctcttaatcacacaggtaatccatacatacgacattcttttttttttttgacacggagtcttactctgtcacctaggctggagtgcagtggcgcaatcttggctcactgcaacctctgcctcccaggatcaagcaattctcctgcctcagcctcctgagtagctgggattacaggtaaccatcaccacacctggctaaattttgtatttttagtagagacggggtttcaccacgttggccacgctggtattgaactcctggcttcaagtgatcttcctgtctcggtctcccgaagtgctgggattacaggaatgagccactgtgcccggccaatacgacatctgtgcaatgaagtgcaacatataagacacccttcccccacccactgcccccaccaccgcccccacgcccccacccccatctccagatcagaacctggggctgtgcaattttaaacgttgtagccacttgctacttgggtagttgaagttcagtctcagccaggttggagtcctggactctggcccctcttttatttttattttttatttttttttgagacagagtctcgctctgtcgcccagactggagcgcagtggtgcgatctcggctcactgcaagctctgcctcctgagttcacgccattcccccgcctcagcctcccgagcagctgggactacaggcgcccgccaccacacccggctaatttcttgtattttttagtagagatggggtttcaccctgttagccaggatggtctagatttcctgaccttatgatccgcctgcctcgggcctcccaaagtgctgggatgacaggagtgagccaccgcgcccggcctctttttttttttttagacagtctctgtcacccaggctagagtgcgatggtgcgatctcggctcactgcaacctccaccttccgggttcaagcgattctcctgcctcagcctcctgagtatctgggattacaggtgcctgtgaccacgcccggctgatttttgtatttttagtagagacggggtttcaccacattggtcaggctagcctcaaactcctgaccccgtgatccttccgcctcagcctcccaaagtgctgggattacaggactctggcccatcttggctgctgccaatgtccttccttctatcttggtttttccacagttacgcacatgccagataacggcgagtctgttccccagcaactgcaacggatctgcccaccactgggaaatggaagaccttgcagcccaggtctttgtagaccaagattagattgtggtcaacaaacacctgaccttggcctttggaaccatcagccatgtcagctaaaataaaagcagaatctggctgggcgcagtggctcacgcctgtaatcccagcactttggggggctgaggtgggcagaccacctgaggtccggcgttctagaccagcctgaccaatatgatgaaaccccgtctctactaaacatacaaaaattagctgggcatggtggcgggcacctgtaatcccagctactcgggaggctgaggaaggagaattgcttgaaccctggaggcagaggttgcagtgagccgagattgcgccactgcactccaacctggactgcagaacaagactctgtcccaaaagcagataaataaaaataaataaaaataaaaatatggccgggcatggtggctcacacctgtaatcccaacactgggaagatgaggcgggcagatcacgaggtcagggattcgagaccagcctggccaacatggtgaaaccccgtctctactaaaaatacaaaaattagccgggcatgatgctgcatgcctgtaatcccagctactctggaggctgaggcaggagaatcgcttcatcccgggaggtggagcttgcagtgagctgagatcgcgccactgcactctagcctgggcaaaagagtgagactccatcgcaagaaaaaaaaaaaaaaaagctgcaagctctgtctcccgggttcaagtgattctcctgcctcagccttccaagtagctaggattatacgcgcccgccaccatgcctggctaatttttgtatttttagtagagatgcggtttcaccatgttggccaggctggtctcaaactcctgacctcacgtgatccacctgcctcggcctcccagagtgctgggattacaggtgtgaacccctgcgcctggccaagaaaagttgcttgaatgaagagtaaatagaagacccagaaagaaatgattcgtccgaggaaggtcacagaagcaacgtaatcaagatggaaatctgactcttcctaattttggccagacttcccatccctccaaagctttccagactcttccagatcattctagatatttccagaaatcattcgtgaaatctaactaggagtagtctgtaaacaatgtgtttcacacagatacaattcataaacgatgagaagacaaggacacttcatgaatgaaatttttacggccgggtatgttggctcacgcctataatcccaggactttggaagacccaggcaggaggattgcttgagtccaggagttcaagaccagtctgggccacatagtgagaccctgtcgctacaaaaaatttaaaaattaggtagatatggtggtgtatgcctctagttttagcttttttggaggctgaagcaggaggatctcttgagcccaggaggttgagctgcaatgagctacgattgaactactacactccagtctgggtgacagagaaagaggctgcctcaaaaaaataaaaataaaaaaataaggccggacgcggtggctcacgcctgtaatcccagcactttgggaggctggggtgggcagaccacgaggtcaggagatcgaggccatcctggccaacatgatgaaaccctgtctctactgaaaacacaaaaattagctgggcgtggtggcgtatacctgtaatcccagctactcgggaggctgaggcaggagaatcacttgaaccagggagtcagaggttgcagcgagaggagattgtgccactgcattccagcctggcaacagagcaagactccgtctcaaaaaagaaacaacaacagcaacaacaacaaaaaaaacataaaaaagttcgggcacggtggctcacacctgtaatcccagcactttgggaggccaaggtgggtagatctcttgaggtcaggagttcaagaccagcctggccaacaaacatggtgaaaccccgtctctactaaaaatacaaaaagtagccgggtgtagtcccagctactcggaaggctgaggcaggagaatcgcttcaacctgggagatggaagttgcagtgaactgagattgcgccactgggtgacagagtaagactcttgtctcaaaaaaaaaaaaagaaagaaagtttaatttaatgattcaaataatgacctgctcgagagataaatataaagtctaacgtaagaggtgtatactttttcctctgtcctgctgtcctcgccccacctcaccccaagtcccaacctgattgatcagtctcctttccctctggtagccccactcccatgaccgaaccgagaagtcatgcacccgcataagaactctaattttttttttcaaagtcttctcactgccccaaaaatagtttctttcattcccaggggatgtgaaagtgtctctcccaattttatttcaacctcccagcgttccacacatatgccttgcctcagccagctttcactgatctgccatttccacctcggcgctgctcctacctgcggaaatcctgtccatccatagtctgatttctgttgttccagaacattcttttttttttcccctggaacattctttaagatacctcaataaatgaaaccagagggtatagagcagtatgaatgggtactacaatgtacagggggaaatggaggggaatatgatatactctcctccttgtatatgcttagaatgttctagaaggatatgcttaaaaggttagcagtcctggccaggcgtggtggctcacgcctgtaatctcagcactttgggatgccaacgcggacggatcacaaggtcaggagttctagatcagcctgaccaatatagtgaaacctcatctttactaaaaatacaaaaattagccgggtacggtggcatgtgcctgtagtcccagctactttggaacctgaggcaggagaatcgcttgaactcgggaggcagaggttgcagtgagccgagactgtgccattgcactgcagcctgggtgacagaacaggactccgtctcaaaaaaaaacaaaaaaggtcagcagtcttaattgtcagagggcaggggacctgcatgggatggaggtttttccatgtgtccaccttttgagcccttttgctttttttttttaaatctttttattgtagcaaaatagatataaaatttaccctttttttttttgagacagggtctcactctgttgcccaggttggagtgcagtggcatgatcttggctcactgcagcctctgcctcctgggttcaagcgattttcctgcctcagcctcccgagtagctgggattacaggtgcttgccaccatacccggctaattttgtatttttagtagagacggggttacgccaagttggccaagctggtcgcaaactcctgacctcaagtgatccgcccccctcggcctcccaaagtgctgggattacaggcaggagccaccacgctcagccctaaaatttaccatattaaccattttcaagttcagaggcattaaagtatactcacattgttgttcaactgtcaccactactcacctgcagaagtttttcatcttgcaaagtgaaaaccccatacccaatttcccgttcttcctctcagcccctggtaatcactattctactttttgtctactttttgtatgaatttgcctattctaggacctaatagaagtggagtcaaacctgtttgtccttttgtggctggcttatttcacccggccttatatcctcaaggtttatccatgttggaggatgcctgaatttccttgtttttaaggctaaattttattctattatattaatatgtcatattttgtttatcctgatggacacttgggttgattccacctttggccattttgaagaagcttctatgtacatggtatacacatatatctttgggtctctgctttcaatgcttttggggatatttcagatgtggaatttctggattataaggcaatttttttttttgagacagactctcgctcttgtcgcccaggctagaatgtggtggtgtgatctattttttttttttttttgagatggagtctcgctctgtcgcccaggctggagtgcagtgtcacgatctcagctcactgcaagctccgcctcccaggttcgtgccattcttatgcctcagcctcccaagtagctgggaccacagccgcccaccacctcacccggctaatttttgtatttttagtagagacagggtttcactatgttggccaggatggtctcgatctcctgacctcgtgatccgcctgcctcggcctcccaaagtgctgggattacaggcgtgagccactgcacccggctggtgtgatcttggctcgctgcaacctctgcctcccaggttcaagcgattcttgtgcctcagcctctccgcagctgggactacaggtgtgcgccactgtgcccagctactttttaaaaatatatgtgtatttattatacttttaagttctgggatacatgtacagaacgtgcaggtttgttacataggtatacatgtgccatggtggtttgctgcacccatcaaccggtcatctacattaggtatttctcctaatgctatcccttccctagccctccactctcccggttttttgttttgttttgttttgttgttttgtttttagtagagacagggtctcaccatgttgcccaggctagtcttgaactcctgacctcaagtgatccgcccacctcagcctcccaaagtgctgggattacaggtgtgacccactacactcggccttattttcacttatttatgcaattttcactattgctatattctaggaggcactgtggaattgcactgtggaattttagtattgctgtatttcagcaagccatgaggtctgtcagcacacggctttgggcattttgtgaagataactgatgccagctgagccaaggcaggttcctgattccacccactggcaggcaccgaggtctctgctgttactgatggtttctctgtggattgatgggcttaaggccagaccacagctgcaatggctcacctctgccaaaggccaggctcgttggggcagagacctattccggactgagcctcctggtgaattagagaggtagaaaatgggaggacgggggcaggtgggctattacagcgaggaaaatgcccaccctgagttgtattagataactttgggagttcaggaactttccaataaagtgggttccacagcaggattacttactgactccctaatagaaagaaggcaggcacaggccgggcgtgttggctcatgtctgtaatcccagcacgttgggaggctgaggcgggtggatcacaaggtcaggagatccagaccatcctggctaacaaagtgaaaccccgtctctactaaaaatacaaaaaattaggctgggcgtggtggctcgtgcctgtaatcccagcactttgggaggctgaggcgggcggatcacgaggtcaggagatcgagaccgtcctggctaacacggtaaaaccccatctctactaaacatacaaaaaaaaattagccaggtgtggtggcgggcgcctgtagtcccagctactcaggaggctgaggcaggagagtggtgtgaactcgggaggcgcagcttgcagtgagccgagactgcgccactgcactccagcctgggcaacagacagagactccgtctcaaaaaaaaaaaaaaaaaatacaaaaaattagccaggcgtggtggcacgtgcacgtgactgtagtcccagctacttgggaggctgaggcaggagaattgtttgaacccgggagacggaggttgcagtgagccgagatcgcgccactgcactccagcctgggtgacagagctagactccgtcaaaaaacaaaaaacaaaaaacaaaaaaacaaaaaaaaaaaaacagcaggaactggcaggtcttccctgaagagataaaaaaaaaaaaatgcagttgcaacacaaaagcagccacagagaaaagcaaacccatatatggtatttattatgcaccgagtgtggctctaatcacttttttttttttaattgagagacagcctggctctgttgattgggctggagtgcagtggcgcgaccgtagctcattgcagcctcaacctccttggctcaagcaatcctcctacctcagcctcctgagtagctgggaccacaggtgtgagccaccacgcctggctaattgttttttttttttttgtagagacagggtctcactatgtggcccaggctggtttccaactcctgggctcaagtgatcctcccacctctgcctcccaaagtgctggggattacaggcatgagccacctcgcctggcctctagtcgctttatatattttaacttaatccttacaagagccctgtgagctagttacaggagcacaaatggaaaccaagaaacagaaaaatttatcagcatgactcagtcctcagagccatgtatggccgtgtccgtgcatggcaggcaggtcaggggcctggggaacgctgttctggaaaccttggccaggccttggcacccgaggaatgtgcttttcagagtttttgtggctcttttccagacctgccctgacctctagctctgggaactatgtaagccaagtgccttccgggaagggagtccctctcctggtaactctttctgggtaaccagatgtggactcatgacacacactgagcctacgtcttataattttttgtttttgtttttgagacagtttcggtcttcttgcccaggctggagtgcaatggtgcgatctcggctcactgcaacctctgcctcccaggttcaagcgattctcctgcctcagcctccctagtagctggaattgcaggcatgcgccaccacgcctggctaattttttgtatttttttttttttagtagaaacggggtttcaccttgttagccaggctggtcaccaactcc

SEQ ID NO: 416 - DNA, 20001 bp, Homo sapiens
ggctgggtacgcgagggtgacactgtccagctgctctgccggggggacggcagccccagcccggagtatacgcttttccgccttcaggtgacccacccaagggtccctctgggatccaccccccagcccctgacctctgtgacctgctaacctgcataacttctaatgtgggacctgggagtccccatggcttaggcagccacctgatctggtggcccacgaactaaaaggacctctgacccctgatttgagagagtcaggacttagcatgccacctgacttgatggcccctgacccctgattctggcttagcatgacactaacctggtggcttctgacctagcatgagcccgctgaaccggggtggcttctgagcctggttcctcgtcccccgtctcccaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctgtgagagccctgggtgaacgggcgggcaggaggggccctggcatcagtgcctctgcgccctcctccctacagccctgaagttgctctgtcatcccaaacactctgccttcaaccctttctctgcatttcttgggggtttttttggttgtttttttttttttttttttcccagagacaggacctggctacgttgcccaggctggtctcgaactcctcatgcgatcctcctgccttgctctcccaaagtgctgggattacaggagtgagccaccgcatcttgtcgagagctctttccatagcacagacctgaccctcctctgctcagaatctgccatggctccccagtacccttgggagaagcccaggtgtctcaccatggccttcaaggtccacctggccagttccaccattagctagctgatccttctccccagtcaaggctatctcctcatcaccccccaggctcctctggttcctaccttcactgcccatccttcctaccgtctatttctcaccaatcccttgaatcccaggcttctaagaatgattttcagttcattcgcatccaggccctggggaaaggctgtattctcccttggcacttcttacatatcccttcctggggtagaccctgcgccagatgctggggacacatctgtgaacaagacagaccacccctgttatttcagtaggggagacagatggtaaatgctaactaagccctttcgtaacagtagtgtatctacaggtgatatcaccagtgagagagagcaggagaggggattattttaggtggcaggtgttgcagtctgctttcctgagaagcagattctgacttggatgttttcaggcaagaagtttatgggaagtaccctgggttccgcacctcttgggtctagggaggtaaaggaagcaagatttggcaaggtgagaagttggactgaagtctaaggaaggtctcaggctgggtgcagtggttcatgcctataatcccagcactttgagaggctgaggcaggaggattgtatgagcctaggagtttgaggccagcctgggcaacagagggagaccccatttgcacacacacacacacaaattaaaaattagccaggcatagtggcacacacctgtagtcccagctactcggaggcccaggtgggaggatcccttgagtctggaaggttgaaactgcagtgagccaagattgtgccactgcactccagcctgagcgacagagaaagaccccgtctcaggaaaaataaaaataaaaaagtaggccgggccccgtggctcatgcctgtaatcccaacactttgggaggccgaggtgggtggatcacctgaggtcaggagttagagaccagcctggccaacatagtgaaaccccctctgtactaaaagttagccgggtgtggtggcatgcacctgtaatcccagccactcaggagcctgaggcaggagaatcgcttgaacccaggaagcggagattgcagtgaactgagatcgtgccattgcactccagcctgggcaacagagtgagactccatctcagaaacaaataaaagaaagaaagagggcctcagtcagccccacggggtacttggaatccaggatggcccttcacagttgtccccagttggggtgagggggctgggccttaataacctctacatcaaccagtcctcagaggtgtgctggccttaggcaaggggctctcagcagctgaggcagctcccagagaggggtgacagctgcaggctgacagctgtcatccttcttagcagctggtggaataagtccttccgtgctgtaggaaagatctgggtgtccacaataggggaggtcagggaagcctctgagaagagacatttaagtgagactcagaaaagcagacagcagccaggcacagtggctcacacctgtaatcccagcactttgggaggccgaggcaggtggatcacctgaggtcaggagttcgagaccagcctggccaacatggtgaaaccccatctctactaaaaatataaaaattagccaggcatgatggctggtgcctgtaatcccagctacccaggagactgaggcaggagaatcgcttgatcctgggaggcggaggttgcagtgagctgagatcgtgccactgaactccagcctgggtgacagagcaagagtctgtctcaaagaaaaaagaaattggccgggcacggtggctcacacctgtaatcccagcacttttgggaggcagaggcgggcagatcatgaggtcaggagtttgagaccatcctggctaacacggtgaaatcccgtctctactaaaaatacaaaaaattagctgggcgtggtggcaggtgcctgtagtcccaggtactcgggaggctgaggcaggagaatggcatgaacccaggaggcagagcttgcagtgagctgagatcccgccactgcactctagcctgggcgacagagccaaactctctcaaaaaaaaataataagaagaagaaatgcagagagctacaaaaagagcactgcaagtagagtgagcaagtgcaaaggccctgaggcaggccccaacttggtctactcaagaaaaacagcaagagaacggggtagctgggagcacaggaggaatggggaagagtgggagatggttcaagaggtgggtgagggccagaccaggcagcatcttttaggcaccctcaagaagtttggcctcgatgccaagggtactggggagccactgcagggttttatgcagaggggagggatgaccagtgggtggttggttttttttgtttttttttttttgagtcagagtctcactctgtcacccaggctggagcgcagtggcacaatctcggctcactgcaacctccacctcccaggttcaagcgattctcctgcctcagcctcccaagtagctgggactataggcatgcaccactatgcccagctagcttttggatttttagtagagatggggtttcaccatgtgaccagggtggtctcgaactcctgacatcaggtgatgcacccgcctcggcctcccaaagtgctggggttataggcatgagccaccgtgcccggcctgaccagtggatgttttaaagaggtccctctagctgctcagtggaggatggacaagagggaggagcaggctagtgaagaggtggttgggacagtcaaacctggggccagaggtggcaggaagccagaggatttgtcctgggagcagaccagataaagacttgctgaggccaggagcaggggctcacgcctgtgatcctagcacttttgggaggtcaagacaggaggatcacttgaggccaggagtttgagacccagcctggccaacatagcaacaccttgtctctattcaaaaacaaaactttgcagaaaagatgtttgggggtaacagggaggttaccccacaggttggggtttgagcaaaaggtttgtgtgctaaagtcacagaagggacaccttccacacctaaggttattcattaaccttgggctcagatgtcagctctgaagaaaagtaattgacttgggcatgtcaatgttggggttagactgctagatttttggttggagagcctggatgggagaatggagatttcatggagatggggtaaaccaggaggattacttgctgttctctgcttccaactgtccattcatgtttgcacccccgaccgcccctggagagcccctaattgagtgggtggcggtctgggacgagtgacagactgtcccccactgcagatctggaccccctggagctcagcgaggggaaggtgctttccttacctctaaacagcagtgcagtcgtgaactgctccgtgcacggcctgcccacccctgccctacgctggaccaaggtgagagggagaggagccccctcgggccctgcactcgcaccctcctctctcccctcactcctcgccctctcacagcgtcctcctcctcctctgcccttcccaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggttcagggggcagggagggggtgggcttggatggggacagtgtggggtgtgggacctggacaaacaggacgagttcctgagtccctggctggggactccatcttctgctcgatgcctctcttctctctctctctcctctcccttcactttcttcccatccccaccacccacaggctcgccagagctaaagacagcggaaatagagcccaaggcagatggcagctggagggaaggagacgaagtcacactcatctgctctgcccgcggccatccagaccccaaactcagctggagccaattggggggcagcgtaagggaccttcctctccaccctgagccccctctcactcatccaagtatcacaccctcctttccacttcctgggagactggacgtcgttcacctctgcccttgaccccaccccttgaccccaccagccggggcctgatcggagcctccatagcccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccggtgagtgactgaggtggtggcagaggagccgggtgtggggcagacagagcccactgcctgacccacgcctctctccatcctgtccctgcagtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgccgtgtgcacctccaacacgacgcctccgcccgctgcctcctccccccaggccgccaggggagccagggctgagccactcggggtcggagcaaccagagcagaccggccttctcatgggaggtgcctccggaggagccaggggtggcagcgggggcttcggagacgaggtgggtgagggcctgggccccctggtgagagggacctgctgggcagtggagcacgcccgtgggcacaggctgacctctccatccgctccccagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacaccatcctgtggccagagcttcctctgggagtagggaggggaagggcgatgcaggtgattccctgctctcagctgcccccccatccgcccccttgcaagacctcagaagacgcctgatgtcatggagaaagaaatgagacagggctgggcgccgtggttcattcttgtaatcccagtggtggtggctcacgcccgtaatcccagcactttaagaggctgacactggagggtggcttcaggccaggagttcaagaccagcctgggcaacatatggagaccccatcgctacaaataataatactaataatacagaaattagccaggtgtgcctatagtcccagctattcaggaggctaaggtgggaggattccttgagcccaggaatacgaggttacagtgagctatgatcacgccattgcactccagcctgggtgacaaagcgagacttcatctctaaaaaaaaagaagaaaacaaaaagaggccaagctcagtggctcaaacctgtaatcccagcactttgggagaccaaggcagggggatcactttaggtcaggagtttgagaccagcctggccaacatggtgaaaccccatctctactaaaaatacaaaaaattagccaggcatggtggcgcgagcctgtaatcccagctacgtgggaaactgaggaggagaaaatcttgaacccaggaggcagaggttgcagtgagccgatatcgcaccactgcactccagcctgggcgacagagcgagacactccgtgaaaagaaaagaaaaagaaatgacagcatgagagcgagtgagcacgcagagggcgacttagctggccgggggtggacggaaagatgccaggtcccgagggtgctgggcttggcccccgaggaccagcgtctgcctggagatgggtgctgtccccttaagtaaaagttcccagtctgtcttgccagagccccagagggaattgaaactgggcgaggaaaagctccctcttagctgtagagtcaatagaattagggatggagccacctcctctggggaggagtccctggggaaagcggggagcttggaggaatccagagaaaagggggcctggggcagagaggacacacagacattacaaggccaagaaagagggacgtgagaaagggatggaaagatttagggggaggcaagagggatgggttgggaagctccgagagagccctggagtaagagacaaaaatagatctggggagacagacaaaaagagtagtgggccaggtccagtggctcatgcctataatcccagcactttgggaggctgaggcaggaggatctcttgaggccaggggtttgagaccagcctgatcaacataccaagaccccatctctacaaaaaataaaaaattagccgggcatggtggcacacgactgcagtcctcagcacaggcaagaggatcacttgaggccagcagttcaagaccagcctgggcaacatagtgagaccccatctctacaaaaaaataaaaaattagctgggcatggtggcaaacacctgtggtcctgcactttgtgtgaccaaggcaggtggttcacttgaggccagtagttcaagaccagcctgggcaacacagcaagaccacatctctacataattttttaaagagaaatacagagaaagaagaactggagttagagagatcattgcagttggaaagggagagaggaaatgcaagcagctgcctagaaggacggaggagggtagcgggaggtcagcacgggtgactggctggcgacctcacctctctgagcctttcttgtgcatcgaatggggatcaattgcactttggccacggcgggctgctgtgaggtgtcagtgtgatcttagagccatgtggggtgatgggggcattgcactcacacaccacccagggcctcctagcattgccttctcaaatctcaggcacgcagctccactctctgctctcagtcacctcagccacaaagtggacagagtgggatctgtcaccataggaaattattcggatgccacagaagcctccttcctggtaggtaaaccaagcagcctgcccaggcagaagagctcatgggccacgttaaggcgctcagatcccatggtttattgaattcatttaaaacaaacacaaggttattgtttgtttttcaactgtgtggtggtaggaagtgctcctgacggttttcccatggcaataatttactccttgatttcacccaccactactgtgacagctttctctcactgattcacccaaaagtgggcttttctttgtcattcattcttttttttttttttttttttgatggagtgcagtggcaaaatcatagctcactacctcaaactcctaggctcaagtgatcctcctgcctcagcttgctctgcagctagacccacaggcacatgccatcacacccagctaaatttttatttttattttttgtagagacaaggtctcaaactcctggcctcaagcaatcctcctgcacaaagttttaggattacaggtatgagccaccatacccagcctaaaaaaaaaatttttatttttttatttttttgagacagggtctcactctgtcacccaggctggagttcagtggcaagatctcggctcaccgcaacctccacttcccaggctcaagcgattctccagcctcagcctcctgagtagctgggtctacaggcataagccaccaactcctggctaatttatgaattttttgttgagacggggtttcaccatgttgcccaggctcgtcttgaacttgagctcaaaatgatctgcttgccttggcgtcctaaagtgctgggattacaggcctgagccactgagcccggcctctaaaaaactttgtattaacaactttcttcttccaaaaaacctgcagttcccactcttgtcaatgtgtgtgaggtgcccattactccatactttggccagcacttgcaattatcctctaaatttttgcctacttgatgggtaacaaaatggctctcatatttgtgtctctttttttttttttgagacggagtttcgctcctgttgcccaggctggagtgcaatggcacaatctcggctcactgcaatctctgcctccttggttcaagcaattctcctgcctcagcctcctgagtagctgggattacaggcacccgccactacgcccagctaattttttgtatttttagttgagacggggtttcaccatgttggccaggctggtcttgaactcctgacttcgtgattcacccacctcggcctctcaaagtgctgggattacaggtgtgagccactgtgcccggcctaatttttaggcggggtttcaccatattggtcagtctggtcttaaaactcccgacctcaggtgatccactcgcctcagcctccaaaagtgctgggattacaggtgtgagacaccgtgcctggccgataatttggtcttgaggtccctttcatgagcatggccatagactctggctttgccctgcctgggctccaggggattagatcataagtgtttacaatgtgcttttcagcagattttcctttatcctggcaggcagcccaatgcctaagtgtctgacttgtacacaggtgtccctctcacaggaaatgtatttatactggccaagaccctttgtggctcttatctgacctgtgtccagtttattccaaaccaggaaagtcattaggttcaggtgtgtcagtcaagtgacacacacaaaggaggcaactcaacaaaacacatgaaatatcagaaagaggcagggtgcagtggatcacgcatataatcctagctcttcaggaggccaaggcaggaggatcacttgatgccaggagtttgaggccaacctggccaacatggcgaaaccctgtctctactaaaaataaaaaaattagccgggcgtggtggtgtgcgcctgtagtcccagctactcaggaggctgaggcaggagaaccacttgaacccaggaggtggaggttgcagtgagccaagatcatgccactgcactccagcctgggcgacagagggagattctgtctcaaaaaaataaaggaagaagaaataacagaagcagaggctggacatgatggctcacacctgtaatcctagcactctgggaggccaaggcaggaggatcagttgaactcaggagttcgagaccagcctgtgcaacatagcgagaccctgtctctatttaaaaataaaaaaagaagaaagaaagatataacagaagcagtttattacttatggatcccagagagaaaagagcagcacacttccctgggccagtgggaagggggcagctgcctgagacatgcaggctcaaccagcaggtggagagagacccccccaaagcctttactgcggtccagggcatggcggagacggagttccccaggagagttctaactgatgggtttagaacaagcaggcacaagaattccatagagacacactgtgatggaggttgtcatatctgcacagtccattcattggaggtgtggggatcagtagcttgggtcaagtagtttgtatctatctagctgtcccatacagagatggtcccatacaggaggaggtgagataaagctgataccttgatcaactccagtaagaaactggaaggagagccgggcatgatggcttacacctgtaaacccagtgctttgagaggctaaggcaggaggattgcttgaggccaggattttgagaccagcctggacaacataatgagaccctgtctctaaaaaagaaatagagagaaggaagagaggcagggagggagggaggaaggactgggaggaagtatagagctggaaactgtgtcaaggataactaagtccagattttggcatgagaaagttaaacatattcagaatggatgctaagacaatatagaattatacaaattcaccacaatggcatattaatttgttttcatttgaatttccgtgacctctagtgtgaaaatggtgtttctctgtatgttcattggccatttgcttttcttgtttatgaactgtggtatactcttgcctacttttctctttttttttttaccttttcttattaatttgcaggatctctctacacaccaggaatattaacctctaatcttataaagcttttatctcaggctgggtgccgtgactcacgcctgtaatcctaccactttgggaggacgaggtgggtgaatcacttgagtccaggagttcaagaccagcctggccaacatagcgaaaccctgtctctactaaaaatacaaaaaaatagccaggcagggggtagccaggcatgcctgtaatcccagcactttgagagaccaaagcagacggatcgcttgagcccaggagttcaagaccagcctgaccaacatagtgaaaccctgtctctactaaaaatacaaaaaattagccgggcatggtggcgcatgcctgtgatcccagctactcaggaggctgaggcagcagggttgattgagcctgggagttcgaggctgcagtgagtcttgattgcaccactgcactccagtctgtgtgacagagtgagaccctgtctttacatagatatagacagatgatgatagatagatgatagatagatagatagatagatagatagatagatagatagatgatagatagatagatagacagatagatgatagatagacagacagatatccacatagatacctcaaacctattatgtcccaaatcgacctccagtctttcctctcgcataaatggtatccctgccctccagctgggtgagcccaaaacttagaatttatcctggattcctccatttcctttacctcccactcacataacccaaaggcacatcccatgggtcccctcccatacagctctctttcctgaccacttatcccccggcttcccatattcaataaaccttttaactctataccctgccacagggcatagagctgcagctagctctttctacaaatggtttcacggccatcagtccaaacatacatcttctttcacctggatcaatgcacttataaaagcaaatgctcaacagcaatctttgatggctctaatactcacatcaattaaaaatttaaacgttacctttcagtcacccttcccatccttttaaagtggaattcctaaatctaaaatggtaaaagttaaaaaaaaaataaaacaccaagctcatatggctctataaaatacagaataactttaaaatgtatcttataggcggggctgggcatggtagctcacgcctgtaatcccagcactttgggaggctgaggcgggcggatcacaagatcaggagattgagaccatcctggctaacacggtgaaactccgtctctactaaaaatacaaaaaattagccgggcgtggtggcgggcgcctgtagtcccagatactcgggaggctgaggcaggagaatggcgtgaacccaggaggcggagcttgcagtgagctgagatcatgccactgcactccagcctgggcgacagagcgagactccatctcacaaaaaaaaaaagaaattatcttataggcaatactttcacttgtcaattctctttatttatttatttattttttgagacggagtctcgctctgtcgccaggctggagtgcagtggcgagatctcggctcactgcaacctccacctcccgggttcaagcgattctcctgcctcagcctcctgagttactgggactacaggcacatgccatcacgcccagctaatttttttatttttagtagagacggggttccaccatgttggccggaattgtctcaaactcccgagctcaggtgattggcccacctcggccacccaaagtgccgggattacaggtgtgagccactgcgcccggccaattttttttttttttttttttttttttttttttttttttgagatggagtcttgctctgtcgcccaggccggagtgcagtggcgcaatcttggctcactgcaacctccacctcccgggttcaagcgattctcctgcctcagcctccagagtagctagattactggcgcatgccaccatgcccagttaattttagtagagacagagtttcaccgtgttagccaggatgatcttgatgtcctgacctcatgatctgcccacctcagcctcccaaagtgctgggattacaggcgtgagccaccatgccgggccaatttttttttttaagatgtagtcttgttctgttgcccaggctgacccattgctctcatgtatgtttgtttgtttgtttgtttttgagacaggacctggctctgtcgccgaggctagagtacaatggtgcaatcatgacttactgcagcctcgaccttgggctcaagtgatcctcccacctcagattccccagtagctgggactacaggtgcattgccctcaggcccagctaatttttgtattttttgtagagatgggatttcactaagttggcaaggctggtctcaaactcctgacctcaggtgatctgcccgcctcagcctcccaaagtgctgggattatggacatgagccaccatgccctgcctataactgcttttaaacataattttatacttttccaggagcgtcctaatgcatacgtgtactgcgtattctcgaaatttatgcttttttaaaacataaaccaggcctggcacggtggctcatgcctgtaatcccagcactttgggaggccgaggcaggtggatgatctgaggtcaggagtttgagaccagcctggctaacatggtgaaaccccgtttctactaaaaatacaaaaaattacccaggtgtggtggtgcgcacctataatcccagctacttgggaggctgaggcaggagaatcgcttgaacccagggggcagaagttgcggtgagcagagatcgcaccattgtactctggcttgggcaacaagagtgaaactccgtctcaaaaataaataaataaataaataaataaataaatagcagattagaaacccgtctgtgactcaggttttctcatttctcttagaataaaattcaaactcctacaaaaggctgcgtgcatagtgcctctctctctgccatccctagcttcactttccttgcctgcatcctatcagacagtctgtctctccagcccttgaatattttgtttctttcctacctctttttttctttttttgagacagggtctcgctctgtcacccaggctggagtgcagtggtgtgatcatagctcactgcagcctcaaaccctggggctcaagcaggtcctcccacctcggcctcctcagtagctgcaactacaggcatgcaccaccacagctggctaattaaaaaaaaaaaaaaaaacttttacagatggggtttctctgtgttgactagtctggtcttgaactcctggcttcaagagatcctcctgcctcagcctcccaaagctctgggattacaggcatgacccatcacacctgaccaggactctcaaacttacccttcatttgtcctgaaatctttcactacagatcctcacgtaattcattcattctcatactgcagattttggctcaaaatagcacctagccagaaatgtctttcagactctcttattttaaggagctcttgccccaaacccacccaagttacttccatcatcctaagtattaatacttttgcttgattttgttcttttctagtttctgggttctatgcatagaccatttttactaatattcatattttcttttaaataccttagaaagatattttagatttcttcatttgagccatgcacattctttgaaaatttatcctaaaatagctgggcacccagcccatcccttgaacccaggaggtggaagtggtagtgagctgcgattgtgtcgctgaactccagcctgggacaccgagtgagactccatctcaaaaacaaacaaacaaacaaaaaaatgttgggcacagtagttcatgcctagtcccagctactcaggaggctgaggcacgaggatcacttgaggccaggagtttgagatcagcctgggcaacacagcaagacctcactctaaaaaaaaatgttaatgctaacatataactttggttctgtttgtgattggcatatggtttatattatactttttttttttatttgagatggagtctcaccctgtcgcccaggctggagtgcagtggtgtgatcttggctcactgcaacctccatctaccatgttcaagcgattctcctgcctcagcctccagagtagctgggattacaggcatacaccaccacacccagctaatttttgtattttttttagtagagacagggtttcaccatgttgatcaggctggtctcaaactcctgacctcgtgatccgcccgccttggcctcccaaagtcctaggattacaggagtgagccaccgcgcccagcaaaaagttttttaactagctgagtatagtggcacgagcctgtagtgccagctactcaggaggctgtggcgggaagagggaggctgcagtgagatatgatcgcaccactgtactccaacctaggtgacagcaagaacttgtctcaaaaaaaacaaataacttcggccgggcaaggtggctcacacctgtaatcccagcactttgggaggcagagtcgggtggatcccctgagaccagcagttcaagaccagcctgaccaacactgtgaaaccccgtctctactaaaaatacaaacaattagccaggcgtggtggccggtgcctgtaacctcagttactcgggagactgtgacagaaagatgaaggctgcagagagctgtgatcgcacccctgtactccaacctagatgacagcaagaacctgtctcaaaaaaatagacaaatacataaaataaaatcggagtgaagctaccaatgtaatgttgagtgagtgatatgtttcagaaaatactttctagatccttgatgtttaatacggtatccctagtcatatgtggctatagaaacgtaaactacttaaaactaaataaaatgtagaatctcattcttcagtgacaatagccacagttctactgctcaacagacaattgtggcttgtggttactatattggacagcacagatataaaacatttccatcaatatagaaatttcttttttattctttttttttttttttttttttttgagacggagtcttgctctgtcacccaggctggagtgcagtggggcgatctcggctcactgcaagcttcacctcccaggttcacgccattcttctgcctcagcctcccgagtagctaggactacaggcgcccgcaccacgcccagctaattttttgtatttttagtagagacggggtttcaccatgttagccaggatggtctcgatctcctgacctcgtgatccgcccgcctcagcctcccaaagtgctgggattagaggtgtgagccaccgcgcccggcccccagtacagaaatttctacagggtaatgcagatctagaatatgatcccattttaaaataaagtccatggccaggcatgttggctgatgcctgtaatcccagcactttgggaggccaatgcaggtggatcacctgaggttaggagttcgagacaagcctggccaacatggtgaaaccccgtctctactaaatctacaaaagttagcttggcatggtgtcgggcacctgtagtcccagctactcaggaggctgaggtgggagaatcacttgaacccaggaggcagaggttgcagtgagctgagatcgcaccattgcactccagcctgggcaacaagagcaaaactctgtctcaataaataaataaataaaataaaataaagtacgtatgtcacatgtgcgtttacatgtgtatatataaatatatttaacaggtttttaatctgttatgtgaattttttaaattttttcatacagtgtcactttattaagtgggtagaaaatgttaaatttttctttgaaacaaggtttcttttttggggggatggggggatggagtctcgctctgtcgcccaggctggagtgcagcggtacgatctcagctcactgcaacctctgcctcttgggttcaagtgattctcctgcctcagcctcccaagtagctaggactacaggcgcccgccaccacgcccagctaacttttgtatttttagtagagacggggtttcaccatgttcaccaggctggtcttgaactcctgacctcaggttatcctcctgcctcaatctgccaaagtgctgagattataggcgtgagccaccacacctgagacacggtttcttaaaacaaaagaaaaaaagagacagggtttcactctgtcacccaggctggagtaaagtagcataatcacggttcactgtagcctcaacatcccagggctcaggtgatcctcccatctcagcctcctgagtagctgggattacaggagcatgccaccacacctggctaatttttgtactttttgtagagatagggtttcaccatgttgcccaggctggtcttgaactcctgggctcaggcaatgcgactgcctcggcctcctcccaaagtgctaggattacaggcatgagtcaccacacctggcataaattattaaatatttaaaattgccaagttccttggagaaactctatttgactacattgtttattttttttaatatgctgcttcataacatctatttatttaaaaatttcttaacatatgatgcagcaactccccttctgggtatatatcagaaagaattgggtcgggcgtggtggctcacgcctgtaatccaagcactttgggaggctaaggcaggaggatcacctgaggtcaggagttcgagaccagccttgccaacatggtgaaaccccatctctactaaaaatacaaaaattagccaggtgtagtggcacacgcctgtaatcccagctactagagaggctgaggcagtagaatcacttgaacccaggaggcggcggttgcagtgagccaagatcacgccattgcactccagcctgggggatagagccagactctgtctcaaaaagaagaaagaaaaggaaggagggagggagggggggaaggaaaggaggaagggagagagggagggaggaggaaggaaaggaggaaggcaggaagggaggaagggagggaggaaggaggaagaaaaggaggaagggaaggaagggaattagaggcgtgagccacagcgcccagcttacattatactttctaacctactaatggcatcaaataaataggaaccggtatttgagaagcacatattataattggaggctgcagtggctcatgcctgtaatcccggcactttgggagacagaggtgggcagatcgcctgagcccaggagttcaagaccagccagggcaatgtggcaaaaccccatctctacaaaaaatccaaaagaattagccaggtgtggtggtatgagcctgtagtcccagctactccggagggtgagatgggaggatcacctagtcacaggaaggtggagactgcagtgagccgtgatctggccagtgcactccagcctgagccacagagggaaggacggaagggaaggaaaagggaacagtgacaaacagagaccagaaacacagagggatgctgaagcataaggaacgaaagacccagagatacagaaatttaggaacacgaagagacccaaagatagtgacagaaacagagagacagaggaaagtctagaaagaaacaatgcagtgacacccagcaccttcatgtatttatttatttacttattt

SEQ ID NO: 417 - DNA, 20001 bp, Homo sapiens
gtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttgggggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttctcctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtggcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcgtgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctgacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaaagcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaacttttttgtagagatgaggtctccctatattgcccaggctggtctcgaactcccaggctcaagtgatcctccctcttcagcttcccaaagtgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaggtagggagggaggagggtgccactgatcccctgaacccctgcctctgcctccagagtgcccctccggcctcgccatgaggctcttcctgtcgctcccggtcctggtggtggttctgtcgatcgtcttggaaggtaaaagtgggatgggagaattgcggagttggagatttggaagagtgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggctgtcctgcttcgacagccttgaaagtgggtaagctgggtggggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcactgcaagctccgcctccctggttcacgccattctcctgcctcagcaggactacaggcgcccgccaccgcgcccggctaattttttgtattttcagtagagacagggtttcaccgtggtctcgatctcctgactttgtgatccgcctgcctcgacctcccaaagtgctgggattacaggcgtgagccaccgcgtccggccattcctccccattctaaccacatgatccccaaggatctctatccatcccggtatcccaacctaagggggttccaataacaaatttttggccgggcagggtggctcatgcctgtaatcccagcactttgggaggccgaggcgggcagatcacttgaggtcaggagttcgaaaccagcctggccaacatggtgaaacttcgtctctactaaaaatacaaaaaaattagccaggtgtggaggcacgcgcctgtaggcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcaggggaattgcttgaaccaggaaggtgggagttacagtgagccaacattgtgccagcctgggtgacagaaggagactctgtctcaaaaaaaaaaaaaaaaaaaaaaaaaacaagatggtcttgcccaggtatggtggctcacacctgtaattccagcactatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagaggggcattactgtgagcctcagtttcctctcctataaactggtggttctacagggaagtaaaggagcaggcctacagggtgtctggtacatgtagatgctcagtatatcatgaaacccacccttgccccctttggcaagttagagagtcattcgttctttcaaaaatatttactgagcatctgctaagtgctggaaactgtttcaatgtggggaataaaacagtgaagaacgtgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggaggctgaggcgagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcacctgaggtcaggagttcgagaccagcctaacatggagaaaccctgtctctactaaaaatacaaaattagccgggcgtggtggtgcattcctgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctggcgcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttcttttttttttttttttttttttctttttaaatttttttttttgagacggagtctcgctctgtcacccaggctggattgcagtggcctgatctcggctcactgcaagttccgcctcccgggttcatgccattctcctgcctcaccctcccgagtagctgggactacaggcacctgccaccacgccagctaattttttgtattcttagtagaatgtagaatttacttagtagaattttttgtattcttagccagcatggtctcgatctcctgacctggtgatccacccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcgaactcctgacctcaagtgatcagcctacctcggcctcccaaagtgttgggattacaggcgtgagccaaatgcccagccaagggtaaagtgtttagacttcaacgtgctttggtccatctgggaaactgaggcacagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaattctctcctgagtgcttctttactctggggaaggggctgcgggagagggtaggggcttccagagagggcagggtctgcaggagagggcaggggctaaaccttaggtactcctcacaagccctccaatgccctatctacttgccctgtgctgaggatgttttaactccatggtctcaaaagagtcttcctaagaaccctgcaaactgggccttattaatcccataagggcattgaggcccagagaggtgaagttacttgtataaggtcacacagccaggaagtagagaactggaactagattgaaccctcagcctagcaatgtcactatgctacacttttcctagtgtggtctacccgagatgaggggctgaggtttttttttgtttttgtttctgttttgaggcagactcactctctcccccaggatggagtacagtggtgcgatctcagctcactgcaacctccacctcccaggttcaagagattatcctgcctcagcctcccaagtagctgggatttacaggtgtgcgccaccacacccagctaatttttgtatttttagtagagacagggtttcatcatgttggccaggctggtctccaactcctgggcttaagcaatcctcctgccttggcctcccaaagtattagaattacaggcgtgagccactgtgcctggctcttatgtaaaattaaaccacatacacatgagaaacaaccctatgtaattaagatttctttctttttttttttttttttaagagatggagtcacccaggctggagtgcagttgcacaatctccattcactgcagccttgcaacctccaccacctgagttcaagggattctcctgcctcagcctcctgagtagctgggattataggcatgtgccaccacgcccagctaatttttttgtatttttagtagagacggaatttccccatgttggccaggctggtctcaaactcctggccttaaatgatccacccgtcctggcctcccaaagtgctgggattacaggtgtgagccaccgcacccagcttaagatttcataagaaaaatatttgtaagccacatatctaataaccggttaatattcaggctgggtgaagtggctcatgcctgtaatcccagcactttgggaagacaaggcgggcggattacctgaagtcaaaagtttgagacctgcctggccaacatggtgaaaccctgtctctactaaaaatacaaaaaaattagccgggtggggtggcacatgcctgtaatcccagctgcttgggaggctgaggcaagagaatcccttgaacccaggagtcgaaggttgcagtgagccaagatggcgccactgccctccagcctgggagacagagtgggactccatctcaaaaaaaaaaaaaattcaaaatgtataatatacaatcctagttgggacatcaaacactgcagccactgtggaaaacagtatggggtttcctcaaaacattaaagatagaactctcaaatgatccttcaatcccacttctgggtatttattcaaaagaattgaaatcaggaccttgaagagatacctgccctcccatgttcactgcaggtctgctcaatacccaagatatggaaacaacctaaatgtttatcaacagatgaatgggtcaaggaaatgtggtctctacatgtaatggaatgtaacgcatccttaaaaaggaaaccctaaggccgggctctgtggctcacacatgtttttttttttaaattttatttatttatttatttatttatttattttttattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgacgactcttaacgagcatgctgccttcaagcatctgtttaacaaagcacatcttgcaccacccttaatccatttaaccctgagtggacacagcacatgtttcagagagcacagggttgggggtaagatcacagatcaacaggatcccaaggcagaagaatttttcttagtatagaacaaaatgaaaagtctcccatgtctacttctttctacacagacacggcaaccatccgatttctcaatcttttccccaacttttcccccctttctattccacaaagccgcgattgtcatcctggccggttctcaatgagctgttgggcacacctcccagacagggtggtggccgggcagaggggctcctcacttcccagtaggggcggccgggcagaggcgcccctcacctcccggacggggtggctgccgggcggagaggctcctcacttctcagacagggcggttgccaggcagagggtctcctcacttctcagacggggtggccgggcagagacgctcctcacctcccagacggggtcgcggccgggcagaggcgctcctcacatcccagacggggcggcggggcagaggcgctccccacatctcagacgatgtgcggccgggaagaggcgctcctcacttcctagatgggatggcggccggacggagacgctcctcacttcccagactgggcagccaggcagaggggctcctcacatcccagacgatgtggctcacgcatgttatcccagcactttcggaggtcaaggcaggaggatcacttgaggccaggagttggagaccatcttggccaacatggtgaaaccccgtctctactaaaaatacaaaaaattagccaggcgtgcgcctgtaatcccagctactcagtaggctgaggcatgagaatcgcttgaacccaggaggtggaggctgcagtgagccgagatcatgccactgcactccagccggggcatcagagcaagactcaatctcaaaacataaaaggaaatcctgaaactgggcacagtggcttatgcgtgtaatcccagcactttggaaggctgaggtgggaggatcacttgaggtcaggagttcgagaccagcctgggtaacatggtgagacaccatctctaccaaaaaaagaagaaagagaataaataaatgtataaatattactccctggggttaatgcatccccttctcccccaaatcaaccctccaaactcctatactctcctgtcttctcactcagcagcctgttagaactcaagtcagattttttgttttttgttttttgagacggagtctcactctattgcccagcctgtgcagtggcaccatctcagctcactgcaacctctgcctcccaggttgaaccgattttcctgctcagtctcccaagtagctgggactacaggcgtgtgtgtgccaccacacccagctaatttttgtatttgtagtagagacggggtttcaccatgttgcccaggttggtctcgaactcctgagctctagcaattagccctccttggcctcccaaagtgctggggttacaggcatgagccaccatggccggcctcaagtcagattatgctcttcctctgctcagaactctcctgattctctcagagtaaacccagaagcacttaccaaggcctacaaacgggacactatgccgtccacgatcgcctcctccctgtctctctctccatcactcacaagcaactctttgctattcctccaatgtactgggcaggttcccatctcagggcccttgcagttactgttcctcttgcctggaatgttcttccccaggggtccagatatctgcctggctccctcctcacttcctccagttctcttccaaaatcatcccctgccagacgtggtggcacacgcctgtaatcctaactctttgagatgccaaggtgggaggattgcttcagctcaggagttcaagatcagcctgggcaatagcaagaccccatccgttctaaaaataaaaataaataaaaaataaaaaataaaaattagctgagcatggtagtggacaccttggggttccagccacgtggcaggctgaggtaggaggatggctttgaatcagggaggttgaggctgcagtgagccatgttctgaattagatactggtgatgatcgtgcaaccttcccaatataggaaaaaccactgaacagtacattttcaaagggtaaatttagccggacacggtggctcatgtctgtaatcccagcacttttggagtccgaggcgggcagatcacctgaggctgggagttcaagaccagcctgaccaacatggagaaaccccgtctctactaaaaatacaaaaaattagccaggtatggtggcgcatgcctgtaatcccagctactccagaggttgaggcaggagaattgcttgaacccgggaggcagaggttgtggtgagccgacatcacaccatcgtactccagcctgggcaacaagagcgaaactccgtctcaaaaaaaaaaaaaataattaagaaattagccaggcgtggtggtgggtgcctgtagtctcagctacttgggaggctgaggcatgagaatcgcttaaacccggcgggtggaggctacagtgagcctagattccaccaccgcactccagcctgggcaactgagtgagactccacctcaaaaaaataaataaaagggtaaattttatggaatgtgaatcataattcaatttttcaacatgcgttaggagggacatttcaaactcttttttaccctagactttcctaccatcacccagagtatccagccaggaggggaggggctagagacaccagaagtttagcagggaggagggcgtagggattcggggaatgaagggatgggattcagactagggccaggacccagggatggagagaaagagatgagagtggtttgggggcttggtgacttagagaacagagctgcaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaactcctgacctcaaatgatccacccacctaggcctcccaaagtgcacagattacaggcgtgggccaccgcacctggccaaatttttaatttttttctagagatagggtcttactgtgttgcccaggctggtgtcaaactcctgggctcaagcagatcctcctgcctcagcttcccaaagtggtgggattataggtgtgagccactgcgcccagtcagtagccccctctttgcccctcactgagccctactggatgttcttggttgtgtgacagtttccccatctattaaacagaaacccctatagcagaggggaggatgaggttggaaaatcaggagcattgttattctattcttgtgggatcggggaagcagacatctgggtggatgtttggggaatgctgggctcagttgaggaagtaggggggcccctggggcttacagggactggaagctctgagctggccagagggatgttgcaatcctgccagggtcttgtctatgctgtccctttcacaaccatccccctaccgccaggctgacacgtggttgtgggggcacaaggccagccgaactagagtctgaggctgggctgaggacaccctccccatcagctgccagggtcactggcggtcaaaggcagctggtggggaaggaattggactccagccctgggggacggatgtggtgatggtgggaagcaggcttggtgccaggaggggcatcagagggtgaataagagcagatagagtgtttgggggaggtagccagccaaagggggtgaggcccggtggaagggaagaaggggcatacactcagagctttgcagctgaaggttttaattttttgagatggggtctcactctgtctcaccaggctggagtgcagtggcgcaatcacagctcactgcagcctcgaactcctgggctcaagcaatcttcctacctcagcctcttgaatagctgggactacaggtgtgcgccaccacgctcagctaatttttgaacttttttgtagagatgaggtctccctatattgcccaggctggtctcttaactcctgggctcaagtgatcctccttcctcagcttcccaaagcgctgggattacaggcatgagccaccatgcctggccaatgcaggtgaggtttttagtgtccagctaaggcgaccccttccctttgcaaaaaagggagactgaaaatcatcaagttaagagcccagagaatatcagggtggtctgggatgtttcaagggctggtctgaaagaaattggaggtggcacgcagggcagggttgcggggccaactgggaggccccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacgaggctgtcctctgagtggggaaaggagctatggtagtctgaggaccccccagagtcagggagattgggaggtgagggtgctgaatggtaaagggcttcggagctaagggaaatggtcaggaccccacctgaccccaacgcccacgggccaggggcagaggagaaaaacctgggtgggcagaaggaggcaatcttccaggggaaggctcaggaggagggagatcaacatcaacctgccccgccccctccccagcctgataaaggtcctgcgggcaggacaggacctcccaaccaagccctccagcaaggattcaggttgttgagtgcttgggagggacacccgcctccactctgcaagaactcataaagggagatgaggggatcgtgggagggagggaggagggtgccactgatcccctgaacccctgcctccgcctccagggtgcccctccggcctcgccatgaggctcttcctgtcgctcccggtcctggtggtggttctgtcgatcgtcttggaaggtaaaagtgggatgggagaattgcggagttggagatttggaagagtgaaggtggctacaggcctggggtcccggcttagaggacctctgagagctctggggccccttcttggtcgtggttgccccattgtggtcgagtgggtctccaggttcgcccaggctcagtccggcaggcgccaaatctgcccaggagagccctagtaaccgatgacgtatggatctccacacctctgggattggctgtcctccttttatagccttgaaagtgggtgatggggcgatgggctgtgggaggaggtcagtgctgagtaaggcaattcccagcggcttgagccccacgcggtcacttcagtatcctccccattctaaccacatgatccccaaggatctccttatctatccccgggatcccaccccaagggggttccaataacaaatttttggtggggcgtggcggctaatgcctgtaatcccagcactttgggaggccgaggcgggcagatcacttgaggtcaggagttcgaaaccagcctggcctacatggtgaaaccccatctctactaaaaatacaaaacagccaggcgttgtggtgcgcgcttggctacttgggaggctgagacaggagaactgcttgaacctaggaggcggaggttgcagtaagccgagatcgcaccatttgacacagcaagtctccgtctcaaaactacaacaacaacaacaacaacaaccaaattttgcacccctgcctcatcttcctggcaggcccagccccagcctagggggctccagaagtctccaacccctttgatggcctggaggagttaggaaagaccctggaggactacactcgggaattcatcaaccgcatcacacagagtgaacttcctgccaagatgtggttagaacccttcccagggcacgggagggctggggtgtgtttgtgtggagccctggaggatgtccaagatgaacagattgaaaaaaaaaacaagtcccagagaggctgacagcatccttctggtcacacagctagatctcaaggatctcagacgtcagggacagtttcccggactcccatccaggccacattttaaaagatggtcttgggctgggcgccgtggctcacacctataatcctaacactttgggaggcctaggcgggcggattgcctgagatcaggagttcaagaccagcctggccaacatggtgaaaccctgtctctactaaaagtacaaaaaattagcctgacatgggggtgtgcacctgtaatcccagctactcgggaggctgaggcaggggaattgcttgcaccagtaaggtgggggttacagtgagccaagattgcaccactgcactccagcctgggcaacaaagcaacattccgtcacaaaagaaaaaaaaaaaagatggttttgcttaggtacggtggctcacacctgtaatcccagcactgtgggaggattgctggagcctaggagtttgagaccagcctggctaacatggcgagatcctgtctctatttttttttttttttttttgagacagagtctcgctctgttgcccaggctggagtgcagtggcgccatctcggctcactgcaacctctgcctccccagttcaagcaattctctgcctcagtctcctgagtagctaggattacaggcgcccaccaccacgcccggctaatttttttgtatttttagtagagatggggtttcaccatcttggccaagctggtcttgaactcctgaccttgtgatccacccgcctcagcctcccaaagtgctgggattacaggtgtgagccaccatgcccggtgatcctgtctctatttaaaaaacaaaacaaaacaaaacaaaacaaaaagcatacaagccagccccggtgcgatagctcatgcctgtaatcccagcactttgggaggctgagtcgggcagattacctgagatcgggggttcgaggccaagttgggcagatcacctgaggttgggagtttgagaccagcctgaccaacatggagaaactccgtctctattaaaaatacaaaattagtcaggcatggtggtgcatgcctctattcccagctacttgggaggctgaggcaggagaatcacttgaacctgggaggcggaggttgcagtgagctgagataatgccattgcactccagcctgggcaataagagcgaatccacgtctcaaaaaaaaaaaaaaaaattgaaaaaaaaaaagatggtcttgtggggtaatgaaggacacaagcttggtgggacctgagtccccaggctggcatagagccccttactccctgtgtgatcttaagagagaggcattactgtgagcctcagtttcctttcctgtgaaatggtggttctgtggggaagtaaagcagaaggcctatagggtgtctggcacattgtaaatgctcagtacatcttcaaatccacacttgctccctttggcaagttagagagtcattcgttcctcaacacatatttattgagcatctgctaagtgctagaaactgtttcaatgtggggaataaaacagtgaagaatatgccgagcgcggtggctcacacctgtaatcccagcactttggaaggctgaggtgagtggatcacttgaggtcaggagtttgagaaccccatctctacta

SEQ ID NO: 418 - DNA, 20001 bp, Homo sapiens
ggctgaggcacgagaatctcttgaacccaggaggtagagattgcagtgagccaagattgtttcactgtgctccagcctgggtgacagagtgagatgctgtctcaaataattaaattaaaaattaaaaaatgaaacgtttgaagagttaaaatgcctccaaatattcatacattgcttaaaatggtaataatgcctctaagcatttgatcaaatcacaactttaatactacttttttttttttttgagacagagtcttgctctgtcacccaggctggaatgcagtggtgtgatctcggctcactgcaagctccacctcccaggttcatgccattctcctgccttagcctcctgagtagctgggactacaggcgcccgccaccacacccagctacttttatttttgtattttttagcagagactgggtttcaccgtgttagccaggatggtctcgatctcctgacctcaagatccgcccacctcggcctcccaaagtgctgggattaccggcgtgagccacagcgcccggccacagcttgaatagttctaagtgttggggttttttttcttcagggtttttgaactttaatacttccttttttttttttttttttttttgaaacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggccctgaactttaatacttctaagtgttggggttttttttttccccctcagggtttttgtttgttttttcctgagacagggtctctctcttacccaggctggagtgcaggggctccatcatagctcactgcacactccaactcctgaactcaatcctcccacctcagcctcccatgtagctggtattacaggcatgcaagaccatgctcagctaatttttatatttttttataaagatggggtcacattttgttgctcaggctggtctcaaactcctaggctccagtgatcgctcaccttggccacccaaagtgctcagattccaggtgtgagccactgcgcccagtcctgaaatgttcttaaattctttcaaagtagcaaaatttatattaaaacattccaaacatgatgagctcccttgctctacaaggatttacaagtagaatcaattaggtggacagttatagctgacagttgacagagagatagttatagatggaggtaggtatagagggagggaggcaaaaagagttaaggaactggacagctgagaactgtctacaggttccaaaaacaagacaaagaaccttttattatctgccaaacaagacagtctacattgagactgctctgcctttcgtttttatgtgtcaaagacacttaaattggcctgtaatcccagcactttgggagaacgaggtgggcggatcacctgaggtcaggagttcaagaccagcctggccaacatggtgaaactccatctctactaaaaaatacaaaaattagccaggcatggtggcgcacacctgtggtcccagctactacggaggctgaggcggggggatcacttgaacctgaaggcagaggttgcagtgagccgagattgtgccactgcactccagcacgggcaacagaacaaagaccctgttaaaaaaaaaaaaaaaaaacttaaatgagtcccaagaaaaaaggaaaaaagaatgaatattgtgatgtgtggggcaagacaagatctagatggtctaaggacaagcaaatctggggaattaacttctgcccatccaaattacaaggaaaacagatgctttgggcaagtgtcgaggaacagtctcatacttaagacaaatgtaggcttacgggctgagaattcttggtgtaaaggttgaaaacggaccttaaacctttacgggacattgacacagagaggtcaaacccgcgcccaggacgcacagtcagtgagaggcagagctgggaagggaacccggagctccaggcatcggctcctccacctccacctgcgctacccggtgcattttctcctccgtgctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggtactggctgagggcccgcgtcgggcccgccctgcgcacgcgtcgtgatcaagggcgccggccgccggccgcgcccccaagcctctgtttctcagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggtgcttctgggactgagctctctcgatgtggagctggagtagaggggatgtgtgcggctgcagtatcaggcgagggagtgggctttatctcgagggcgtcgggagacatagaagttttgaacagaatcaggacatcctctgaggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggcgtcctgggctgtggacagggcctatgaattggactgaggaatgggcagggactcagccaggtgtgggcagttatggcttgagggtaaagaagaccagctgggatgcctggggctattgggaagagcctagcacctaactgaggaggggagggtggcaacagagaggggaagaaaggggacaccgggtgaaaggaggaagggattgagttcctctgtgttcacaggttgttgaggctgctcccctgtggcgactggtgagaatcatccagtccctcaggctggatgagcagcctggaaatgtcaggcaagcaggctcagcaggggagggtcccagtgatgggtatgcctgggaagcccctgctgggactcacagtttcttgctacaagagcaggaagggtgcatctggggagggtcatgagtggtcatgctgagtcacgagtggacacctggggctgctcttggtgtggcagctgagggcccagccaggacttgttctagcttgcttgtgtatggcgttgccagtggggaggccaagaaggcatctggggtctggtcagggagggcagaggggaggggtcccagacatgtgagggaagtgccatctgaagatggtgggggcagaacccagggaaggagggtgagtgtctgagggacatcatggaaggtggctgttgggatggggagcttggtcctggctcacagccataccttaaactaagcttgtccaacccactgcccaggatggctttgaatgcagcccaaaacaagttcgtgaactttcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggtaaggtcctagatactccatgaaatgggcaactgataacaagctgactggccagggctgccccctcacctccctggtggctgacgagcaggcctataccttgcagccaggagccatgtggaataggggtctggtcctatagacatgcagtctggttggctcaaccactccctgtggcgctgtccggctgtggcctctccgagccttggctcagtccccttcctttggtgccctgggcacagttgctgccctggggatgaatgagctattcctgtgagccccttgccctgtgccatctttagattctgcagttgcacagatgacattttctgtttccgtgaagccctgactcctgccctctgtttggaggtgggttatcttgagctggggctggactctaacctgcacctcctcctcacaggactctccacctctcgacctcgtgtggtcatccaactggagcgtggcgaggagccctgggttcccagtggaacggacacaaccctgtccaggaccacctacaggaggcgcaaccctggtgagagggagctcagggtggggtgaattcaggaccaacctgtggtcatgcctctgtccctggttcccagactccccagaagcaccctcctcccctccctcccacccgattcccttcccttccatcatcagcccctcctggaggctgcagccttagctgcccttgaaggtggagctccaagggcacaggagcggggttgacacagaagggcactcaggctatggtgagaccatctcagagtcctgctatcagctgggctggcctcaaaccctccatggctagtcactgccataattgatgggtcatttttttcacccttcatctttgtgttcagcaaacatttcctgagtgctcacagtggtcaggcccagtccaggcaatgtagacacagcctcaatcaggacgaccctggtcctgcttttctggggctcatggtgtggtgggagaggcagtcggtaagcaggattcaggagtatagtctagagcactggatggaggtcattgcaggagcaggttggggagtgggtgcctgagaagggggacaggggcggggggaagggggtaagcaatggaaagagtgtgggtggaatagccagtgtggagatgtatgcagcatacagcagccgctagttttcctcagcttcacatcctgggtgtcggggggctgccaccttgatcatgggagtgcccagtgtagtcagtgccatacctatcagggcagattgttcctccaaaccccagcccctcctgcagggccagcctcacctctacttttcccctaagcttttgtgccagctccggggttccttcttgcctgtccactcagcctgccctggtcctctcctaaccaggatgccccaggcaaccactgtttctctgcctttaggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatttgtgtgaacggtagcaacctgacacctatttcaccctcatacaatgcagatggtattgaacataccctgacatgccatcagcgtttgtcatcatcacagaagttcctggacttggcttcaacctgggtaccctcaagaggccacagagtagagatacagcctgtctgcagcccagggagggagtgggatacctgtatccttttcagggtcagaggtgggttggggtagccaggagctggatgaactgggatagagtggggctgtctggagcagcagccctgctagatgagtcctggtggatcctggcaatgggaggatggtaggtggagaaaccaaggcagggctgtgttccttctgctgctgagatagagggtgtggccatgtgtgatgaccctgcaaggttgactccaaccagtgggcactccatcccatggcttccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatcagcctggagggaaacctccacccccgactttgtaggactgacatctgaagacgtcagagactgcggtcacaaccgtcggtacctccttagggcgcttaacagaggtcaaagatggccctcgcaccctcctggcgggagaaagcccaggctcagggtggtcttctacaccaccgcctctcccgggtccacttggaagcgagtcccagcgaactactcgacctaggaaaccactgggccgccacttccagcctcttcggaagtcgaggcaacgctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggtgggcgtctttcactgcagaccttcagggccgggatgctgtggccatccctcgactccgcgcaacgtggagctttggccccgtttttcttggcctttgcttttcgttttcacatgcacgggccccggcagtgtgagtcgcccacggctcgctgtggtcagcgagcacgatgtccacgtgccccctccccagagccattcctaaaggaggtcccacccagtcaacctccccgagattgtggagggcgactcgtccccgtacattacagcctggccccaccttctacccgcccaccctggtccactctcctcgcacctcggctagacactgtggctcctcagcctggcgctggaactctgtgatgactgtctttctccacctctttagcgtcatctcccagcagtcccctgctggacccaactgtttgcaatttccaggaagctccctggacaccttgcgtccaagcatttgtccctgaggcttcctcctgctctcatttgccatcattgtttgggtcctgtgaccctcctccttccatgaagctttcttggccttatctcttctggcctcagagtacacttggtcctggtctcagccccctgggctgagcctggtgtctgccttcccctggccagattctcttggctgacattccgacccttccttttctgtaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctgggtgagtgtggctggcatcagcttcttggagggatagaccctggctagagccattgtgacctacctcttctcctcagatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtgggtgaggttggggtcccaccagagatgagggactcctggaggaagtgtggacattcctggctagggtgggagtcccaggagaggtgtgtcaaggctgggactcctgaagtgaatgtggatgtccctgtctgggatggggacctgggaggcaggagccaagggctggctacgtgccatgtcacacagcagaggagctcctcatctgccatggctcatgtgggcagcccctgacaccacccttccatctgccccacttttcagcaccctccagccctccacttgcagcacagtcccctgaggggaaccatggacaccaagaaccagcctccacatccttccacccacccaggattcaggtgagcagccccaagtgggaagtataggccccaggtgtgagaagggactgtccccatggctgccctctgcctggtggttttccaggctccttgactagtggctctttgcttcccagaagtggagtctgtaaaagctgtacccctccacaggacctggggcagagggacagactggtgatctattattgaaaaggatttggggctggacatggtggcttacacctgtaatcctagcactttgggaggctgaggtgagcggatcacctgaggtcaggagctcgagaccagcctgaccaatgtggtgaaaccctgtatctactaaagatacaaaaattagccagaagtggtggcaggcgcctgtaatcccagctactagggagggtgaggcaggacaattgcttgaacccaggaggcagaggatgcagtgagccgagattgtgccactgcgctccagcctggtcaacaagagcaaaattgtgtgtcaaaaacaaaaaaaaaaaaaaggatttgggcctcaagccatggaaacccagtttagagtggctggaactagtgggcttggcttcctcacctccagagaagtcagctgggaggtttgctgctcccagaggtcctgagccagacctggggatttgaacttttgtgtgtagctggggaggggagaagatgaccagctgtggcaggactccccccacacctgagaccagatggagacactctccctgggaaatgcccgaagtcccttctctcctaggggtttcttcagaggccacctgttaggcctggaagctcagcttgaggcctcttctacctggatcgcttggttcccaagtgtgggtagcaaggtcttttcctctcccggctcctctaacaactccactggggagcttcagcagcaacattgctggttgagatgtgtttcgaggctaagaagtccttccaggctccctccacagccccatggcacagtcagaaagtgaggcagggtgggtaggctgcacttcccagtgtcctcacctccagccagcaccatctctagctgtggctcctcacagctgccgccttcctgcccctggacttgccacagcttgtccctcaggattatttttcccaacccagcaaagccccagatgatgggactcaggcagcaaggagggctgacccccaatcagggagttcattcctcgataaagtcactcaggtccctgtgatgctgccaaacctgccctctgagcaggatggtgtagtagagggggatgagtgctggcagcagcactggtcaggtgatctgaaggagaacctctgcacttaacaaacacacaccttgagatcattctcagcaggaggggcagatgaggcgtaggtaacctgctgactcttccgggtaataggtaagaatgtgaaccagacagggcagggaaggggtggaaagacgcctacagtgatgggccacatccgcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcagggttaccgccccaccagccagaggcacaggcccagtcagagctggggatgctgctcacggggacaggcgtctgcagaagcctgcgctcgggtgagtgccccacaccatccagcctgaatcacccctcctgtatcggtgggacctgagccacccactcatggggggacgggagcttgtgccacggccacaagcctgagggaggggttgctgagtgccgggactcacctggtttgcccctgcccccaggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataatatggagtttctgaataagaatcctgatttctggcttctgctggtcgggaaataggcagtttgctgtctctgcccagtagctgcagcacagggcagttgagcccagaacggccaaacctctgttgccacagaacccaggtcccaggtccccagcctcccttgctccttgccgcccacatcactcaccagcctcactggccttggaactcatcagtcccggcttgagagacacaaaggggatttcctttcgaagtacggctggacaagggggacctctgagaagaggggctgcaagcaggggttgcgccaaggccatgggtacttctaggtcaggccgcaccctccatagttagctggtcatgcagcaggaaggcaaaaggtcagctccctgggaagcaccggatctctgggcagtcactggggactcgccaatgcactgtattagttttctgttgctgctttaacaaacttggcagcttgaaacaacagattctcttatagctctgaaggtcagaactctgacatgggtcccactgggctaaaatcaaggttttgttttgttttgttttgttttgttttgtctgagatggagtctcgctcagttgcccaggctgcagtgcggtggcacaatctcggctcactgcaagctctgcctcccgggttcacgccattctcctgcctcaacctcctgagtagctgggactacagacacccgccaccacgcccggctaatttttttgcatttttagtagagacggggtttcaccgtgttagccaggatggtctcgatctcctgacctcgtgatccacccacctcggcctcccaaagtgctgggattacaggcgtgagccaccgcgcccggccaaaatcaaggttttaacaggactggttcctcttgaaggctctaggagagaataatccattttgttgccttttccagcttctagagtcagcccacgttcccccttttttttttcttggtccattcctccgtcttcaaagccagccatggttggtcacgtcttccttaggctgccagctctctgacacccatcgatcctttggcctccttaaggaccctcatcatatcttgtcccctacctgcacacttagtcacaccgcagagtcccttttgccaattgagatgttcacagcttctggggattggaatggggactccttgggggccttgattcagcactcttctccttcctactctgaaaacaaggggcattttcacaggggatggtttcaggaaatgggtgccctctcggaaggagccctcgccagctgctggtatgtgcagcatgtgcacaagtcgcaggtggatgttgagggtagctgcgactgtggttaccccaggaggggctccctgggaggggcaggaaccctgctgcggcctgaagctgggagagggaggctctcctcagaggcccatcttccccatccccttttatgagggccttctaacccgttgctcccatgtgcagggctccggaagcagggccagtttggagatggagctgggggtgggtgatctgtgagcaagcaggaggcgagagctgtgctggggacagagaagaagaagacagagcagtacccaggggctccagctaggccccagcccagaagggagagtcagggtatagaaggctgtgaaagggccagatcatgcaagaaaagctgcagggggtgagggcagtttttaaataaactttttcacatttagaagcaatttatgctcacttagaaaaatttgaaatacacaagatggcaaagaagatcatgaaaatgttccctaattcaactgtctcatggcaatgcttactccagaagtttacatatagaagtggttgaatgtaaagtttcttttaaggcaacttatgttgtttcactttgggagaccacgagttcaagaccaatctgggcaacatagtgagaccttgtctccaaaaaaaaaaaaaaattaaaaataatagtaggctgggtgtggtggctcatgcctatattcccagcactttgggagaccaaggcaggtggaccacttggagttcgacaccagcctggccaacatggtgaaacctcaactgtactaaaaaaaatacaaaaattagccaggtatggtgacatgcacctgtagtcccagttacttgggaggctgaggaataagaatcacttgaacccgggaggcagagctgcagtgggccaagacggcgccactgcactgcagcctgggtgacaaagcgagaccctgtctcaaaaataatactactactaattagccaggcatagtggcgcatacctgtagtcccagggagactgaggtgggagaatcacttgagcccaggaggttaaggctgcagtgagctctgataacaccattgcactccagcctgggcaacaggatgagaccctgtctggaaaaaaaaaatacggaaatgggagacggaagggtaggtcagagagagggatgatggatgaaataactgcaaatattcacaataggagagggatgaccccaccatatggaatgcttcacaaatttgtgtttacccttgcacaggggccattctaatcattccaattttagtgtatgtactatagaagtgagcgagcagttaacttttttcttttcatgcctggatgaatctattttctggctggcaccatcatttctaccaagaccaaagaatttcttgttccctcctcaccctgcagtacccagtgctatgattaattctcttgagtaaacacttggatactactgtggctatttctgtagtataaatttctcaaaatgggattggtgagttacagggaacatgagatttatttttgccttaaaacagcaaaaacttattgtacaattctggagaccggaagttagacaccatctcaccaagctaatactagagtgttggcaatggctgggcacagtggttcactcctgtaatcccagcactttgagaggctgaggcaggaggatcacttgaggccaagactttgagaccagcctgggcaacagagtgagaccccatctctaaaaaaaaaaaaaaaaaaaaaaacacacaattaaaaaaaatttttttagctgggtgtggtagtgcacacctgtagtcccagctacttggaaggctgaggcaggaggatcacttgagtccaggaggttgaggctacagtgagccaagatctcacgactgcactccagcctgggcaacagggcgagactccatctcaaaaaaaaaaaaaaaaagtgttggcagggctgca

SEQ ID NO: 419 - DNA, 20001 bp, Homo sapiens
ccagcctctagtatcctctgttctacttttaacttctatgagattaaagctggtttcatttgaggcctctctccttagcttatagatggccatcttctccctgcatctatacgtggtcttccctctgtgcatgtctgtgtcctaagctctccttataaggacaacagtcatattagattagggctcatcctaacaacctcctctaatctcgttacctctctgaagatcctatctgcaaatatagtcacattctgaggcatttggggttagggtttcaacacatgccttactttgctcgggctgccttaacaaaatagcttcaacaacagaaatgtattttctcacagttctgaaggctagaaggctgagatcagaaggagggctgtctcctttgctttcagacagctgccttttcactgcatcttcacatggaaggaggatgagtggggagagagctctctggcatcttttataagggcattaattcaatcatgagggtcctaccttcataaactcatctaaacctaatcacctcccacaggccccatctcttcataccatcacacgggggattagggcttcaatatatggattttggggggcagaactgagcccctaatagctgaacgggaaccgcaaacaaaaataggtctacacttctggtatttcctgagaaaggcttttaaaatctttgataagattctgtcaactgactagctgaccaggcacagtagtcctaatggtcttgagagtgcctcgaatgtggcctgcccagtgtctgagtgcttcctgagatgggctttggtcatggtgtgtgcggcagtggagaaaggttggaggttgcctctagggcacaacactggcagatttggtactgtactctggtgaccacacaaccatgaaatcctgtggcattcattccaggagtaggacaaatccagaaaactactgccctaggacactcataaagcctttcagcagcagcagaataacccaggaagaagaacgataaagcttgttgacttttgctctttggaggctatctttctcctagcagagtaaacgcatctctaggggattaaaggcaggctccagagagctatcgactcccacgcaccttcaagccagcaatccttttagctcaagagataacatagccgctaaccttggccttctcaggaagggcaggtcagggctttgatgctgtgagtgattttgttgggaaacaagagatataagggtgtcccttgcaagaaagaaacacactataaaaaaaactataaattagaaaaagatttatttacatgagatattaggcttcttcaggaaagtactggaagaaatatttttggctattcatttatgagatttttaaagtgacatcattgacatcaaccagcctaaaaagaaagacacaataatagcatatttgggaaaaaatgatattaaactaagacaaaaaaattatattggtggtctgaggagtgtgatgaactcaacagcagtttggctccattatggtcagagcatttactgtctgatttcaatcttttaaatttgttgaggcttgtttatggcacagaagatggtctgtattggtgaacattccatgggcacttgagaaaaagcacgtattctgctgagtttggtgtagttttctacaaatggcaattagatcttgttggttgagggtgttgttgagttcctttacatccttgctgattttgtctgctggttccattaattgctgagaatagggtattgacgtcagcacctataaatgaagctggggctcaaaagccaaaaccaaacacactgtggcctccagctctcaatcaatcaataaatcagtgacaaagcatgtattggttaatttcagcatccttggccgtatcctggatggtgaaggaaagaggagatatgggcttagttaagaaaacttggtatttacatcatgtatgaaatagatatgtataggttcatgctgatgtgctgaaacatttgtaacttccctttctaaagatttttttttttttgagatggagtttcactcttgttgcccaggctggaatgcaatggtgcaatcttggctcactgcaacctctgcctcccgggttcaagcgattctcctgcctcagccttccgagtagctggggttccaccacacctggctaatttttgtatttttagtagagattgggtttctccatgttgatcagactggtctcaatctcctgagctcaggcaatccacctgtcttcgcctcccaaagtgttgggattacaggcgtgagccaccacgcttggcctttaaagatttttatgtgttcagtcaattcatcctgttagccagacttggttctaggtaaccatatagagcaataagaagaaaggcaggccttccacatgctgggtgatctatggagcagcttactcttgttatagaacaagtggatcctacacagacccagaagatacccaccatttatgcagggctaggtactgatgcttcctttgttcatgcatctcttctttttaaggatgtggactaccagcgtggctaggaactcaagctctgaagccaggggccttttcagttctgccactcactagctgtgtcatttggggcatggtatttaattccttgggcttctgtttccctatctgtaaaaaggagatcacaataaatgatacctacctgacagggttttgtatttattaaataagttaatacagataaggcacttggcacagtgctggtacttggttaatagtccataagtattagttattatcatttgtctaccaatatatcctttcacgttcagttccctttcttctatgggtatgggtcattccagtgtgcaaacataacatccacttcagactcttccccaaggataccaagatgagtacaaaatgtttttcttttagtttacttctagcaagacctatataaatagtcaaactataagaccaaatatcaccttaagagagataaagtggctgctggagtcatgggtggtggccaagtaagatgaactgtttttacaaaagaccccaaacctctgagagattttgcaaatcattcctttggatgcttgcagaatggtcaatggacatttttgtgctatttgtgttttactaaagatgtccatgttatatctttttttactaggtggaatttcacatttttagtggaaatgccaacttcttattttatacaaaatttgcttttacttcttattttgtatctttatatcttcaatgcagtttctgcagaaactttgaagctttcaaattattttttcaggtaggctatcctttcatctctttaacatctatgtaaaacaagtaataatcttctcagttaatttataaaaaatcatccaaagcataactatgggatagcatttgcaatccaatcaaaaaaatccatgctttggctgaaagttgagttgcctttgaacttcctgaatggtgtaggggatgagcagggctgccccggccaccagtatccaggaccccagcccccagtcagggatggaaagtaaaccctcacaataaagtctgttagagagtttcttatgttaaggaattcagagctggaattcatcattttgtgatttttttatggtagggaaatactttcaacgttttagtttcattgaagatgaatactacatgacaaaatgcccctcccattcactaatccaatcagttgttccaaaccttctcaaggctgtgactctcccagatctagctgtggcaccctcacaagggagaaaggactttcagcccttggggaagtctcttagtgtcctataatcttctttacctcatcccccaagtataggggtttaattaagtaggccaagattctttaatttttattctccctcctctcaccctctgaattctacattaattattttctgaccatcacaactcttttaaaaccatactatcataccattcaaaagatgtccattacagggtctgatttcaacttatacacacgttctcaatatatatttatggactgtcaaggtttttgtatgccaggttaaggattctagattccccataaaaaggaagattcagtgaggaattttatatatggagagatgaatcctgcagaaacaaaaacacttagatgtaggacagggaaaacaggaacacagaaaagagagtcccaagaagtaagaaaagatacagaagagagtggtggtgcccatcttgcctgccccaaccctctctaggtggagatggccattgaaggctcaagtctaggctctgcccacctgggctctgagcccatgagaccaaggcccacaggatctgcccatgagacacctcttcctcactaatcagtcaagccagtagcgggtcttcctgtcctaaacctggttccactgtgcacagagagcccctgagtcccatgtcctaaaacatgtgaaggttgattagacaaattgggtcattcttgtcatactgaaccaaataagactccaggggccaaggggaaaaagcacttggggcacaaagcacctgctccaagaattaaattttctccaagcccggctgctaaaacagcctggtgtaaccctaagaccagttttgcctagtagctgctaaaacaacctgcctctaagactaattttacctaccactgtcactcaccagtcagagcttgccagctcccaaaagcttctttagtgccaaagagttttctttcaaaacagtatgtgatatttctctttctgataaaactcccaatcctctttttgttcttcagacctagggaagaccagggagtctgcgtgtttgccttgaattggaattcttgcttcccaaataaaaggttttaaatttggagatttgtctctgtatattatttgacttcagcagctgcagtctctgtgaaagcagtggtgcagcacaatggttcagaactgtggcatctgaaactagctggcctgggcttgagccctacttaggcacttattagtcatgtgattttgagcaagtcacttgactttcttatgcattagtttcctcactctaaagatgggaataagcgcagccctgccttataaagttactcttgtgataataattaaatgaattaacatggcttaacagcatctggcaaaagtaggtaaggacttatacaaacattagctgtgtacattgttgttattgttacattgtaacgtgtgcacaaatcatggtttgcaggacatctccacttactggagctcccatggctgatgcgctgccaaacccttgctagctcctcttctgttgccctctgcttcaagcagggtggactttctctggaagtaaaatgccagcacctgtctattagtttgaaccatatatgacattgccattttttgtaggtcacaaattattgaacattgacaattttctatggtttaatctaaaataagtaatgctcttggcataaacctgcaaacaaacaactgcacttcacactctgaattatgaccttgacctccgttttgagaaccagctttagtgtcaattctttgagtcctagacttgcccattttgggcttgctacctcctctgttaaccctagggctgaggaatgataataatgatgataataataggggatcctctatagctaaagggtatatatgatagttgcaaggggaacagaaatcactctaacttagaatagtgtggctggtatatttaccctcagattagagtagttataacataaggcatagatggccagatggtatcctttcaccccatctgcctcataaggatccctaacttcaaaagtctaatgttaattagtaagtgatagttgtcaacttctagtttaaccttagaatatttatatatcatgggacaacttcctaggcacacagtactgtcacaaaaagctgttatttccataccaacagaaacgtgggcgaagcatataaacagacagttcccggtaagggacagaattcttaaattaggtgcagtggctcatgcttataaacccaacaccttgggaggccaaggcaggaagagtgcttgagcccaggatttcaagaccaacctgggtgataaaaagttacaaaaaaaaaagggtttgttttgtttcgtttttttaaaaaaactgggcatcgtggcatgcacctgtgagtcccagctcctggggagactgaggggcttgagccggggatgttgaggctgcaatgagtcataatcatgccactgtactccagcctgggtgatagaacaagaccctgcctcaaaaacaaacaaacaaacaaacgaacaaaaaatccagccataattacactgagttacacatgataaacttcctacgagttggagagtgatacatccctccagtgagatgtgagggaagaggggactgatactcctattgactcacttctctggacccacttcctattgtttctccagacttagtttcaggtttgaagataaagcttctttaagaggtcagttagaaaatgcaagatcatcttgtgtttatgtgccatatgctcttttcatgactctcattcgtctcatctcatctcatctcatctcatctcatctcatctcatctcatctcttctcttctcttctcttctcttctcttctcttctcttctcttctcttctcttctcttctcatcccatcccatcccatcccatcccatcccatgccatcccatcccatcccatcccatctcatctcatctcatctcattggtcctgtcctgagtcctgttgagtcctcggtgctgtgctagccacacaggaaagacatacatgacactatccttgccctccaaaaaagtcagaaaggcaaacagtaagtagaagaaaatgttagaatcctgatgcatcttctttgctcctgattcaggattcaggagcttattttcccccagtatttgggtaaacagccaaacaattgaatctcacattctagggtggagtggagagacatcaccttgccataatacatcggctttcctgggagtaaagtcaagttggaatgctgtctgtcagcggcagttccactggatatatcaaaccctgcatctctcctctccttttttttttttttttttgtggtgaggatgatggagtaaatatctccttggtactctgagagcctgcagagagaggtgtttgcatgaggaggcaggaacctattctatttggattgagaactttttgcagtcacaagtgatgagtgacagcaaaaaaaagttatgaattatagtttattatttccattactcttcccacctctccctgggctgggaacttctttcctgggcagagacagataccttttacctgtctggctctgcttgtggtgttttaagagggcagcaagttggcctccaagggtttctttccatcctgtgatttgtatattcctggatttgctgacgtgtttcagacaacagactaattgctctgcctgtgttgttctccctcctgcttttgaaggatcttatttcacgtgttgtgccctctctctcctatttccagattctgcttgttggcaacatggtcattccaagcattggaattaggcttgggtgtacattctgtttcaggtctcagtgattggggtggcaataggcgcaaattgtttaatttcttagaatccgttttctcatctttaaaaggtcaataagaaccatcttgttactgcacagattttgaaaccagatctttggttccattttggctgtttttggttccattttgctgttacttggctgtaagcccttgagatcagctttacttctctgctcctcagttttctcacctgcaaagtgggggtgatgataccactaacttcataaggcttgtgaggattaagtgaagaaataaatgtaaagtgcttataacaatgtctgtcatacattaagtacccaatagatattaaatatcattattatctgtcagtgtcattctgaggattaactaggaaaacatgcataaagtgattagaacagtgcatataaagcatgctatgttgtttccgtatgaatcttgtcaaatccctactaccttaaaaatatttttttcatcctgaatcactagctactcctctctttattcctcctgaattttcccacaatgtacttctccaaaatgtagatcacacacgttgtctccatttttctcacttccattcacttctcagctcaatgcaatccagtataggccctctccatcactcaaaaacgtggaaactgtcctattaatgttgccagagctcattgaacaaacccaggggcagcatctgaatctttatcctgcttgacctgcctacagcttttgacactgatgtgcattgcatacttctcgaagcccttctctccactgggtttcatgtcatcactttctgctagtcctcctgccgtcttgcatgcaggacctttgcagcttgctttacaactgttgctctccctcttctttaaacatcagtcttctcccgggctctgtccttgttactctttatttcacctattctgtggcttcaacttctacctctatgctgagagctccacatttatagcttcagctcagtttccttctctgagctcctcacctaacaaatataatggacaaacccaaccaatttgatgtcttggaggcatcttaaacacaaagtgtttaaaactgaatacatcatctcacctacccttgactcttaataagtctcttccctgtgttccttccttgtattagtaaatggtactgctgtccttcatatgtccaagccggaaacctaagagtcatcatagtcttttccccttttttttttttttactactgcatcccatcaatcattaaggctaagaagtatgctttttaaatatctcctccaacccttctctactgcctcagatgtgaacatggctctcctgtgttattataatagtctccttgcgctccagttgcagctacacaaatcattgtgtggtcccctgaatatttcacgctcgctcacggctctgagtccaggatgatgcctatgtctgcctggaatggttccttcccattagtttgaaaaacagaattaaaatcttctctagccttccctgatgtccctggcacatttagttgctgctccgaatgctacccatgggctttgaatgtatttccagtgtggtaatatctaattttactataactgttcacttggccgtccatctatccgttactatgaacatcttaaaactgaaggcaacgccttttcatttttgtcatcttagtgccaggcacaccaaaacctttccacctggatgccccacaaacatctcaaatatgacatgcttgctgaatgactgaatgaatgaatttgttgaacaaatcttttctatcttctgtgtcttgagtgtgggacacaactatcttcctcactttcggtgacaaatatttcatcacctcttggttgacagagatgttaactaacactaaaacatgtcagttctcattggccatttataacttgtctttttctcaagccccagctacctataagaagtgataaatgaaacttatccaaggtaagtctgttgttccatagaaagagcatcctttgaattaaagcacagcattgataggagtgcttcctgggtgcacagttggatttgaacaggatgttgatatttcagagtatagtttttacctggcatgtattttaaaggattaataaaaacaagttggagaattatttgcaggtcacttttttaaagttctgtatacaaacacaaatacacacacacatatttcatttgcaaatctaaaaacatttactgagctacagtacaacccatcaatcctacttctgggtattcatccagaagaactaaaatcaggatctcaaggagatatctgcatttctgtgttcattgcagcattttccccaatacccaagatgtagaaacagcctaaatgttcattgtcttgacagatgaatgcaggtaaagaaaatgtgatgtatgcaaaccatggaatactattcagctttaaaaaaagaacattttacaataggtgacaacatggatgaactttgaggacattaaaacaagacatggaaagataaatccaacatgattctacttttaatgagggatataaaatagtcaaattcatagattcagggtagggatggtggttgccaggggcttggggaaaggaaaaatggggagttattaatcaacaggcacaaagtctcagtaaggcaagatgaatcatctctagatatatgctgtacaacatcatgcctatcatcagcaataatgcattacacacttacaatttgtaagaaaatagatttcatgttaagtgttcttgctacaataaagtaaaacaaaatacttactaaataacaaaggaaaaaatttcacatcttagtgcagtagatggtttttagcaatttctactatctgttgggtcacacttaacatagagaatgcttttgcattgtgtcttgtgaaatttgttctagctctacactttataaaactttgttatactctgagaaaaggcagagagtccactttttaattcttttttatgactcagtaatgagatacaatttttattttaacgaaattctttgcgatttagaaaaatgaagtagtttcaaattggaaatctaaactctctggtacatggaccaccagctcacttcttaagcaaaagaaccaatcagttaataacaatgaaacataaagctatgaagggtagaatatatttatcatttctcagctatgtgaaaaatgccaccatgccagctttcatcatctttccccttatcatctaaatgtatatttgaaatacagcatcataaactaaatggatgtttttaagttgtcatgttagactttcgctggtcataaagctggctgatattattttctattatctgagcagccaatcaaggctttttaaatacaaatcttatacaactctccaaaatcaatgttacataactaaatgcacctggtgtgcttaactgttaatttttcctatcctttattactcaatgagtaatgaatcaattatgatagagacagttatcaatttcgaatattaaaaagaataaatagaggacaacatactttttctaaagcccaactttttcacttgttgtcagatcactgaatttagtgaatgaattaattttgctaatgttaattatctgtaagaaatgtattaccctaaataatcaggattaaaacaagcccatggtgtggctttcttttttttttaagttgaggtattattacacaaagaaaaagaagcaattctaaattatgtatggaattaatcttggttggacttgggtaagccacaatgggaaattaggcgacagttaatcttctgataaatacatctggatttagactacacaattgtttagaagttatttgggaacttagaggacaattcctctaggtaaattgtttcccctaagttcccagcaatggggtgattctgaggctaaaacaaataaaaccccccaagccccccaaaactgtcttacccacaacaaaagagaagcacaacagcccaataattttaaagaataaagctagatctgcttagatgcaaatttttaaaaatcagattgtatagacacaatatgatcaaatatacaattagcaaagataagcctctgaactgcaataagccaactcaaaaaaaaaaaaaaaaaatacacgacggcccagccggagataagagagtcagcccagtattttctctccatgtttttaagagcagcagttatggtgacagaatctaccacagggtgatctatgctctccacaccgatgacagaagtgacattcactgcattgcacaacaaattgttttcaacttacttgtttttggacatgctgctgcagtcggagggaaattggaaatcttgtacacaccttataaggagtaacatatgacactgcatttttcaggaaatcagttggacctcagatttggtcaaagtacttctagatcccattgaagtggtgatactgtgatgctgagaatctgctctgagcacttgtttagttgatattggggcagtaaaccatatggaaggtagattctgtcactctaaagattttctcctccttttcatccagggttatatgactattcttcttactacaagaatggcaaaattacagtggaggaaactaatcattaaatttttttttttttttctttttttttttttttttttttttttttttttttaccacagagctctttgatcatctggtaagagctaacgacctcttatagaaatctacaaatgcccagaaaattttgcacagaacttcaagaggttactcagctactgaaatccatccctggaccccccgaaactccttaattaagatgtttactgtgacaactggaggatcaggttcataccttactcttctctgtctgtgacatgacttttacccctgacccagacagagccttcaatattgccccagagacccaccttgccttacagtgtcttgatagtggagccacaccaagctactcaggcaagatgtgtcactgataactcctcagtgcagatatcaagtttctgtaagaatgtcctagtggcaaaagttcacactaagcacagtacatcaagaatacaaatacagcaagtctggggtgacagattttctacattgttctactttctgcctctccctcttccctggtctatagttaccgtgcatagtgacaggccagacagacagaccacactccccacttggctcagactctgtcctgtactctggctctttctcttttgtttctccatgagccaaattctttaggaattgctctgaatgaacctcctggaaatctctaggatcccagctgtatctcccctttgtgatgtctttgttactgaggagtaattaattgttacctggtgtgacatttaaatattcttagtattctgtcattgtttctgaccatcctccttctgtagctaggtccttgagagcaagatgtctatggatattaccccttggagctaagaaatggatcaattgagatacgtttcaatactggattgaactattaaagcattaggcaggtagcaaggctgaatcaaaatagtcttaggaacattggaataggaagggcatgctgtctcctctgcgtttttcaaactttttgaaagtgatgcattgtaataaatcttttccccattacgatagagtatacaaaatatgtgtaatagagacaaaaattatctgaaacaaaatttacccatattacatgtgctgcactctattttctattctgttcaattttatattaaaaaaacaataagaaacactgttcactgcccattacatggatttcatgacccactaataggtggcgacttgtttgcaaaacactggcttatcccatgggattggattaaacttgacaaggaattctgctctgccttgcattcttctctaaaatccataaaaaggtttttttttctatttattaatttacataatattcaaagagaatccttataacagttctgaactgggttttatattaggtttcacagataacaagtggcaaaactcatcgccataaccagtcttggcatttcaaatcgacggctatttccatcttatcatgctgcaatctatcatctgatttttccctgcctagactccccaccttggctggaagtacccaaaaagctaggaatgtaccttagccatgctaggtacccaggaggcacttaatgaatatatgataaacagaatggaataacactcttggtcaaaagccatgtcttggcttggcatgttttgggacatctttgttccaaaaccttatataattctctctctctcttttttattatactttaagttctagggtacatgtgcacaacatgcaggtttgttacatatgtatacatgtaccatgttggcttgctgcacccaccaactcgtcatttacattaggtatttctcccaatgctatccctccccccacccccctaccccatggcaggccccggtttgtgatgttccccgccctgtgtccatgtgttctcattgttcaactcccacctatgagtgagaacatgtggcgtttggttttctgtccttgtgatactttgcttagaatgatgaaaaccttatgtaattcttaataatcatactttcttcatactctatgcgccattcattaatgggttggcactggaaacatttcccaagcttatagggaattcttcaatgaacatagaggagctactgagagctaaacactctttggttcctgcctgtgattgagtttttcccagaactcaaagagagaatttcagaaaggccaataaaagcccccaacaggagagtttttgtttttgctagttttcccaaacagctggcttccctaaggctgtaatttgtaagcctggtttctaccagactctaaatccataatcaatgataagctatcaagcatatgccctaatttatattactttgggccttttctagccaaaaccaacatccctggggaaataccaaaatacatctgtcctaaggtagataccttatgtctggggaggtagggggtggacagctaagacttggtattgaacaggactgagtaatcgtctaatgaatgaatgagtgtatggataatcaaagtgcaaatgcctgctatacatatgtaggtattcagaatattttatatgcatttatatgaggctcttttccctgatgacctaggaagggaaaagacggcaataacatagtcttgtgggtacttggggaagaaaagtcaggtggagagagagaaactgaggggagcaaacagaaggtaaggagagaagaataaaagaatgagagggaaacatctggccggaaaagcaggaaggccagcagctctgaatgcagatcacaatctttgttagtcatctttatcttactggttactttgctactcaaagtacacatttcctatggtggaaactcccttgtttacttattcttcctgacccaggtttaaaaggcctgcctaaccatctcagtaggcttttcctagctgatatccttctgagctgtggtagagaaaggggaagcagtgccctcatggctcctggatttacagttcctgaggaagaactgacaaatagaggaagacttccctaatatcaaatgaagcagaaccttctgggcagaaggaaaacaggtgatgttgcaatgacagggctcacctttccacctcgtgtttgatgagggtttgagaaaagagccacattctttccaaaagtcaggtcagaagcctttccacactttggtttcccaattcagcacccgtaatgtcaaataaaacgaaggcccttgccccaagtgaagtcatcagcaaatatctctttgctttccgggggactgtgttctctcacaacatcttttggaattatcacttcatactgaaacaagggtttgatcttttcatgagatgtatggtgatgaaattaaggccaggggctctggggacagaagagaaggctggcgccactcgtatgccctggagaaacagtgagatgaagagcacagcctctagagccagagtgtctggatctaaaattggctctgccaacaagcatgtaagtcacatagcttttatatgtttcatatgaaaatggaataaaagtcttatctataggaataaataagtcaatagaagtgacgcacttaaaacagtgtctgcgtatagtaggcattcagtgaggtgctggctattactggggtgtgagaacagaaacagtcatttgctcaatcccaagtttattttggtactttgtttctttcttgtaataaggaccagtagtttcaagaatcctagaacgttagaactgaaaggaacgttcattttatggctatgtaaggctcagagagagtggagccctccaaggtcacgcagctacctggtggcagtttcaagaccaaacaccaggcttcccattttctggaccactctccactctaccaccctccttccttggaggacgatgtccaggaccaagataatgctgttagggcaatgataacaactggaactgtagtagcccctccaacggctcccttgtcactacaaagacaatcttaagcgggttcattcattcattcattcactcagcactgctttttaagctattctcaaacagtacagaaaagcgaaacacagttctcattcttaaagagcttctattgaaattagagcaataagatatgaagataaaattatacaatagtacaatcacttacattatacaatatttatataattatattttataaatataaatatattttatatttataaattatacaataatacaatcatttatgttaagtgtctaagtattagacagcttacatatattctatctaatcagttgctagtaaaagagtttacattaaggttaataacattatgaattcctaaaataaatgaaaccaagcaagcaaggaaaaagatgtgcaaagcagtttggaggtttaataagacaaaaaaagacacctggctagaaggatcaggaaagtcttcatgcagtaagagtaagtggcattagatgtgggccctgaaacatgaataggtaacagaattagaatgtgaccttttcctctctcctccatgaataattactttctaaatataaatatacgcaaatgtatacatatactcgtacaaagaaatgaaatacaattctacataaattttctatggaatttcaaagacaagtaaaacataaatgaatccaaaaggcaagaacttccagcacttccaccctattctgtgcaaggcaattgaagaataagagggcttgttttaagaattatcatcacatatgaacttctagttcatctgtaacagtggttcccaacctttttgacaccagggactggttttgtggaagacagtttttccacggatggggatcgggagtgagatgggactggggtgtgggggtgatagtttcaagatgaaactgttccaccttagatcatcaggcattagattctcataaggagtgcacaacctagacccctagcatgaacagttcacaacagggttcatgctcctatgagaatgtaatccgctgctggtctggcagggggcagagttcaggccataatgctggcttgcctgccacttacctcctgctatgtggcctggaacctaacagaccagagagtggtactcgtctgtggcctgggcttggggacccctgatctataggatacaagacaagtcactcctcacaaggaagaaggatggtcatgatcagatttggagagacaagctgatagactggatttctactgccaccatgcctgtgtatcagtggaggtcttaagtaaattattggataatactgcaggaggacagtcagagccactgcaggactccaggctagatagggaagtgggggtaaaaatacagagaaggacatttgttctataatgcagactgttttccaaagcagctacactatcttacattcccatcagcaatgaagcagggttccagcttctccacatccacattatctgtcttttcaattacggtcattccagtgaatatgaattaatatctcattgtggtttcaatttgtattttcctgatggttaatgatgtcaagcatctttttgagtgcttataggcaatttgtaaatcttctttgagaaatatctgttcgtgtcctttgtccagttttaaactgggttgtcatttcatccttgagttgtaataattttttattacggctacaagtcctttaccagatatatgatttgcaaatattttcttccatcctttggtttgtcctcttactttctttatcttatgttttgaagcacaaatgttttataattttgatgaagtcctatttatgtcgtttttccttttgtcacttatgcttttattgtcatttttaggaaaccactaagaaaccaaggttacacagatttacttctatatttttttctaaaagctttatagttttaacttttacatgaaggtctatgatccattttgagtatttttttttggcatggtgtgagaaagtggtccaactttactttaaaaaaataaactttactttttagaaattttagatttacagaaaaaattgagaagatagtacaaagatttcccatatatgctacgtttcccctattagtgtggtatatttgttacaactaatgaaccaacagtgataaattattattaactgaagtccataatttattcagatttttctaagttttatataatctgcttttttttttttgttctgggatctcatcatggataccacactacatttggtcatcatgtctccctaggcttctttggctgtgacagtttctctggcttttcttgcttttaatgacctcaacagtattgaggagtagtggtaggacatcataaagtgtccttctgttgggatttaactgatgtttttattatgattagagtagggatatatgcctttagactgggctagggatatgtgttttgcaaatattgtttcccagtctgtgaatggttcttcatcctcttaaaaggtcttttgcaaagaagaaacttttaattttaatgaagttcaacctatcattttcttctatattttcttttggaagtttcatagttttgtgttttacatttatgtctaatccatattgagttaattttttaaaaatgtttaaggtttatgtcttgttttattttatttttttaagatgaattctctttctgctgcccaggctggagtgcagtggcatgatcttggctcactgcaacctccatctcttgggttcaagagattctcctgcctcagcctcccaagtagctgggattataggcactcaccaccacccctagctaatttttgtatttttagtagagacagggtttcaccatgttggccaggctggtcttgaactcctgatctcaagtgatctgcccacctcagcctcccaaactgctgaggttacagcatgagccactgctcgcagcctatgtcttgttttacatttttacatgtagacttccaattgttcctgcacatttgttgaaaggatgattctttctccatggaattgcctttgcttctttgtcacagaagacttgactatttgtgtgggtttatttctaggctctgtatgccattccagtgatttatgtgtctattctttctcgagtaccacactgttttaattgctgtagcatcatagtaagtcttgaagctgggaaatttcagtcctttgactttattcttctttaatattgtgtttggtattcagggtcttttgctttttcgtataaactttagagtcagtttgttggtacccataatgtagcttgctgtgatttttattgggttaatattgaatctataaatcaatttatgaaaaactgacaatattaagtctgccaatccataattatggactatgtctgcattcatttagatccttgattttttttaatcagaatgttgaagttttttgcatggtgaccctatacgtattttgttagatttatttcatttttcagtgttattataaatagcattttatcagtatataaaaaaagcatcaacttttgtatatcagtcatgtaatctgcaaacttgatataatcactttttagttccaggaaattgttttggtgattatttgggatcttctacatggataatcatatcatctgtgcatgcagataggttttttagctaggacttccagtacaacattgagtaggaatagtgagagacattcttgctgtgtatacaattttatgggaaaaaaattcagtttttcagtatgatgttaacatttttttttctttcttttggtagctgttctttttcaagttgagaaagttcatctttatttttattttgttgagagttt

SEQ ID NO: 420 - DNA, 20001 bp, Homo sapiens
ttctgaaatgtcactgtaatctcatttcaatatgaggaaatccgtacagtgtctcagaggcgcctgttctccatcacaaggagacgactcacaagagatcaggaatgcattttctctaattgattttccttctagatgtgcatgccagttctgtcactttctagttctgaccatgaacaagttatttggcctccttaaggcttagttttcacatctttaaaatggagaaataagttttacttgaatggctctttcaaaggtcaaataaaatatttaatgaaaataaaaagcttaatggagtgactgacacatagaaaggactcagtaattattagctagtaatagttatatcttatacatggtgtttatacctaagacagtgcaaaagcttcatgtttcagaatcagctacaaatccaaattgtacctttctcctgagaccgtaagttattctgtcttgttacccattgctgtcacagagcgtggttcctagaaacaactggaagccatctgcagtgagtttgggcaacctcatggttgtgttgagtgatctgatcccacagctcaggcatctgacagctgcagtattcgtgcctcacttttctgcctgactcttgctcttggtgaaagcagttactgcaccaccactctctggactttttccgctgcatcgtccttttgtcttttcaatatggaactgagattctgtgaacaacagggccattttacagcctataggctgcactctgcttgggggactgagcattctgaggcaggttcctgccctcatcccgttctggtcccatatcatgattgttccagtgaagaaggtgttgggaggtgccccataaaccttccatatttagggtcttctgagctggcagcccactgaagacaaacatggccatgtgtcgatggttgtggaaagaggatgcatattgtccaattgactgccaccagcatggagcatggcatgctggcagaagcacaagatccagaagaggatagaaggatcccaggtctgggggaaactaaactgtttcatcctttgctaagggctggggcccatcaggatgctctgggctgtgaagtcagggcaggagaacaagactgtggaggaaaatgtagtcagaaaagacagtctcagcccacttctcatctgtttcattcaagcctgaatcatgcctcatctctcctcatgctcagcagataacgttggatcaactgtatgttcatttaagtctcctcagcgttcttccttctgatccacccatatttttaccatcatctcctaccaacctacaggcagcctccctgactaacatggatctctgttctgttctgtgcaatttttattaatccatctttgttcttcacatctttgtactacccttttcttccagtatggtcagtgtcttcaccatctctgccatcgaagtttaattcctatctctccctggggatcccctctccagggactgctatcccagtctgcctctcaaaattaaattctaaagaccccacaaaatttttgaggatttttccaattgtcctaaaaggttataatcttaccttacagggaatttccacagaaccactcacattacattcacatttgtaatacatttatctgcattactagactggaacttcctgaggtcagacactggggcttaattatttttgcatctctagtactgcaaagggtaggttgaacacatattggtatttgaataacaaagaggaacatttatatgacgatggtatatggaaggaggacatgaagagccgctcagcaccactagtttattaggaaaatgcaaattaaaaccacaatgagatacccactaaaatagctgaaatgaaaaaactctgacactagtgctagcacttttgcagagcacctgggactcttgtgaattgctggcagaaatgcaaaatcacacagccattttgtcaaacagtatgacagtttcttaagaagttaacatacacttactgtatgacccagcaatttgtctcctagatatttacctaagagaaatgaaaacttacgtttatcaaaaactaactaaacaaaaaatctcccattcctgttacagtggcttcatccataattttcaaaaattagaaacaaccccgacatctttcaactgcagaactgataaacaagctgtaccaagtccatgcaatggaatactattcagcaataaagaaaacgaactactaacatgaataacagctggatgaatctcaaatgcttgaggctgagtgaaagaagtacactcaaatagtttcatatcacataattctatttagatgacattctgcaaaaggcaaaaatgataggaaggaaaacagatcagaggcttccaggggttgaagaaggggtacattttgggggtttgatattaatgttttgtatcttgatatcaatgacggtaaaatgtttctatattttctaaaattcataaaactgcatacctaaaatgattttgtctgtatgtaataatatactttatatccaataaaatataatggaaagaaagtggaaatagtgaaacctctttcttatcatcaatgggccctagagaatcagcaacctatccctagctggctcccacaaactcactactttacccccagaagtcactgagatggtgaggctaggatgtgactatcacaatctgttcctgggtccaaagttgaaggtagtaatgacttaaagtgtttgataaatggggagaaaataaaagtgagtagtccagagttatcaaataatttatgtccagaacatgaactcaaacatttgactgacataaattttattgagttttctttacattaatccaactcagtaggccaatggatagaattcaataaaaataatgtctgtcaaaaggctgacattatttaattttaaaacagagttaatcagtctttactttgggctctcctagcccccgtgtataccccttgattgcagtatttattaaaatgtattttaattatgtttatatcccagtcttccccaccaggactttgggttccttagggtcagggattttaagttactgatatttgcactccaggtgcatcacaaagcaagtgctcaatacattttttgttgttgttgaaaaaatgaaaggatgaatgagggctcatggtttccactactacatatgtgacatgcccatctccccattctatcttctgcttctccataatttgcccactgccacacatctctaaattctgcagaccacccccaagctgtccttcctgtctcatagctgcagcaaaagccctcttaacgcccactctggttcctgctcctcttacaattctgtacccagacatagacatctcactgaaacattaaacagatcataccgtgctcaggcttaaatctgccagtggtttccaattaggcatagaacaaaaatcagattccttagttaagctttggaagccctacagttcctgaccctttctatctctgtgaccttgtgtctcactatctgtcttggccaatatgctgcttaccactgaatttccttcagggtctcacacatgcttggttgagtcagcctcatagcttttgtgtgagcagctccctgacctagaatgtattttgttctgctcttcatattgctggtttcttctcagcatgagatcatggccacaacatccacttttccaagaggcctttcctgacacaatctaacctcactctctaacacactacctcatttaacttctctgtataactctcattccaatgggatatatatgttattcattgtgtatttgacaataattctgtcttcccttttggataatatgctctaagacagcaggaactctgtcttaactctggtctcctcatcaccaacacagagtaaatgtttaatgaacacttgttaagagatgaacagatggatgggtagatggatgaatggacagatggatagatggttggatggatggatggatggatggatggattaatggatggatggatggatagatggatggagggatggagggatggagggatggatggatgaatgtaatggacaggtggaaaggaatgaatggcatctttcacggaaggataggaacagctattattttctaacaaacagaaaacccaaatgaccttatccatagacatttcttctactctgtgttacactgaaatgtgttgcagaccacctcactgatgcctgtctttatctgatgtgcattatttacattaatagaagaggaagcagggaatcagacactgacttcagcagggtggataaggaaattggaaaaaaatagtagggaaaaagaaatgtggggatgttacatactttataattattacagctattccagatctgtacaactccccattccctcttagatggcaattggaggcacctgattttcttctatcctcctaaggtgaatgctcactcttttcccctcagcctgttcaggccacagcatctatgtagcttgtagacaaggagatactgacttttacctcattaactctgtctgggaagcccaaagtcatggttagacctggcacaaaacaatagccgaaaaatcagggtcatctcctttccaaatggcaatctgctttactgaggccaccagaatgtaatatagtctctttgcctctgccctgtacaaagatatgaatctgggtattttgttataacttgaaaatcaaggcagacgattaaaaaaattactctcagcaattcagttgaataaaggctttaatatctaaaatgaactacaggtgtaccctggcaattttaacactgagatttctccaaaaccaaagtcagatggagcaggtgaccaggtgccagagtttttcagacagcaatttctggagccagattccctgagatcaaaccttaccaactaaaattgggcaagtcacttactattttcatttctcagttttcttattatgcagtttgtgctggtgtggtaagaatttcatgagcaaatgcatgcaaagcactttgcacagtgactgccacatagtaggtactgagtacctggtgtatctactcaaagtcattataattaagtgagtgaatagcttcagattttctttactctactctgaaataacaccagtcctaagtcactctttgaagcatcaattgctgaagattataatagttgatttccttcagtgataattccacattgcttttgtgctgttctttttccagagccttgggatggcaaggtatgggtaagatgggaacattttgccacatccattggcagctggagtgaaattccagcaggcactccaaatccatagctggtaagaatccagctgcagagcgctgcaggaagtaaacaagttccatccactccaacttccctctgttctacatctggggattcacagccacccccagacttcagaacaccctcatcctacacagtgggtcaactgacagaaaaaaacactgctatgaaggataatgtgtttgctgcagacaaaaatgattgaggccaaggaaacaactttttcatggtagctccagaaatttaattttaaagagcccttgagagaagccagtgtcttcctcaagagaaaagatggcaaattgtatcattttgattcacacccatgaatgatgtttctgcagctgtttgaattaagactgaaatacaagcaatctcagtaggagtctgtattttcataaaacaatttcctgctgagttagttcagccagctctaccccagacctttcacacacctcggtgatgaggacatttacaagatagggttatttttgcttattaaagagctcacggagttttgtaatatccaactcttctcaaggcgaaggaacatctctggatctccccacacacatatctgaaataaaatagagttctaacctgtcctagttgccactggaaaactctgtaggaactgcacaccaaagaacacagtcctagccccaccagaatgagatttctcatctaactcctgctttctttctttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcctaactcctgctttctaaacctcttgagttgaagctcctcaactcaaaacctggctgtccccaaccccggagtcaatcccaggtgaatgcttggtccacctgtacccactgagctgtcacatttccctacattcccagtagatgggcagcaaatgcatgaggcttttcctaaagcaactgttatgccctcaagggtcctcaatttcagacccctttgctcagttcctgacttcctgacacagtcttatgacttctttactggaaccagaatgctgtgtcctgacattttgcttttactggagaggaagtagaattctttattcttctacactcctctatgtagtgggagcacgctgggagggctgtgagaatgagggaggtgcatgttatatcttctccttcacatatactctcacattctgtattagtcagaaatatccttagaggttataacaggaaacctaatttacagccattcaacaagaaaaattccatctatttggagtttttttacagcatgtaacagcaatggaggtaagttgttgctggatttgattgagcagctccaacatggaaagactgagactgttctgattcttttggccttttcctcatggttgcaagacggctgctgaagcttcagccattatgtctgagaccaaagtaagacagaaaggaaaaagtgtttttcagaccttttgtccccataccagaaaagcaaacacttagatctaatctatcaacaaataacatcaatttacctcttcttggccagaattgggtcacatggccacccttagctagaaagaaagatgtaaaagggtgaaaataattgttgtgatggtcttagagcagggcttctcaacctcagcattatcatttggggatgaataattctttgttgtggagagctggcctgcgcacggtaggttatttaggaatgctcctggactctacctaccagatgctcacagctattttctcctccaggtgtaacaaccaaaaacgtctccaggcattgccaaatatccactggggaatgaaatcgtctgtggttgagaacgactagcttaggccaatcatgactcattgtctggtttaagatgcatggctaccctgaagaaaagtagggtatcaagaaggaagaataagaaaatatgtgcaaggtaaataatcgtgtcatgcctcagacacacagcctagacatgcatgtcatacctacacagtacacacccgcattcatgagcacttgtttggcgcttggagtcatggcataagcaaatgttcactggtgtggagaaagctcttttctcttcagactcctttccctatgtatttacatgtaaaatgtaattgctttggttaaatgcaattaaattcaaatcaattaaatcctttacatatttactgccataaaccaaaagtttagcttgagttaagcctgaatgtccagaaagcggagccaaagaaggaaatgtctccaaatcaagagatgcaggagctggagtgaaggataatgaagaatcaaacaaaacctcagaaaactaaggtatgtaagaaccagaaaaaagctaaatagtaaacacctatggtgtgctatgatgaacacttatgaaaatggaaaagaagttgttaacagcaaaaccagactcctctaggcaaggacaacttatttagtgtggcccaaagcaacctacaccatactgatcttcatgagtaacaagggaaaacttttatgttctgccccaaataacatctagggctaagcattcaacatcacccctgactgtaggtactaagtggcataggaagaaagaggctatcgctattatggggtcagagaagaacgaacttccttagagctcatcattaacttaggtctgtacagtagtaaataggaacataaattgctataggtaggaaaacactttgtacccctaattctgggagataagccttttcagacacagagactgagaattctttgaagtaagactgaaatctgatatcagaatgttattgtccccatggatgagatacattaagaagcagaggatcaaaagattattcacaacaaggaaataagaaaagtaaatttggtcagattagaggagaaatgtttatactcgccattcctagccaagactttctccaatccctggtgataaacttgggggtaaacaccttaacggcattataattacgtgtgtgtgtgtgtgtgtgtgtgtgtgtgtgtgtgtaattacttcaagtttgttggtataagcagtgcatttgtgtgtatatgtgtatttaactatcaaagcatttatcacattctgttttgatgtttaagttacccacctgtctcccctgctagactgcaacctctgtaagggtagggctgatgaacactatgtgtgttaaataattaaatcccttttaaattcgtgtatgtatcaaaaacatatttaatacatacttactaggcaccaaataccatgatgggtgctggggacacaatgctgaaagagggaaaacacacttagacacacacacaaacaaaatagacaatgatctttgtcttcacagagagattttagtcaatgtcaggcaacataacatttcaattgtgaaagtctatgacttggtaattggtaatttgacctaaatgagaagtgaaaactccagatgatgaagagaggtgagcctcctgtgtgctaactgggggtgagggtgagataatcagtcatccagtaacagtctatgaggcagtgaggcaaagaaaggtggaaggatggagagaggcagtgttgagcctggaatggacctttccacagggattcttcccactggtaaagtatatcccagtgaatcttaagctataaccaatcataaggtgtagaaaaaaaaaggcaccatgtgtcattccctacattcccttctgtgaggaggcacagttttatgtgaaaccaacatttacaaagactccaaggaagacagtatagacttacagcatctgagcacttaaattggacagtgcagtgcagccactatctcctgcacacatgttagggtgaggtctttgttgtacgaaacaacagagataataaaatggaagagcagaagtggccattctaattcaaagatggcagtaacatgtagtattgaaaataatagattctaggccaggagcagtggcccatgcctgtagtcctagctacttgggaggccaaaatgggaggatcacttgagttcaggactttgagaccagcacagccagtttagtgaaatccagtttctccaaaaagtaaataaaaaattagctgggtgtggtggtgagtctgtagtcctaactacttgagaggctgaggtgggagggtcacttaagcccaagaattttgaggttacagtgagctgtgaatgcaccactgcactccagcccaggtgagaaaatgagaccctgccccaataaaaagaaaaaaagggaaaagaacaaattctgcaggcagactacctggactcaaaccctggttctcccctctactatgtgtataacagtaggcaaattacttaaacttactgagcctcagttttctcatctgtgaaatggcctaacaacagtacctactccatagggttgttgtaattactagatgagtcaatagaagaacttaaaggagtgactggcactcgggaaatggtataaatgtctgttgaataaactaatatcagttttaggtccatgtgcatgcacatgtgtgtgtacatgtgtgtaaggacctgtgtgcatgcacatgcatatacatgtgtgtatggacctgtgtgcctgcatgcataagtgtatgtacatgtgtgtatgaacctgtgtgcgtgcatgtgtgtatggacatgtgtgcgtgcatgtgtgtgtggacatgtgtgtatggacttctgtgtatgcatgcacatgtgtatgtacatgtgtgatgaacctatgtgcatgcacatgtgtgtacatatgtgtatggacatgtgtgtattcatgcacacatgcagttgggtgaggaggagcctcagttggtctgaaggggttccagcatattctactcttgggaatatttcctgctgggtttcaggaggaaatattcaagttctgtacactaaattgaggactggctcacctaaagcaagcaaaaactaaagagaggtggatgctaaaagagcttcctccctaagatacagagcagttttcactcgcagccttgacctcggtggttttgtcacctaaaaccattctagtttcaagactcaagctacaatgcttttgagaaatgatctaataaaagaattaatagaactgtggcagaagtgagccctccaaaactggtcctatagaagcttctgtcttagatgttttctggggccagacaccggatgccctctttctccaggcatctcaaaaatagccatggtatggacaaccagcaacatgatgtcatacccataacaaaactggaattctttggatacatagctggagttttctccttctgccctacaaatgaaggctaggggtcttagaagcctccagaacaccattatttttcttctccattagactaagaagcaggcatcattcatttattataatggtgttcttcccacattgttactggcacattctgtgctttacaacaacaagaaatgaaacgtcccctgagaagcctcaggttacatttatttggctttcctttaataaaaaaaaaaaaggagtaaagccaggaatgaaagggagctgagagctgatgtactttcctgactgagttcaaggaggcagtctgtggtgaggccagagatgaacagggctggccactagcaggaaaacataagtgacggcttctcccagtaaccatatgaaaatgggctgatctgttctgggactcaaagcctgtctccctcatttcacagaaaattcaggagttttccaatactcagagaaccttcagaactgtgtgggtttgatacgttttcctaacctgtttgagtgcacagttttggggaactttcaaaggccagggtatgactttggaataaaatctggtttaatttcaggagaacacatttaattctgatgatatctaggcctcaggaaatgaaggcagaatgagatctcccagatttgactggttgttcatgccagtttgtatcagtaaaagctagctcctcaaagcaaaccagaactcagattcctcggggtgggaaagtgcagacagtggactgttgtacccaggaagcatgcctgaggtgctgacagaaaagaagtttcaatacgtgaatcttcagcccttcaacatagttcactataatataggatgattccagaggtgagaggagtgagggtgatgacggcaataattatgcaaaaattcaaaacagaagagacttgtgtaccctgatgtctcacctgtccactcttcttgacagaatccctcatacctggcagcaccaggactgagctttgtaaactgaagactggctgggttatagtcaaatggtaaggcagaagcaaaataccccaattctgaaaggagaagacttcaacagccagtgatggagaatttaatcttgggtcaaagccacatgagggctgcaggaagacaagccgtgtaaacaagagggtctactttttgaaattgctaaatacagattctgtgcctgaatgcctctgatagtagatctcaaaaagagggcattctgaattcttgttagaacctctcactgacctagtccacagactgaagctggaatctagagaacaaagagaagattagtggatagcttagcttttgctgcataagagaccacccccaaacctctgtaactgtaagcgtttatatacctctcttgatttttctgagattcatgattccttgcctggaagattctgattgggcatggcttggctgaggctgggtggtctagaatggccttactcacacatctgatgattgacgcaaagagctgtggctactggaatgatttaactatgtatctttcatcacccaataggctggcttggcctcatttacatggtgctggtcacaaagttctcaagagtgtccagagaaggccagctcaatgtgtgcattcattttctgagcatcagcgtggctctcattgaccaaagcaagtcacataggcagtccagagacagtgtgggatggcactaccaaaggtcatggatagagagaagaaaataacacatggccacttttacaataagccacaagttttctcccttccacccattctgtttgctcctgatagaatctcctcctctgtccactcacagtgactggcctgaaatacagttactaaaaggaaatctccccaacatacatagtgaatactcagttttggtgtcaatagttaacaagattctctcgtttgtcaagggttggattaaattaggatggtcagcatgttcctaacactcactgtttaaacagaaagggcacactcccattcgagttaagtcacaggctcaacagtaagtgtattttccatggggtaattgctaaagccactgcttttccaagaagaatccttttggagtcttttgttcttttgattgaaacttaatcagcttcttgtttgacaaaaatgacaggctgcatgaaaggggaaacagagtttgggttttgccaatcctaattcctatcaaacatcacaagaaaataagcactttctacataatgttctccactttgtgttttagactcaaatttatcacttaaaaagaaaagaaaaaaaaacaccctaactgtttatattttgggggaaaaaaagaaaagcgatggttaactccttctttctggggtttttcatgttaaggattttttaaggatcaagactcttgactttacctttcagtttggtggggtagagatatagggaagcaaaagttcgccagatcacttccagatgatacgtcctgaaatctgtcttccttctgtcacagaggacctaccctgcagtcaaagtttattgtctcccaagtctcatccagacttccaattctgaccccaagccctcatgctgaatttcataaagagaacacacatttctaattctgttatgaggaaagcactagatttgcaattggaagcacattcatcttggccagagactcactagctgtgtgatcttggacagattaaattcattctctctgattctgtttctgcatccatattacttctctatttgaagggtggctgggaggtttaaattaaagaatgggcatcaatgtgcaaacctggggcccaaaacttagtaagggcttagcaaatgttaattttatcctatctgatttctttctttccatctctttccatattattctcattttcccattctaggaaaaaaaatgcaggctagcatattccctttgaatgaaaagagaaaaagccatgctgttaatctctgtgacagaaaatatggaagacactcaacagagagaggcagctttggccagttttatgcctttgccagtgcttagttgtggatagacatgtaactctgccccagccagagctagacatatgggggggaggcccatctttctacaatcccatgactagtaagtggcagagcctggatttgatccccaacagtccagtttcagaatccatgtgcttttctactaagctataattccttgctaatataaacccattcattcattcattcatttatgcactcattgtccaaaaatattggctgggtgttgtggctcacacctgtaatcccagcactttgggagactgagggggggggcagatcatgaggtcaggagatcgagaccttcctggctaacatggtgaaacgtggtctctactaaaaatacaacaagttagccaggcgtggtggtaggcgcctgtagtcccagctactcaggaggctgaggcaggagaatggcatgaacctgggaggtggagcttgcagtgagctgagattgcaccactgcactccagtctgggtgacagagcgagactccatacaaaaaaaaaaaaaaaaacaacaccaactctgtagagcctatgaatgccaatcactatggtgaatgttgaatctgagcaaagctgctagggaatcccacacaggaaggcagtgaattttgtctgagggagaaaggcacaagtggactcaagtctcagattcattatttacacgtgtgatgttctgcatgttagttgaactcagtgaattgcagtctctactgtttttgtatagggtggattcgtttgggtactgaagcaaagtgaaaacagctaacccaaagcctacaatgtggtagttacccgagaaatgttctttaagagaattcataaaaaaaaggaagaacactgtacagggatatttttaaaggatcttcagggagacagagctcaggtggagaagagaagcaaggagaggacatgggtaacaaataatagggccagaaataaccatcttggatgtaggagccagggacaaacaggcctgagaagcactgtctggcctttcagagccccgcagctgaatcctgaccctaacacatatgaaaatggggccttggccaagttgctaaactgagaacctcaatttccacatctacatcagagaggtgaggatgtccccctcccacaaggtgtggaggttacatgaggtcactcatgcaagtgccatgttgttgatgctgcgtggtgattgataattactcaataagtaattgtggctcacatgtttatgacagcaagaaggatgatgaatgttgcagggtggtggggggatggacaggtcacactttgtagggctttagggttgccatcagggtccagacaacatttattgtccagtccattgataatcctgattttctcctggcttcaactaagtattttggactctaagtcaagggtcaaaccaccagtgtctccacctccatgtgtgtctctgatttgacaggctctaatgccagggctgcccttaaaaataatcctttttgtcatacacacagaaaaccatgcttttccaggttgaaagtggatcccatctcacaaaagtccagctcagattgagaatttagagccataaatgctaaggaggtacaatgctcagaaaagtacattagtacttcttccgcagatgccccttagaaagtcttacatccagagtttggcttccaggtaaatcatttctgaatcaaggctggcctgacattttcaagcacagccagttgcacttgcctctacactccaccttccattctgacacttttcagtaatgctgttaattgcttatggatgtatctccccaaacagactgtgagttcttcaagggcagtgcctctatttaattcacctgtgaattttaatcctgtggagtcaactttctgtagataatgcctgaacaaaaaaattaagaaatataaacaatcagccccagagccttgctgttgggagaggttggactctctggggcagctttgccccaggatatagttccaggaggtgggttcccaggcggaagggagaaatacaaatgtacaagcagatgacagcccgtgagctggatatgtcccggaaataaaaactggacaagtcataaagtttcaggccaacaccaaaggaagaaatgctgggtctttacatagaactgtcctctaaccccctagtgactagcaattatttcctcctgccctgctggctcccctacaaagcaaggggcgtccagtgaggagttctgagcccagcataagcaaagcaccaaacacggagtgtgtgaccctaggagacgcagggaatctcctcctgcatctctgtctgtgactgtgttgtaagagatgaggacgggagaaacaacgggagaaaactgtgacaggagaatttgggattctagcagaaactaacaccagaatcttgggcaaaggacacagaattctaagagagaagtttgatcatgtaccaaatagtcagagacatatttgcttctatgagagatctcgttcccttaagtgaaatgccagaccctaaaatttctagttatccttaaaagagtggacacacaagaaaaggaaggagggagggagggaaggagggggtgaggaagggagggagggagagtgaggaaaggagggagggagggaggaaggaaggaaggaaggaaagaaggagaaagagaaaggaagaaaagggagaaagatgaaaagaaatgagtgagaaaagaaaggaagaaagaaaggtgaatttccatcaagtaagacccagagaaaagaaagaaatgacggcagctgaaccacttttctctttcctttttaatctgactttagatgttctcctggtaaaatcattacaaaggccgtttatttttaaaattgaaagattgggaagagtcataatgagatactatgtgtaaaagttgcacataaatttcctcttgtcatattttgggcttcactaacgcatccccttgacaggacgaagggaagttgatcgctttagtatagattgtgcgcgcctcagaaatattgccctaggagagagctcctgggtggctgacttggctccatgctgatttagaaattagccgggcttttattggccacactaaattgttctcaggaaaaaaaaatacatttttattacagaacaaggggcagatgattgaaacaagcctgccttctccttcatttggagctgtgttttagactgttaagttgactttcttctctggggttctcgctgctgtttaatgggggcatacaatatctaccattaaagaaattaccttgtttctctcagtgtccccagggaattccttattccttaataaagttctgtttgagttctcctgagtgcatgagtgggcaggttgaggaaaacggagactctctatataatattcctattgcaagggtttagaggaaggggagaccaggagccgtccttaaagaagggattcagagcgactgtgagtctggccactggccattgactccagatctaaggccagaggtaacactacagaaatgcacaccccaatcctgtattgagtgaagcccacggcagggccgtgcaatgaacttgcatgtgaggccaaacctgtcaaaagccacttggaccaaagggaatcattcatttgtagagaatgcccaaacccactcatatccaattctgttctcttgaagtccagcctgactcctgtctccgactctgctttgacaggcggccttaggctcttcctcagttctaaacagggcattgatagattcccatggaactgctcactactgccctccacaaaactgcctgcctgatttcagacagcctcttgcttagaatctgttctaggtacagaacccctagcccttctccaggagaaatattatgtccatatggatgggagcagctagaggatttctggaaactttctaaagattagtttcacttcttgaaagctaaaaggcaaacatataattgtatccaaagtaaattactagagtaacacagagcaactggggtatttgaggaaggaattgttcggccaactgaaccatttcattaacccttcaaatgtgatccttgattttattttcttaaatacttataaaatgtaagcaccttcctgcattaatatgcaatatgatggagcccttaagatcttggactcaaggtaagtcagaattgaataggacacgtttgctgtcattttccaaatataggtccttgggcaaatcacatccagtttttctgatgcggttttctcatctataaaatggggatcatcacagccctgctagtgagaactttatatatgttgagtttatatatgataattttatatatgttgaatttatttaatatgtgaaatatgttaaataagtatatttaatttaaatatatttaaattacttattaaacagtaagtaccacacctggtataacatacaaactcattaaacattagctgttgacattgctcaccatcagctcagcgctccttagctgaaaggtagatttatttcccccacaagctaaattctacaatagagccaagtctcacaaaacgttagtggttcagctgagacagaaaacataacttttgattacttatcctcctccactaaacttcagaccacactgcctcctattaaaattaatttctgttcccttcaggtggagatttaaatttgtcatgcctccctaagccactggacccatagccctatccctgatttttccttagggaagccaggactacttgaggtaattaatccaccacaggctcccctaccacaactgggaaagaaacaccaaattctacttggtttcttactaattaggaacagagagagggagagagggagagagactaaggacgggaaagggctgagctaagtggggtgtggtccacatgtgttcccaatcatgaccacacaatgaaaatgttttctttctggggcaatcaggcaaaatcttggaaagatgaacttttttccccgcttctttatgtacaataataacaatatcccaaattcaaaactttttttttaatcttggcacaattttgcttctaaaacatttggaaaacatccaagcactgatggcctatgcctgacccttttctctgaggtccaagccacttattctataataataataagcgaacacatagatgatgcattctatgtgccagactctgttctaagtgctttacaatacattgactaaaattcaatctccttcaaaaaccctacaacttaacactatgttcatccccattgaacagatgaggaaactgaagcaaaatagatttagcaacttctccaaagttaatcagctagtacagggcagaggcaggatttgcactcaggctgtctgaactctagatttatgctcatcattatcagctcatacttctatcatgtacctccatggcagaagggctaggggaaaagcagagggctggggctgcccaagagttgaagatcaggaggcacaaaaactaagaagagaactcccaagaaagttggagtactaataggcaatggggtaccagtccctcttttgagttgtggctctgcctttctggttctacatttactcagttcatgaaccaaacacctgtcaccattgcccttgttcactctgctctccccatgctcttcactttgattgacatgcaaactttattctcttacactcctgaccttgaattccatttctagcctgagtgtcccctaggccctgaccttcacacctccagacccagccaagtacccggattctggctcctaattgctccctttgcttaactgtctagttgaaagttcagaccctgaatcagcccttggctctgattaattgcagcctggggctcagcagcaggggtctgaatcccttcccagtcactggagtagccagacttgacctctgttggtggagcaatggaggatgccatgcctacttgttgaataagaaggctgctgtgaaacatactacatgagttggtgcatatgtcacagatgcaactctgccaacaggaagaccctcaggggctgactgccatctgctgaaaggcaagcagggatggatggatagatagatggatggtatctgacctctgattccttccagggttagatttttggagagtgatgttcaggag

SEQ ID NO: 421 - DNA, 40001 bp, Homo sapiens
ctgtagccttgtagtatagtttgaagtcaggtagtgtgatgcctccagctttgttcttttggcttaggattgtcttggtgatgcgggctcttttttggttccatatgaactttaaagtagtttttcccaattctgtgaagaaagtcattggtagcttgatgtggatggcattgaatctataaattaccttggacagtatggccattttcatgatattgattcttcctagccatgagcatggaatgttcttccatttgtttgtatcttcttttatttcattgagcagtgatttgtggttctccttgaagaggtccttcacgtcccttgtaagttggatacctaggtattttattctctttgaagcaattgtgaatgggagttcactcatgatttggctctctgtttgtctgttattggtgtataagaatgcttgtgatttttgaacattgattttgtatcctgaaactttgctgaagttgcttatcagcttaaggagattttgggctgagacaatggggttttctagatatgcaatcatgtcatctgcaaacagggacaatttgacttcgtcttttcctaattgaatacactttatttccttgtcctgcctaattgcccaggccagaacttccaacactatgttgagtaggagtggtgagagagggcatccctgtcttgtgccagttttcaaagggaatgcttccagtttttgcccattcaggatgatattggctgtgggtttgtcatagatagctcttattattttgagatacgtcccatcaatagcaaatttattaaaagtttttagcatgaagcgttgttgaatttttgtcaaaggccttttctgcatctattgagataatcatgtggtttttgtctttggttctgtttatgtgatggattacgtttattgatttgtgaatgttgaaccagccttgcattccagggatgaagccaacttgatcatggtggataagctttttgatgtgctgctggattcagtttgccagtgttttattgaggatttttgcagcaatgttcatcagggatattggtataaaattatcttttattgtagtgtctctgccagcctttggtatcaggatgatgctggcctcataaaatgagttagggaggattccctctttttctattgattggaataatttcagaaggaacggtaccagctcctctttgtacctctggtagaattcggctgtgaatctctctggtcctggactttttttggttggtaggctattaattattgcctcaatttcaaagcctgttattagtatattcagagattcaacttcttcctggtttagacttgggagggtgtatgtgtccaggaatttatccatttcttctacattttctagtttatttgcatagaggtgtttctagtattctctgatggtagtttgtatttctgtgggattggtggtgatagcccccctttatcattttttattgcatctatttgattcttctctctttttttctttatttgtcgcaatgctagtggtctatcaattttgttaatcttttcaaaaaaccagctcctggatttattgatttcttgaagtgtttttttgtgtctctaactctttcagttcttctctgatcttagttatttcttgccttctgctagcttttgaatttgtttgctcttgcttctctagttactttaattgtgatgttagggtgttgattttagaccttccctgctttctcttgtgggcatttagtgctataaatttccctctatgcactgcttaaaatgtgtcccagagattctggtacgctgtgtctttgttctgattggtttcaaagaacatctttatttctgccttcattttgttatttacctagtagtcattcaggagcaggttgttcagtttccatgtagttgagcggttttgagtgagtttcttaatcttgaattctaatttggttgcactgtggtctgagagacagtttgttgtgatttctgttcttttacatttgctgaggagtactttacttccaattatgtggtcaattttagaataagtgcgatgtggtgctgagaagaatgtatattgttgatttgggtggagagttttgtagatgtctattaggtctgcttggtgcagagctgagttcaagtcctggatatccttgttaaccctctgtctcgttgacctgtctaatattgacagtggggtgttaaagtctcccattattattgtgtgggagtctaagtctctttgcaggtctctaaggacttgctttatgaatctgggtgctcccgtattgggtgcatatatatttaagatagttagctcttcttgttgaattgatccctttaccattatgtaatggccttgtctcttttgatctttgttggtttaaagtctgttttatcagagactagaattgtgacccctgctttttttttgctttccatttgcttagtagatcggcctccatccctttattttgagcctatgtgtgtctgtgcacatgagatgggtctcctgattatagcacactgatgggtcttaactctttatccaatttgccagtctgcatcttttaattggggcatttagcccatttacatttaaggttaatattgtgtgtgaatttgatcctgtcattatgatgttagctggttattttgcccattaattgatgcagtttcttcatagccttcatggtctgtacaatttggcatgtttttgcagtggctggtacagattgtttccttctacgtttagtgcttccttcagggcccttgtaagacaggcctggtggtgacaaaatctctcagcatttcttgtctgtaaaggattttatttctccttcacttatgaagcttagtttggctggatatgagattctggattgaaaattcttttctttaagaatgttgattattggctcccactctcttctggcttgcagggtttctgcctagagatctgctgttagtctgatgggcttccctttgtgggtaacctgacccttctctctgggtgcccttaacattttttccttcatttcaactttagtgaatctaacaatttgtgtcttggggttgctcttctcgaggagtgtctttgtgatgttctcgtatttcctgaatttgaatgttggcctgccttgctaggttgcagaaattctcctggataacatcctaaagagtgttttccaacttggttccattcttctcatcactttcaggtacaccaatcaaatgtagctttggttttttcacatagtcccgtatttcttggaggctttgttcatttctttttactcttttttctctaaccttgtcttttcactttatttcattaatttgatcttcaatcactgataccctttcttccacttgatgcattggctattgaagcttgtgcatgcatcacgaagttctcgtgccatggttttcagctccatcaggtcatttaaggtcttctctacactgtttattctggttagccattcatctgactttttcttatggtttttagcttccttgcaatgggttcaaacatcctcctttagctcggagaagtttgttattatagaccttctgaagcctacttctgtcaactcatcaaagtcattctctgtccagctttgttccattgctgccgaggagctgcgatcatttggaggagaagaggcactctggtttttagaattttaagcttttctgctctggtttctccccatctttgtggttttatctacctttggtctttgatgttggtgacctacagatggggttttggtgtagatgtcctttttgttgacgttgatgctattcctttctgtttgttagttttccttctaatagtcaggtccctcagctgcaggtctgttggagtttgctggaggtccattctagaccctgtttgcctgggtgtcaccagcagaggctgcagaatagcaaatattgctgcctgatccttcctctggaagcttcgtcccagaggggcacttggccatatgaggtgtctgtcggcccctactgggaagtgactcccagttaggctacacaggggtcagggacccacttgaggaggtagtctgtctgttctcagagctcaaacaccatgctgggagaaccactgctctcttcagagctgtcagacggggacgtttaggtctgcaggagttgtctgttgccttttgtttagatatgccctgcccacagtggtggtgactatagaggcctaggccttgctgagctgcgatgggctctgcctaatttgagcttcccagccactttgtttacctactgaagcctcagcaatgatggacacccctccccccgccaggctgccacctcgcatttcgatctcagactgctgcactagcagtgagcaaggctccgtgggtgtgggacccgccaagccaggcccgggagagaatctctttgtctgccagttgctaagaccttgggaaaagcacagtatttgggtgggagtgtcctgattttccaggtaccatctgtcacggcttcccttggctagtaaagggaaatcccccaaccccttgcccttcccaggtgaggcgacaccccaccctgcttccgctcaccctccatgggttgcacccactgtccaaccagtcccagtgagatgaaccaggtaccacagttggaaatgcagaaatcacccaatcttctgcattgatcacgctgggagctgcagaccagagctgttcctattcggccatcttggagccgcctcctccatgagtatttcttatcaacctgagccttatcttacatgatcatactacagttatcaactttgttaaatttaaccttgatcaaacatacttttatctattctatcatgagtattaaattttatcacttcacccaataatgttctttttcttttatgaaattcaaattttggaagaatacagccaaccttttctttgaactgaatagtcttcaattggggtttatctgagattttcttaagattagatataagttatgtattctcaatgggaatagcatgtagatgatgctgtgtccttctcaggatatcatatatggaggcacacaatgtctatccatgttatctttctctgtctcagtttctccatttgaataacataaacaataatttattccatagagggatagtgttggcatgatgcaggggcatgatttgggcagggaacccatccaagcaagacaaaggtgaaagcttttacaggctcacacttccagccccaggaccctgacccccacctacctttgaagatgttggagttggaggtgctgaaacctatttgactggtggctcttcttccttgcctctaggaaccatggagcccctgcacagtgagtaggtggtgagcaaaaccagtcaattatgcagatcttagtcatgcttctggttgtggcagatctgtaagttctgtcccaaaccataagttgggtacatatagaacattgtccctgaattcctattcaaggagtactttcttctttttgctgcaggcaatatagatagagacagaacactgtggacctgcagaatcctctgctcccctaacacacacacaagtctggctgattgtggacactcagacacaagtctgggtgattgtggagtggaaggaggatctacatatctattttttttctaacattgtgtgaggaccttcataaagtctcatccatctttatattaatttctccattgctagcatcagcctaacaccaccttatcagcaatctcttgtgacttttgtgaggaaaagagagatctcttccaagagggcttcgaaaatatcacataacatgtagattttaaatatatagacttaaactatactcaaatcctacatcccacttactctaggaaagtcactaatcatctctgtgcctcaatttcctcatttttaaagtgagaatagcagtactttcttcataggatttttgggaggattccatgagttattttgtgttaaacactgagacccaatgtctggcatataagcagtgctatgtatggtttgctaaataaaccaataaaacacttattgaagtgttcagaatcacccagttggacaccaaattcactatgagtcaaatatttaacatgtattaaccaatactctcagtgacccagtgagtttagtgctaaatatttatattttgccaatgcagaaactgaagcatcgaggagctaagcaacttgcccaaggccacacagccaataagtggtagaaacaagatttgaaaggaagtgaattcagagccaggtatgccagatggtgaagcccacagcttttcctgggcctcagagccacgatacatcttgggcttattcccatcaccaaggcactctctctagatacccttacagtgctagcagaggggcataatgggaagggaaatttcaggagctgagctgactgtgagaggctctgagtaagtcttgactgggtctaggaatattcccagagttgtttggttgggatgagaaagtgggaaagtgggagagaagcaaagcctgtagattgtcctaacattttcttctctagttctatttccttgcctcttcccactttacaatatactcttggccttgtcctattcctgggacccctcatcaatttatatcatttacttctctccgtaggaaaaaaaaaagaaaaagatttcttttcaagatgtcattttttgctcttgtactaataaaagagcaactcatgcttagtgcataaattttgtaaaaatatgaaaatgacaattaaatttaaaaataattgttaatcttgtcaacctatgctaacatttgtgcatatattctagtagactttttcttatgtacatatatatttttatatagtggataatcctgtgactatttttaagtttaacatttacaataaatattttcctgtactcctaaatattttcaaaaatttcatagattggtagattactctgccaattaatcaccagttgttgacaagcttggtggtttcagtttttccctattgtagaaattcactattagttacataatgataactaaatccttgagtatttatttatttattccttgggaaagccaataaaagtagaaatacagataattcaatctgtgcataaatattaccaattctctcttcataatgtttaggctatacttgcaccaacaaagaaatggtctgaaaatgtcagaccatttccttcatcttgaccctgatatagacattcagaggattcagatggtaggtcggaggagccagcaggctattgactattcacagttgtctagtgtcacaatcacaggccttacactcatccgatgtaaacttaaaacccatctttacagaggcagatactaaaaaattaaaattaaaattaaaaaaccatctttatcatttgctaactccatgaccttgggtaactcatttcacttctggaaaactccattaaatcacatggaaaaattatagcacaggcatacctcatagatattacagattcagttccaggccaccctaataaagtgagtcaaacaaatattttggtttctcagtgcatataaaagatatgtttacactatactgtgatctactaagtgtgtgacagcattatgtataaaaacagtgtacatatcttaatccaaaaatagtttattgatagacatcaataccaagagctctcaaaaccacacacttacatgtgcttgttagtacatgctcctgttcctgaatgactttttggtaaacaacaaaattaagacagaaatcaagaagttttttgaaactaataagaacaaagatacaacataccaaaatctctgggacacaattaaaccagtgttgagaggaaagtttatagcactaaatgcccacatcaaaaagttagaaatatctccaattaacctaacatcacacctagaggaacttgaaaaacaagagcaaaccaaccccaaagctagtagaagaaaagaaataaccaaaattagagctgaactgaacaaaatggagataagggaaaccatacaaaagatccatgaaaccaaaagttggttctttgtagaataaataagactggtagaccactagttagactactaaagaaagagaaaatccagataaacacaatcaaaaataacaaaggggatattaccactgaccccataaaaatacaaacaaaaatcagagactattacaaacaccactatgcacacaaactagaaaacctacacaaaattgataacctcttggaatcatacaaactcccaagattaaaccaggatgaaattgaacagaccaataacaagtaccaaaatttaatcagtaattaaaaaaaaacttaccaaccagaaaaggccctggaccagatggattcacagccaaattctaccagacatataaagaagagctggtgccaatcctactgaaattattccaaaaacttgaggaggagggactcctccctaattcattctatgaagtcagcatcattctgacatcaaaacctggcagagagacaacagaaaaagaaaacttcagaccaatatcactgatgaacatagatgcaaaaatcctaaacaaaatactagcaaaccaaatccagcagtatatcaaaaagctaatccaccacattgtttcctgttgggagctccctgcaatacccaccccccctcccccctgccccgcaaaaaaatgaattcaccacaatcaagtaggctttatccctgggaagcaagattgattcaacatatgcaaatcaatacatgtgattcatcacataaaccaaactttaaaaaaagatcatcttaatagatgcagaagaggcttttgataaaatttaacatcttttcatgttaaaaaccctcaacaaaccagacatcaaaggtacataccacaaaatagtaacagtcaactctgacaatcccacagccaacatcataatgaattgacaaaagctggaagcgttcctcttgagaagcggaacaagacaaggatgcccactcttgccactcctactcaatatagtattgaagtcctagccagagcaatcatgcatgagaaagaaataaaagtcatctaaataggaagagaggaagtcaaactatgtttgacagacaatattcacagacaatataagcctagaaaaccctgtagtctctgcccaaagcttctagatctgataaaccacttcagcaaaggttcaagatacaaaatcaatgtacaaaaatcagcatttctagcagcatttcaatcgtatgaaatgcatagaaatatgtccaagctgagagtcaaatcaagaatgcaatcccactcacaatagccacaataagaataaaatacctaggaatacagctaaacagggaggtgaaagagctttacaatgagaattataaaacactgtatcagagacaacacaaacaaacagaaaaacattctatgctcatggataggaagggtcaatattgttaaaatagtcatactgcccaaaacaatttacggattcaatgttattcctatatacaaactaccaacatttttcacagaatcagaaaaagccatttgaaaatgcatttggaagcaaaaagggcctggatagccaaaacaattctaagcaaaaagaccaaagctggaggcattatacttccagacttcaaactatactacaagcctacagtaaccaaaacagcatggtactggtacaaaatgagaatcattaacaaatgaaacagaatagagaacccagaaataaagctacacacctacaactgtctgatcttcaatgaagctgacaaaaacaatcaatgggaaaaggacttcctattcaataaatgctactggcataactggctaaccatatgcagaagaatgaaactggacccccactttttaccacatacaaaaatcaatacaagatggattaaagacttaaatgtaaaatctaaagctataaagaccctagaagaaaatctagaaaataccattctggacattggcccaggcaaagacttcatgataaaaactctacaagcaattgcaaccaaaacaaaaattgacaagtgggacctaattaaactaaagagcttctacactggaaaagaaactatcaacagagtaaaagacaacctacagaatgggaacaaatatttgcaaactatgcatccaacaaagatctaatatccagaatctataaagaacttaaatcaacaagcaaaaaacaaaaaaaaattttaatgggtaaaggacatgaacagacccttctcaaaagaagacataatgtggccaaaaagcatatgataaaaatgctcagtatcactaatcattagggaaatgcaattcaaaaccacaatgagatattatctcacaccagtcagaatggctggtgagggagaaaagggaatgcttgtgcagagctggtggtgtaaattatttcagccactgtgaaaagcagtctggagatttctcagagaacttaaaatagaactaccatttgacccagcaattccattactaagtatatatccaagagaatagaaattgttctaccataaagacatatgcctgcgtatgttcatcacagcactgttcacaatagcaaagacatggaatcaacctagggtgcccatcaatggtggactcgataaagaacatgtggtatgtatacaccatgaaatactacctatttttaaaaatgagatcatggcctttgcagcaacatggatggagctggaggccattatcctaagcaaattaagcaggaacagaaaaccaaataccacacattctcacataagtgtgagctaaccattgagtacacacgggcacaaagaagggaacactagacactgggacctattttagggtggaagttggtatgagagtcggattgaaaaactacctatcatggattatgcttattacctggatggcaaaattatctgtacaccaaactcccacaacacacaatttatccatctaacaaacctgcacatgtactccttgaacctaaaagttggcaaggcaaaaaaaaagaagaaaaatactttattgctcaaaatgttaacatcatctgaaccttcagcaagtcaaaatcttcttgttagtggaaggccttgcctcagtgttgatggctgctgactcatcagggtggtggctgctgaaagttagggtagctgcagaaatttcttaaaataagacaatgaagtttgccacattgattgattgcccttcacaaacaattgtgcagtagcatgcaatgttgtttgatagcattttgcccacagtagaacttctttcaaaattagagtcaatcctctcaaatcctctcataaggatttgataaagttgataaagttgataaagttgatagctttatcaactaagtttatgtgacattctaaatcatttgttgtcatttcaacaattcattttcttcctcagcatgcttactaggagaagtttccatctcaataaaccacattctttgctcatccattcaggttttatcatgagattccaggaattcaatcacatctttgggctcaactttagttctcttgttatttccaccacagctgaggttacttactccactgaggtcttacacccttaaaagtgattcatgagagttggaatcaatttctccaaaacttcttttagtgttgatattttgacctcctcctgccaatcatgaatgttcatctagaatggtgaattatttccagaaggttttcaacttactttgccaagatccatcagcgaaatcactatctatggcatctatggccttataaaatgtattttttaaacaataagacttgaaagtcaaaattgtcccttgctctaggagctgaagaatggatgttgtgttagcgagcatgaaaacaacactaatcttgtacatctccatcagagctcatgaatgaccaggcacattgtcaacgtgcagtaatattttgaaaggcaacttcttttctgagcagtaggtctcgaacacggatttaatataaatcatcatgtaaatagatgtgctatcatccaggcttggttgtttcatttatagagtgcaggcagaatatattttgtacaattctgaagggcctgcggattttcagaatggtagatgagcattggcttcaacttaaggtcaccagctgcaccagcccctaacaaaagagctgtcctgtgctctctagctatgaagtcctagatggcatcttcttccaacagaaggctgcttcctccacattgaacatctgttgtttagcgtagacaccttcatcgcttatcttaactagatcttctgggtaacttgctgcagtttctacatcattgcttgctgcttcaccttgctcttttattttatggggatggcttctttcttaacctcatgaaccaaccactgctaacttttcttctgcagcttcctcacctctcagcctcaatagaattgaagagggttatagtctttctctggattaggctttatcttaagagaatattgtggatggtttgacgttctattcagaccactaaaactttcttcatatcagcaaaaggctgtttttcctcttatcattcatgtgttcactggagtcgcccttttgatttcattcaagaactttttctttgcattcccaacttggctaactgatgcaagtgacctagttttcagcctgtctcagctttcgacatgccttcctcactaagctttatcattcctagcttttgatttaaagtgagagatgtgtgactcttcctttcatttgaacacttggagaccattgcggggttattaattggtctaatttcaatattgttgtgtctcagagaatacgaaggcccaagaagagggagagggatagggaaagagctggtcagtgaagcagtcagaacacacatatttatcaattaagctcatcatcttataagggcacagtgcccccaaacaattacaatcaaggatcactgatcataggtcataataacagatacaataatcatgaaaatgtttgaaatattatgaaaattaccaaaatgtgacacagagccactaaatgatcacatgcttttcaaataatgacactgaaggctgggcgccgtggctcatgcctgtgatcccagcgctttgggaggccgaggcgggcggatcatgaggtcaggagatcgagaccatcctggctaacacggttaaaccccatctctactaaaaatacaaaaatttagccgggtgtggtagcgagcacctgtagtcccagctactcaggaggctgaggcaagagaatggcatgaacccgggaggcggagcttgcagtgagacgagattgtgccactgcactccagcctgggcgacagagcaagactccgtctaaaaaaaataaaaaataaaaaaaaatagcactgataaacttgttcaagtcagggttgccacaaatcttcaatttgcacctgcaatatctaagaggcacaataaaatgaggtatgcctgtaataatagagtatatctcattgcctaatattataattaagtgagctaaatgatgtggttttttaacatcgtctcaagtagatttattgtcagtaattaatggtaatagtacacaaagtggagaacaaaggaaccgtgcaattaaaactttaatttttagtaaattttaaaatttactaaacttttgagtaattttgtgttgtaccaactttttttgccagtgtgttcaatccaattccttctttaaattttatttttaattgacaaataataatggtatatatttatgaggtacaaggtgatgttttgacatgtttacattgtgaattattaaatcaagctaattaacaaatctatcacctgacatagttatcttttgtaatgtggtaaaaatatttaaaatctactcttttagtaattttaaaatacataatgtgttactatttatcataatcaccattctgtgaaatagacccctaaagtttatttcttctgtctaatcaaaactttgtatcctttcatcaacagattccctttcctggttcaccccctcctccagcttctggtaactaccattccactctctacttctgtgagttggactttaattttagagtccacatataagtgaggttatgcattatttgcctttctgtgccaggcttatttcacttatcataatgttctccaggttcatccatgttgtgacaaataacagaatttccttttttaaggctaaatagtagtccactgtttatatataccacattttaatccatttatctgatgatgaatacctaggttgattccatatcttggctattgtgaataatgctacagtgaacattggagtgcagatatgttttgacatgctgacttcaatgtctttggacatatactcagaagtgggattgctggaacatatgataattctagttttcattttctgaggaccctccatgctgttttccaaaatggctgaaccaatctacattcccaccaacagtgtgcaaggattcccttttctccacatacttgccaacatttatctttcatactgttgataatagccaatctaccaggcgtgaagtaatatttcattgtggtttttattcgcatttctctgatgattaaaaatgttgatctgagctttgtcagcaacaagtaaaaataaataaataagaaatgttgagcattttttcatatatctgttggacatttgtatgtcttcttttgagaaatgtctactcaggtcctctgcccattttttaaatagggttgttttcttgttttgagtagtttgagtttcttacatattttggatattggctccttatctgatttatcatccaaatagtttctcccaatatgtgggttatgtcttcactgtgttgtttcctttgctgggcagaaggcttttagtttaatacaatattattcccctatttttgcttttgttgcttgtgctttgggagatcatatccaataaatcactgccaagaccaatgtcatgaagctttcccactatgttttcttctagtagtttttacggtttcatgtcttacatttaagtctatgattcattttgagttcattctagtataagaggtaagataagggtccactttcattcttctgcatatagatatagttttgcccacaccaattattgaaggtactgtcctttccccattgtgtgttctttgggcccttgttgaaaatcaattgaccataaacgtatgggcttatttctgaaatctctaacctattccatcagttgctgtgtctgtttttatgccaatagcatgctgtttttattactatacctttgtaatacattttgaaatccagcagtgtgatacctctatctttttctttttggtaaatttgtctttggctattctgggtttccagtggttccatgtgaagcttcagattatttctttctgtttctgtgaagaatgacattagaatgttaatatggattgcattgaatctgtacatcactttggatagtatggacattttgccaattttgattcttccagtccgtgaacataggatagctgtctgtaagttcttctagtaaaaacacactttactgacaaactggatttctctggttgtttttttggtttcttggctccttcagcatttgggggacactttgcacatatggccctcacatgaaacagtccttttagcattttttataagacaagcttagtgttggtgaattctctcagcttttgcttgtttgggaaagtctctaatctctccttcatgtttgaagggtagatttttgagggttagcaggtttttccttcagcactttgaatataacatctcactgtcatctggtcatcagggtttctatgaaagccatattgaggcttcatctaatgtaatatgtttcttttttcttgctactttgagtattctttctgtctttgatttttgataattttattattatatgccttgtggatttcctgtttgggttgaatttcattggtgacttctgagcttcctgcacctggatgctgtcatctttctccagatttgggaaattttcagccattatttctttaaatatgctttgtgggccctttctctcttgtcttctctaggaattctaattatgcagaggttaatttgcctgatgatgtcccatagttcttgtagaccttcttcattcttttttttctctttttgttcctctgattggtgatttcaaatgttctgtcttcaagcttgctaattcctctgtttgctcaagtctgctgttgaagctttataatgagtttttcagttcaattattttattctttattactagtatttctatttctattgcttggttttttttttcattgtttctataaatcttcaattcttctgggaccattcctggagctttgttgatttcttttgatggtattgaatatttctgagttttcacaagccttgtatctttacatggatgcctgcatatttgaggcgactgccaactcttccagcttttgcaggtgctctttcatggtgttagacctttacttcttagtattagaacttaaacactggcctgttgttgctttacactgtagagagggcttaatagtgagcatcagaactaaaacattgcactggacctaactcattgccctgtcattgtttcccagtgtaaggaaaacttatagtgagcaccacagcttaaatgccctggaacaatattgctgccctactattgtttctcagtgtgggaaaaacttaggtgggtactgaaaatcttgaccttttagttgtttctgggccagggaaaagcttcacatgtgcacctgggctttgtggatttgggccttcccataaattttgtcccctacaatactctggcccccccaccagtctcttcaatatggcatccccactgatcaaagcactgaacaatcaccaagatccacatgccagttgctgcaatcagtgacctactctttgtccccaattcaccccaggtttttcagccctcttggttctctagtgggatgaaactggagtggacttaccattaagattcctagacaagtgggaagatcaaatatccacctccaattccttcttctcatctcagcaactgtgggtctagggaagttctctgtgagtggtattattatggcctgggagagagggtggaacaggctgaaatgaccatttctcttacctgtcactgcttctctcaattctatgagcccagggggtttctctgcttctcaagttctggtgtattcagggtggcattcttgtctttgaatagtttttcattttatttttgtgtcaggaagtgatcccaggagatctattctgccatcttgctgacatcacttcccagtttagtcctgaggtatcagggatggattaagaagcacatggctttccccatcctgggaaaattctccaggacagggcaaaccagctcttgcaccagagacatatccacagagtagcctttcttgtattgtcactctctgcagctcatatccttgtgctgggctgtgaggcaggcactaaggacactctttaggtaacagtggaacgcagaacaaagagaagtcaagctagcctcagagaagagaaaatttgtcttaagtttttgatatcacaatctgcatctttttataatttgtatcccttgacaaattattgtaggtttcattgtttttaatagctttgccttttaatgttattaaagatataatttatttacccactgacattacagtatcagagtattttggatttcacaatgtatttacttttatcagtgaatgttatactttcatatgttttccagtcactaattagtgtcctcttcttcagcttgaagaactctctttagcacttcttgtaaggcaagtctagtagtaataaactctctcagcttctgtttgtctgagaaagtctttatcaccccttcatttttgaaagaaaagatttctgggtatagtattcttggttgacagggttgttttattcaggatttttaatataacatcccacccccttctggcctacaaagtttctgctgagaaatctgctgataatctaagggagggttctcttgtgtgtagcaattcactatttcctcactgtttttaaaactttctctgtctttttgcatgtatggcagggggagggtggtgagtattctggtttcttccatcctatggtgaaggtgaatgccagtatttatctctccctctctctgcactaagctggagagataatctgtgacaaatgcctatacttgtgtccaaactgcaccctctgatcctggtgagatagctgcttgatatggttagaatctgtgtccccatccaaatctcatgtcaagttgtaatccccaatgttggcggtggacctggtgagaggtgattggatcacgggggtaaatccttcatgaatggtttaacatcatctctttggtgctgttctcatgatagtgagtgagatgtggttgtttaaaagtatatagtacatccctcaccccgctcctcctccagccatgtgaagatgcctgctctggctttgtcttctgccatgagtaaaagctcctgaggcctcctcagaagcagatagtgccatgcttcctgtatagcccatagaaccatgagccaattaaacctcttttctttataaattatgcaatcttgagtatttatttatagcaatgagagaatggactaatacatgctgaaagtgggcccgttgtatgcccatgtctttgttttctgtagtcccaggccgcttaggaatgcaaagtctcattgggaatgcaaagccccattagtccccagagctaggttgataaggagacagtcccttgggtggaaactatagaagcttaggtactcagtacacggacaaactccttccaggaagaatgggtcgactggatttatcactgggatgagccaaaggaaaggctcagaaagtgctcagctcaagctcaggatgacagggagctactttctccccttaggtcctcaatgcaaattcattaaaagcaaggtcatcaagtagccaccaatagagtaagcaggaaaccccttgcaaagagaaaatgggagctcagcattctagtcccttttctacactgctcccaggagatgtagaccctggcagtgttattatgtccatttaaaaccacctttttggctgggtgcaatggctcagcctgtaatcccagtactttgggaggctgaagtgggtgggtcacttgaggtcaggagttcaagaccagcctggccaacatggtgaaacgctgtctccactaaaaatacagaacattagccagatgtggtggtgcatgcctgtagtcccagctacttgggaggctgagacaggagaaccgcttgaacccgggaggtggaggttgcagtgagccaagattatgccattgcactccagtctgggtggcagagtgagactctgtttaaaaaacaaacaaacaaacaaaaaaacctttttgtatgtgatctgggaagacttgagtatgcatagtttcaggtggtagctgctgtaaaagttgggccactcaatgcatggcataaaccccttacagggagtaacagggagctgcatttttaagccccttttctgtaccactccaagagtttgaaacccccagaaatacgtgtgcacctgtataaacctaccactcttgtctgttgtctagagagattctcatatgcatagtcctctctgctcctaaagctgggagttttagagtgcagtccttccagtagaagctgcaaaagttgaggcattctacatgtggacaaactctctccaggaaggagtaatagacctggagttatcactggagtgagccaggggaaaaggcttaggaagtgttgatctgcttctgaggctaccagcaggctactatttgcctctttaactccccaatgcaagttaattaatgcaagttaattagaagcccagccaccaagtagcccctagaagagtgtcataaacccctcccagagaaaaacaagaagctgcatttttttaagtccttctctgcactgcctccagagagtgaggcccctggaagtgcttgttctgtagcataaaaccactgcttttttcctgtaggtcagaaagactcatgtattcctaatcccctccacttccagagttgattaattgagccgaaccacggggaatttcagagctaaagcactatatgtgaggcccaaaccctcctctccacagagagaagttgtgtgttagggattcctttcctggttgtatggcacagtgtccaaggtggagttcatgcctgagtgcacctcagcttttcccactcatttgatgcagatgttttttctcagttgcccagtgggtaggagtctctcaattggttcctgacttttttcagagaatcaatcagtgaatagtttgttcagtgcattggtgggtgaagggagagtcaggagtctcctatttcaccatgttgctgatgtcatctaagggtaagcctttaggcttggcaacaatgacttctggataggagacttcccttgaatctttcacagcatgaacattctatttttgtgccaacatgcatttcacggtgaaagaagtcacaacaggggcctcagacaccaaacgcaaccttagatttcaaataacgtcctgtagttcatgaattaggtatcctgagtttggaataatgcagactgctaacagaggtaggggagggacaaacattgctggtgacgacattggtatagaaccacctgtgagcatcaaatgcagccaaagtacagaaacaaggtaggggtggatcagtgtcatgttgcatacatgagatggcagtatccttctagagtctccccatttacattcacttcgaaaagcagcatggcctaggagatagaaaaagaacaaacaatgcaaaagcaatggcaaccataagactatgtgtttgctctcaaacacaacaggcctcatctgtgattcttttcaggctagaacttgacattttggagatccagattttggaagaatttgcctttgcttcttcctctgcctccaagacgtccatgttcttctaagggtcctcactaccttactctacataatatgagagcacatagatgttttcatagaagagagagcacacagtcataaccaaatgggcactcctttcagctttgagttccctggggcactgtgagctgtccagagagctctctggaacacaggtcagggcaccagtgattagaagaaagcagagcaactgcttccagtaaaattcatagtctatgatgctcatgccagtgacatggaataggtcaacctgacacccatggcatgtccacatggtacagtgcactgaacttgaatgggggaggttattctctatatggtccctgaaaggtaaatttgcctctcttaatagtgtctcctagcagtgtttggagatggcctgagatgacgcttgctaagggaggctatctgaggaagcaccaaataagatctcttagagaccatgcccttatagcccacctactgctgatgatgtctgtgttggtagttgattatgatctcttttctaagactcccttgtccaagaaaagctcttgagaaaggtgaagacaaatctgagatatccagagcctggtgtgatgcctcagaggtggctcatggcctctggtctgatgggggaagttttcttctctgatgtctctttcattgaatagcccagcaagaagcactagactggagcataacactgcacacctgcctctgggcatggcctgtcctcctgaaacctcttcacatttgactccgtgttccaattagccacatgtgatgcaaccctggatctggccccaggatcatttcagaggagttgcgattgcatagagtaagggagagtctgtaccacagtggttaatttccactaactcacagtaggatgacaggcaagacccactgccactctgtgccaattactccttagcaatagcagcatgaaccacctgttccccaccccttggtgttcctcttgatcaaaagaaaagagaataagcctctaaggaagagggcttgggaaagatagggactattcagttaatggaaggtgctggagtgttagatcctgagacccaaattgggtcccatcagaggagtagccatgttggtgggtgctggataggaggagctttggggttggtgcaggcactcactctcactaggatgcctctggtctcaagtaatggagagaagtgagaaaaagtgagctcagaggaaacatcctcttccggccacatcatatcctctctctctcttgtggccttaggcatgtcgctggccttcctgggactcattatcctcattgtaaagagacagcaatctgaagctcagaaagagattggggagcatgaggtgggggagtaccaaggctaaggagaccaaagcagtgcttgggggcctcccactctttaccttgggttctaactgccacccatctcgtgcttaatgggtccttctgactccagggtgagaaatgttctccttagcatcaggagacgctgcacatgagcagttcctccccctgggagtactggttcagtgagcaaaacagcaaggggctgggcatcctgagggctgggagggatacatgggccaaagaaggagaaggagggtagagaagcatagccagggagagaaatcaaacaccaggacacaagatgagtggggcatctttgggggctacagtgggctctcaatgatcacctgtagtggcagcaaaagaggcaggatccatgggcatttgttctggtttatttgacagggacagggagttcagacactggggagggtggcattcctgttgatgttcttgtgctgatgatttgatgtccttgtgcttcggatgtgggcacagtctcggatggaagggttcagggagcaggatgcacatcccagcccactctcccactcataggatgctcatacaaatgttcccacagaaggctgaacagcatatcttatttgtttcacacttttggaaatatgaacagtggtggatgcatagatctatgctgggtcgcttctcacagaccttgattcctgaaatgatgcaggagcagggtcaatgaaaccatgcacctatagagcagccttctcaagcttgaagctcctccatggccccagaaccaaggcacccctgccaccacgactctcctggactcttcagggaacttccttccagcccatcaccaatcctagtgattggcagtatcttaaatcctgtctccctgccctgcatctcaccccagtagacttcaatgcctgggcttcctggactctcgccatacacctgcattcagaactctgtctccccattaatcatggtgaagtcacccccatagaatctatggtctgaccctgagagctcaaagaagcctgagacatttccaaaccctcccctagtctccagaatttgcagagcccagaaaagaagatgaacttgcctctcatccctccttctcctctcctctccatcactgtccctagtatcgcttcccaccaccactctcctggctcctttgatgttatacttaactttgccctgtatactccaacttttcattgcttatgtcctttttaccctacacttatacccatttctacacctacacctaccctcataaccacttctagatgttcactcctcacaaatgtgcataaatcaaagaataattgtcttgctttcccattggattctcagccctggttcacctttcactatgggatgtaccatttgtctctaagtactgggagcaaacaacaaaagatgtaggttcccccttcattcccactactattcccagggccaggtaaaggggttggagggccatggtttgggacagcccagagtctgcacagcattgtggtcagagctggatatgcagaaaggttgcaagtcctaggtcctactcagactggacacagctcctccattccccctacccaactctccatcacccatccagcagcccatcacctactctgcatcctcatcttgtcacggtatcctccctgggcctgcagcagcagcacacagagaaccaggacaagcagcagagtctggggtgccataactctgaccagagcgtgagccctaagtctggccaggcagtcacagacttccctgcagagctgcctgtggagagggaaggaaataaagaaggaatgatcttcagctcctcgctgcctccactggacaagtcagggcagagcaagagtccttgcttcctgcccttgccttctcctggccctgtccttctccatgtaggatagggcttctgcaggaatgatgcctcctctcacatcacataaccagtcctgtgttcttgctaacagagtttttcttttccaaaaggtactctttatttctgctttctaattataaaatgctttatggaaaaaagaaaagaagaaatataattttttaaaaggtgcttagaattaacccatattttattacattatcttttagttcctctgtatatttaatgtaaacaatcttttattttctcatttttgaatcacctatcttttgttacctaccgtctgccacctttatttagtcatgcaaatatttacaatgtcattatttctcaaaaagaaaagacataatttttttgggggggggcggtgaacgtagctacagatagacactccaatttccacagttgtgaaagcagaaatcatatcatgagcccctttaggaagtggctatttgcatataatggatgtgttcattataaattcttctttttttttttttagacagagtctcactccacaccaggctggagtgcaatggcgtgatcttggctcactgcaacctccaccttccaggttcaagcaattcgcacctcagcctcctgagtagctgggattacaagcatgtgccatcacacccagataattgttgtatttttagtagagatggggttccgccatgttggccaggctggtcttgaactcctgacttcaattgatccacctgtatcaacctcccaaagtcatgggattacaggcgtgagccaccacactcggcctaattataaattattcttatcaattcattacacaaaactctatatgattgagctatatttttaatattaagttctggggtacatgtgcaggatgtgcaggtttgttgcatgtgctgtgggggcttgctgcacctatcaacccatcacctaggtatcaagcccagcatgcattagccatttatcctgatgctctccctcctatgacaggccccaaggtgtgttgtttacctccctgtgtccatgtattctcattgttcagctcccacttataagggagaacatggggtgtttgaacatggggtgtttggttttctgttcctccattagtttgctgaggataacggcttgtagttccatccatgtccttgcaaagaacatgatctcattcctttttatgccacatagtattccatggtgtatatgtaccatattttctttatccaatctatcattgatgggcttttgggttaatttcatgtctttgctattgtgaatagtgctgcaatgaacatatgcatgcatgtgtctttataacagaatgattccattcctttgggtatatacccagtaatggggttgctgggtcaaatggtatttctggttctaaatctttgaggaatcatcacattgtcttccacaatggttgaactaatttacattcctaccaacagcatgaaagcgttcctatttctccacaacctcaacagcatctgtagtttcttgactttttaataacctccattgtaactggcgtaagatggtatctcatcgtggttttgatttgcattactctgatgttcagctttttttcatgtttatcggctgcatatatgtcttctcttgagaagtgtctgttcatgtcctttgcccactttttaatgggattgcttgtcttttcttttattattattattattattattattattatactttaagttttagggtacatgtgcacaatgtgcaggttagttacatatgtatacatgtgacatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaacttcatccatgtccctgcaaaggacatgaactcatcattttttatggctgcatagtattccatggtgtatatgtgccacattttcttaatccagtctatcattgttggacatttgggttggttccaagtctttgctattgtgaatactgccgcaataaacatacatgtgcatgtgtctttatagcagcattatttatagtcctttgggtgtatacccagtaatgggatggctgggtcaaatggtatttctagttctagatccctgaggaatcgccactcccaccaacagtgtaaaagtgttcctatttctccacatcctctccagcacctgttgtttcttgactttttaattattgccattctaactggtgtgagatgatatcccattgtggttttgatttgcatttctctgatggccagtgatggtgagcattttttcatgtgttttttggctgcataaatgtcttcttttgagaagtgtctgttcatgtccttcgcccactttttgatggggttgtttgttttttccttgtaaatttgttagagttcattgtagattctggatattagccctttgtcagatgagtaggttgcgaaaattttctcccattttatgggttgcctgttctctgatggtagtttcttttgctatgcagaagctctttagtttaattagatcccatttgtcaattttggcttttgtttccattgcttttggtgttttagacatgaagtccttgcccatgcctatgtcctgaatggtaatgcctaggttttcttctagggtttttatggttttaggtataacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttggagtatagtctgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctataaattaccttgggcagtatggccattttcatgatattgattcttcctagccatgagcatggaatgttcttccatttgtttgtatcctcttttatttcattgagcagtggtttgtagttctccttgaagaggtccttcacgtcccttttaagttggattcctaggtattttattctctttgaagcaaatgtgaatgggagttcactcatgatttggctctctgtttgtctgttattggtgtataagaatgcttgtgatttttgaacattgattttctatcctgagactttgctgaagttgcttatcaacttaaggagattttgggctgagacaatggggttttctagatatgcaatcatgtcatctgcaaacagggacaatttgacttcctcttttcctaattgaatacactttatttccttctcctgcctaattgcccaggccagaacttccaacactatgttgaataggagtggtgagagagggcatccctgtcttgtgccagttttcaaagggaatgcttccagtttttgcccattcagtatgatgttggctgtgggtttgtcatagatagctcttattattttgagatacgtcccatcaatacctaatttattgagagtttttagcatgaaggttgttgaattttgtcaaaggccttttctgcatctattgagataatcaggtggttttgtctttggttctgtttatatgctggattacatttattgatttgcgtatattgaaccagccttgcatcccagggatgaagcccacttgatcatggtggataagctttttgatgtgctgctggattcggtttgctagtattttattgaggatttttgcatcaatgttcatcaaggatattggtctaaaattctcttttttggttgtgtctctgcccggctttggtatcaggatgatgctggtctcataaaatgagttagggaggattccctctttttctattggttggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtacgtgtcgaggaatttatccatttcttctagattttctagtttattttcgtagaggtgtttgtagtattatctgatggtagtttgtatttctgtgggatcggtggtgatacccctttatcattttttattgcatctatttgattcttctctctttttttattagtcttgctagtggtctatcaattttgttgatcctttcaaaaaaccagctcctagattcattaaatttttgaagggttttttgtgtctctatttccttcagttctgctccgattttagttatttcttgctttctgctagcttttgaatgtgtttgctcttgcttttctagttcttttaattgtgatgttagggtgtcaattttggatctttcctgctttctcttgtgggcatttagtgtcataaatttccctctacacactgctttgaatgtgtcccagaggttctagtatgttgtgtctttgttctgattggtttcaaagaacatctttatttctgccttcatttcgttatgtacccagtagtcattcaggagcaggttgttcagtttccatgtagttgagcggttttgagtgagtttcttaatgctgagttctagtttgattgcactgtgatctgagagatagtttgttataatttctgttcttttacatttgctaaggagagctttacctccaactatgtggtcaattttggaataggtgtgttgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggcgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccacccttttattttgagcctatgtgtgtctctgcatgtgagatgggtgtcctgaatacaacacactgatgggtcttgactctttatccaatttgccagtctgtgtcttttaattggagcatttagtccattacatttaaagttagtattgttatgtgtgaatttgaacctgtcattatgatgttagctggttattttgcttgttagttgatgcagtttcttcttagtctccatggtctttacattttgacatgattttgcagtggctggtaacggttgttcctttccatgtttagtgcttccttcaggagctcttttagggcaggcctggtggtgacaaaatctctcagtatttgcttgtctataaagtattttatttctccttcacttatgaagcttagtttggctggatatgaaattctgggttgaaactctttcctttaaggatgttgaatattggtccccactctcttctggcttgtagagtttctgccgagagatccactgttagtctgatgggcttccctttgtgggtaacccgacctttctctctggctgcccttaacattttttccttgatttcaactttggtgaatctgacaattatgtgtcttggagttgctcttctcgaggagtatctttgtggcattctctgtatttcctgaatctgaatgttggcctgccttgctagattggggaagttctcctggataataacctgcagagtgttttccaacttggttccattctctctgtcactttcaggtacaccaatcagacgtagatttggtcttttcacatagtcccatatttcttggaggctttgttcatttgtttttattcctttttctctaaacttcccttctcgcttcatttcattcgtcttccatcactgataccctttcttccagttgatcacattggctcctgaggcttctgcattcttcatgtagttctcgagccttggctttcagctccatcagctcctttaagcacttctctgtattggttattctagttatacattcgtctaaatttttttcaaagtttttaacttctttgcctttggtttgaatttcctcctgtagctcgtagtttgatcgtctgaagccttcttctctcaacttgtcaaagtcattctccgtccagctttgttccattgctggtgaggaactgtgttcctttggaggaggagaggtgctgtgcttttcagagtttccagtttttctgctctgttttttccccatctttgtggtcttatctacttttggtcttgatgatggtaatgtagagatgggtttttggtgtggatgtcctttctgtttgttagttttccttctaacagacaggacccttagctgcaggtctgttggagtttgctagaggtccactccagaccctgtttgcctgggtatcagcagcggtgtctgcagaacagtggtttttcgtgaaccgcgaatgctactgtctgatcgttcctctggaagttttgtctcagaggagtacccagctgtgtgaggtgtcagtctgcccctactggggggtgcctcccagttaggctgctcaggagtcaggggtcagggacccacttgaggaggcagtctgcccattctcagatctccagctgcatgctgggagaaccactgctctcttcaaagctgtcagacagggacatgtaagtctgcagaagttactgctgtctttgtttgtctgtgccctgcccccagaggtggagcctacagaggcaggcaggcctccttgagctgtggtgggctccacccagttggagcttcccggctgctttgtttacctaagcaagcctgtgcaatggtgggcgcccctcccccagccttgctgccgccttgctgtttgatctccgactgctgtgctagcaatcagcgagactcggtgggcataggaccctccgagccaggtgtgggatataatctcctggtgcgccgttttttaagcctgtcggaaaagcacagtattggggtaggagtgacccgattttccaggtgccgtctgtcacccctttctttgactaggaaaaggaactccctgaccccttgcgcttcccgagtgaggcaatgcctcgcactgcttcggcttgcgcacggtgcgctgcacccactgacctgcgcccactgtctggcactccctagtgagatgaacccggtacctcagatggaaatgcagaaatcacccgtcctcttcatcgctcacgctaggagctgtagaacggagctgttcctattcagccatcttggctcctcctcctgtttgttttttcttataaatttaagttccttgtagactctggatactagacgtttgtcaggtggatagattgcaaacattttctcccattttgtaggttgtctgttcactctgatgatagtctattttgctgtacagaagctctttagtttaattagatgccatttgtcaatttttgcttttgttgcaattgcttttggtgattttgtcatgaaatctttgccaatgcctatgtcctgaatggtattgcccagattttcttctagagtttttatagtctggagttttacagttaagcctttaatccatcttgagttaatttttgtataaggcataaggaagaggcccagtttcaattttctgcatatggcaaatagtagcaaaaagagctgtgattattatattaaagtcaaacaaaatacacattgtgtcaaatattgttaaaagaaacaaaaaacatgattatatatcgataaaagggtcaattcatcaaaaagatataaaaattataaacatatacacaccaagcaatagagcttcaaaatatatgaagcaaacaccacaggattgaagggagacgaagcactacaaaatagttggagagttcaatatcccaccatggcatcataagaaatatatttggtctttgtccccagttcctggcacaaggttcctaaaactcttggaatttcctgagtgatgggtgtgtcttttgatattcataagaagcccctttcgattccacctcagtttctgctaatgaggttacttggagtggggcccctaggtagcctcaggatggagctggtcaccagaaaggtcaagtgattagaggtctggaaattttagacccacccactctcctccaggaagttaaagaaggaaggagttgaagctctataaaaactcttaaacaataagatttgatgagcttctgaattggtgaacacatccatgtgccaggagggtggcacacacaactcacaaggacagaaattcctgtgcttgggacccttctgaagctcaccctatttacttcatctggctattcatttgtatcctttataataaactgataaaccttaagtaaagtgtttcctgagttctgtgagctgtttcagcaaattatcaaactttcagatgggattgtgggagcccctgatttatagccagtagatcaaaagtgcaggaggcccaagacttgcaactggcacctgaagttgggagtagtcttgtgaaatcaagcctataagctgtggggtctgcactaacttcaagtagttagtgtcagaattaaattaaattttggaacacccagttggtgtccagagataggagaattggttgttggtgttggaaagcattccaggccctctttcaataatgaatagaacatgtagacagaaaaatcaataaggaaatagggtactaaacaacactataaacctaagacagacctaagacaagaagagaatgcatattcttctcaagcacatatggaacatactccaggataaactacatgttaggccacaaaacaagcctaaatacattttaaaagattgaaattatacaaactatcttctccagccacaatggaacaaagctagaaatcaataagagaaggaaaactggaaaattctcaaaaatgtgaaattaatacactctaaaacaaccaatgagtcaaagaataaatcacaacggaaattagaaaataatttgagccaggcatgttgactcatgcctgtaatcccagcactttgggaggctgaggtgggtggatcacttgagcccaggaattcaagaccagcctggcaacataaaaagaccctgtctctacaaaaaactaactaactgggcatggtggtatgcacctgtagtcccaactacttagaaaaaaaactttcggatgaatgaaaatgaaaacacaaaacacaacatccaaaaacttatgagatgcagtaaaagtagttctcagggtagaaaatctataactgtaaatacttacattaaaaaagagcacggccaggcgcagtggctcacgcctgtaatcccagcactttgggaggccgaggcaggcagatcacgaggtcaggagatcgagaccatcctggctaacacagtgaaaccccacctctactaaaaatacaaaaattaactgggcatggtggtatgagccttgtagtcccagctactcaggagtctgaggcaggagaatcgcttgaacccaggaggcagaggttgcagtgagccaagatcgcgccactgcactccagcctaggcgacagagcaagactccgtctcaaaaaaaaaaaaaaaaaaaaagatctcaaatctgcaacctaactttacatcatacgaaactagaaagagaagaacaaatacacccaaagctagcagaaggaaggaaataataaacatgtgagcacagaaaaatggaataggaaatagaaaaccaataaaaagaatcaacaagaccaaagcttggtttttttaaaagatcaataaaattgaaaatctttagctagattgactaagaagaaaagagaaaagacacaaataactaatatcagaaattagagtgggacatcaccaccaaccttacagaactaaaaaaattataagagaatactatgaacaattttacaccaacaaattagataaccttggatgaaatggacaaattcctagaaactcacaaatcaccaaaactgacttgagaaggaatagaaaatattaacagacctataacaaataaagagatagaatcagtaatttttgaaaaatacacatgactctcttcaacaaaaagaatgcctagggctagatgacttcactgataaaatctataccaaacatttttttattaacaccaatccttctcaaagttttccaatcttaactgatacagaaaaagcatttcacaaaattcaccacccttctataattaaaaaaaattcagaaaactaggaaataaaggacttccttaacatgattaaaggtacctataaaaaactatatacaatgatcattatactcaattgcaaaagatcaaaatctttctcccaagatcagaaataagacaaggatgcatctttcaccactgctagtcaacattgtaatggagttctaaccaaagcaatcaagtaataaaaagaaataaaagtcatccaaattgggaagaaagtaaaactatctcagctgtttttgtaaacaccagcaatgagcaatccaaaaaggaaattaaggaaacaatttgatttacaacaggctatgaaaggataaaatacctagaaataaatttaaccatggaggtaaaagacttgtataccacaaaatacagaacattgctgaaagaaattatagaagacctcaagaaatagaaagacatcccatcatttttttttttttttttttttttgagacagcgtctggctctgtcacccaggctggagtgcagtggcatgatcttggctcactgtaacctccatctcccaggtgctgggactataggcgcatgccactacgcccagctaatttttgtattttctgtagagacagggttttgccatgttgcccaggctgatctcgaactcctgagctcaagcaaaccacctgccttggcctctcaaagtgctgagattataggcgtgagccaccacacctagctgacatcctatattctatattggaagacttaaaattattaagacggcattacaatgcaattccaatcaagttccaacaggtatttctttttctttttttttttttttttttgagatggagtctcgttccgtcacccaggctggagtgcagtggcgcgagctcagctcactgcaacctccgcctcccaggttcaagcaattctcctgcttcagcctcccgagtagctgggactaccagagtgtgccaccactcctggctaatttttatatttttagtagagatggggtttcactatgttggccaggctggtctcgaactcctggcctcaggtgatccacccgcctcggcctcccaaagtgctgggattataggtgtgagccaccacacctggccggatttttctttatttgagaaacagaaaacttgatcctcgagttcatacaaaactgccttttcattgttgtactttgtagggtctcccatttcccccattttgtgcgttctgagtgaaaaacagagagtgccttgttggctgtgtgacccagccagttgcatgtttttcccagcaaggctgaaccgaagccaaggctttggatagccaaagcagtcttcaaaaagtagaattcacacttcctgattcaaaaataagccaatgatttaaatataaaagctacagaattcttagaagaaatgtagaagtaaatcttcatgactatggattgggcaatggattcttagaaaagacaccaaaagcacagtaacaaaagaaaaaaaaatcggacttcatcaaagttaaaaatttttgtgcctcaaatgactatcaaaaaagtgaaaagacagcctatggaatgggagaaaatatttgaaaaaatcatctatctggtgagtatccagaatatattaaagaactcttatgactcaagaagaaaaaaaaaaaaaaacccaattacaaaatgggcaaaggacttgaatatacatttcttcaaagaaaatataaaaatgaccaacaagcacatgaaaatatgctcaatatcggctgggcacggtggctcatgcctgtaatcccagcacttcgggaggccaaagcaggtggatcacctgaggtcaggagtccaagaccagcctcgccaacatggtgaaaccctgtctctactaaaaatacaaaaatttgtcaggtgtgggtggcaggcgcctgtaatcccagctactcaggaggctgaggcaggagaatcgcttgaacccaggaggtggaggttgcagtgagctgagatcacaccactgcactccagcctgggcgacagagtgagaatccatctaaaaaaaaaaaaaagaagaaggaggagaaggagggggagggggaagaagaagaagaaagaaatgctcaacatcattagttattagggaaatacaaataaaaaccatgagataccacttcacattttttgactggctataatttctaaaaaggaaaataataagtgctgacaagcatgtggagaaattggaaccctcgtgcatagctgatagaagtattaaattgttcagccgctgtgggaagagtttggagtttcctcaaaaaagtaaacatacaaagttaaacatatgacccagcagttctactcccaaatatttacccaaatgagttaaaaatatatactcaaaaaaatattcatctacaaatgttcatagctgcattatttgcaattgccaaagcaaggaaacagctgaaatgtccatcaacagatgaatggataaacaattgtgatatatatatatacaatggagtattattcacccataaaatggaatgaagtactggtgcatgctacatagtaaatgaacctcaaaaactacagaaataacatttcctacccaattgttttggaaaaaattcaaaagcatgacaacacgttctgttagtgagactgtaggaaacgtgcacagtcacattgttggtggcattacaaaaaggtataatctttatgaagtagaaatcggcaatatctagccaaactatatgtgcatttatcctcttttttctcttttgagacaaagtctagctctgtcacccaggctggagtgcagtggcttgatcttggctcactgcaacctctgcctcccgggttcaagcgattcttctgcctcagcctcctgagtagctgggactacaggcatgtgccaccacgcccatctaatttttgtatttttagtagagatggggtttcaccatgttgaccaggctggtctcgaactcctgacatcatgatctgccctcctcagcctcccaaagtgctgggattacaggcgtgagccaccgcacccagccgtgcatttatccttttaaccaatgatcacacttttagaaatttactgatattatacctccaacaatacagaaaattatgcataattgttcattgcagcattatttataatagcaaaatcttggaaactacctaaatgcccaaatataggagactggctatatgactaaggtgtatgtcaaatgcagctgtaatagaggaaaaattgttatgaactactggagagcagttttcaggatatattgttaaatgaaaacaacaaggtgcaaatgggtatattcgtgcaagaaaaacagagttgagagttcaagtaactaattatcttaaatcaagaatttatagagaattgataaagaagggctgctactcagcacatcctatgaagtcagcataaacttgctatgaaaccaagcaaggacaatatgagaaagacaagttacaggcccagttcattatgaacatagatgtaaaataccttaaaaatagcaaactaaaccaaacaatataaaaatgataatattcaatgatcaccttatattaccatagaaatggcttaatgtttgaaaatctgaatgttcactgcattaacagattaaaggatataaaaatgttatcatctcaatatacatagaaaaaagcaatacatataatctgacataaactaatttaaaatttcttgttaggaatgaaagaaaaatttctaaacctgatagagggtacttatgagaaacctaaagtggagacaattctaaaaggggaaacaagaagttttcattttaaatcaggtatcagacaaaaatacacactatcaccacttacatatgatgtactcaagggcctagcgagcacagtgaggcattaaaaatggcataaagtttgaagaagaaaactataactgcttatttgcctatgataaacactgaagagaacacacaaagaaaccataataaacaatgggagaatttagcaagctaactagttacaaatttgtggaaagaagaaaagatccaagctttaaagagaggaaagcaagtttgaaatagtatttgtagaaagtgggaacactggcttactgaagaaacttagtaagattgccagaccctttttggtttggtgatggtgcatctattgtgctgtttagtagcccagttgagttattttcccccagcaacaattatctgcctaggttcaagcttcaatgaaattgatggttggattcattcagggttgcagtttttgtaggtagattcaagcaaggagatttaaatgacaggttctgagtcctacattgatagaaagaaaagtaaacgcctataggggaggactacgaaatagggaagtgaagagtcaatgtttattggtttcagtgaggtcaaataattgtcatggtggagatttttgagcaaactggaaagttaacttctctacattagcagtaaacaaaaggaattagttgaaaagttatgataacatttacaatttccttttaaaaacttcaagcctcagaccaggcgcggtggctcacacctgtaatcctagcactttgagaggctgaggagggcagatcacctgaggtcaggagttcaagactagcctggataacacagtgaaaccccatctctactaaaaatacaaaaattagctggacatggtggtacacgcctgtaatcccagcaactcaggagtctgagacacaagaattgcttgaacctgggaggaagaggctgcagtgagcagagatcgcaccactgcactccagcctgggtgacagagccagactccatcatctcaaaaaaaaaaaaaaaaaattcaatcctctgtgaataaatataacatgtaca

SEQ ID NO: 422 - DNA, 20001 bp, Homo sapiens
ggtgcacaccaccactcctggctaattttttgtatttttagtagagatggggtttcaccatggccaggctggtcttgaacttctgacctcaggtgatccacacgccttggcctcccagagtgctgggattacaggtgtgagccaccatccctggcctaagtagaatgtgatatggtttaaaactcagtttaaactttcctttcattatggttcttatataaaaaagctttctgatgattctgatataaatgtatattctgtgtaatcacacattctgattaaaattttaagatctgccaattaaacattaacttctctataacttctggcaataatttaaatatcttttatatagatacatatatacagcagtatgtagagatacatatatttttattcagcattttatatatgaatagtaatacatatatatatatacatatcagaaaacatactttccctaacttattcagcacttacaaatttaaaagtattccagtaaaaacttttgagaatttttcattattttgtgatttgggattgcatggaagaaaatgttttccatataaaaatttacttaaaattggaattgctgccatttgttctttatattttctgtatcaggattcagtctttggctgatttctttctgcaaaaaaaacaaaaacaaaaacaaaaagctggtggagaataaagtgctctcaaaaccagcaaagtttcttgagaaatttagttttaattactttaacaaaaaggaagatcaaaatttaaatatgaactaaactttcagtttcaatattttcatgaacagtgggaaatttgtgagtaaaatttcaagtccaagactatcatacacaaattccacaggaaaaataaacttttaattttttacaaaagactcagagctcaagctggtattgatgaacactagggtcaatgcacacatccaaacgaaacttctgagtctttgcctctattttgccttaatgaatctctgatacttcctctctttttattttgtggcttgtcttttttgcgcttacccatctatgacttcatgattctctacctatctttccttcctccttcctgttttatttgacccacacaaatctccgtttctgcttttcctgtcccttttctcctttcaacatcttcctcttctctcatctcaatctatcttttctcttgagaacttttcaatactctacaggagaaaaaatattacattagtctatgagcagcagactaatgctaagtgttcacatacctttgagtactctatctcattcccacactattgtgctacttgtttcccattcacttcttatttgatgatgtttattctattacttaaggaaaattgctctcactaaagccattaaaaattgcttaatttctacacgcactgatttcctttaagccagcatagtacttgtacaaaaccagacacatagaccaatggaaaagagtagaaaactcagaaagatagtcacacacttacaaccatctgaccttcaagttcaaggtaaacatgcagtggttaaaagattctgtagtcaataaatggtgataggataactggctagcctgaagcagaagaacaaaactgaacccttacctttcaacatatacaaaaacttactcaaggtggattaagtttttaaacgtaagacctcatactataaatatcctagaagaaaccctaggaaatacccctcttaatgttggccttggtaaagcacttttggttaagtccacaaaatcaattgcaacgaaaacaaaaattgacaagtgggacctaattaaagaacttttgcacagcaaaagaaactatcaatagagaataaaaacaacctacataaagggagaaaatatttgcaaactgtgtatccaacaaaggtctaatatctacaatctataaggaacttaaatcaatgagaataaataaataaatacccccattaagaaatgagcaaatatgacagacacttcttaaaagaagacatacaagtggtcaaaaaacatatgaaaaaatggtcattatcgctactcatcagagaaaatgcaaatcaaaaccacaatgagataccatctcacaccagtcaaaaaaaaaaaaaaaaaaaaaaaaaagacagatgttggagaggctgcagaaaaagggaacacatatatactgttggtgggaacataaattactttagccactgtggaaagcagtctgtaaatttttcaaagaacttgaaacagagctaccatttgacccagcgatactattactagcaatcctattactatatccaaagaaaattaggtcattataccatcatttttttttcttgctatacttctcttttctcagtatactctctaatagataaataattcataactatgccctcatctactctaatgacacccaaattatttttttatttctattgctctagtaatattatattactaatactaaccagctcatctcgatgttcaaggcatgttcacgctacacacatgtcaatgcatctgaattcttagtctctattttggataactactcacaaagtgactcctttttccttcagtgaatactactttcccatcaaatatggggctaaatatttgcatcctagtgatgctacattctgaatgccttacaatatcctagtgatgctacattccgaatgccttaaatctttcttcatcctcctcattatttccagcattatgttacacaagtagacgggaatataatttaattttgtgtaatgtcagtaactatgtatgcatattatactgcttagtgcacccttctgaagagttttcagtgacttctgtgttgtttattgatatggtttggctctgtgtttctgtgttctcccccaaatctgatatcaaattgtaatcttcatgtgtcagggaagggacctgatgggaggtgattgcatgggagcggatttcccccttagtgttcttgtgatagtgagtgaggtctcacgagacctagcggtttcaaagtgtgtggcacttctctctttgctcactctctctctgctcactctccctccttctctgccatggtaagacgtgcttgcttcccgttcactttctgccatgattgtaagtttcctggggcctcctagccatgcttcctgtgcagcctatggaactgtgagtcaattaaatctcttttcttcataaagtacccagtctcaggtagctttttatagcagtgtaagaatgaactaatacagaaaattagtaccaaaagagtggggcactgctatagagatacctgaaaatgaggaagcaactttggagctgggtaacaggcagaggttggaacactttggaggactcagaagaagacagtaagatgaaggaaagtttggtacttcctagagacttgttgaatggttttgaccaaaatgctgatagtgatttggacaatgaaatccaggctgagatagtcagatggagatgagaaacttattaggaactggagtaaaggtctctcgtgctatgctttagcaaagtgagtggtggcatttttcccttgtcctagagatctgtggaactttgaacttgagagagatgatttagggtatctgggagaagaaatttctaagcaacaaagcattaaagatgttttgttacctgactgtttctaaaagtgtatgattatatgtgtgaacaaagagattttctgaaactggaacttatctttaaaagggaagcagagcataaaagtttggaaaatgtgtagcctggccatgtggcagaaaagaaaaacccattttctggggagaaatttaaacctgctgcagaaatttgcatgagtaacaaggatccaaatattaatagccaagacagtacagaaaatgtcagcagggcatttctgtgatcttcatggcagctcctcccatcacaggccaagaagcctaggagggaaaaatggtttcatgggctgggcccagggccccgctgttctttgcagccttgggacatggcaccctgcatcctatctactccagctccagttgtagctaaaatgggtcaaggtatagcttgagtcgttgcttcagagggtacaagccccaagccttgatggcttccctgtggcctgtgggtgtgcagaaggaaagaatttgggaacctctgcctagatttcagaggatgcatggaaacacctggatgttcaggaagaagtctgctgtaggggcagagccctcatggagaacctctactagggctgtgcgaaggggaaatgtgaggttggagccctcacacagagtccccactggggcactgcctagtggaactgtgagaagagggccactgtcctccagatgccagaatggtagatccactgacagcttgcactgtgtgcctggaaaaaccacaggcactaaatgccaggccattttgatttgcatttctgtgatgattggggatgttgaccaccttttcatatgcctgcttaccatttgtatgtcttcttttgagaaatgtctattcaaatcttttacccttaatttgatcagattattagattatttcctataaagtggtttgagttccttatatattctggttattaatccattctcaggtgagtagtttacaactattttctcccattctgtgggttgtctcttcattttgttgattgtatccttttttgtgcagaagctttttaacttgatgtaatcccatttgtccatgtcttctttgattgtctattcttgtagggtattgctcaagaaatctttgcccagaagtcctggagacttccctcagtgttttcctatagaagtttcatagtttgaggtattagattgaagctttttattcattttgattttatttttggatatggtgagagataggggtctagttttattcttttgcatatggatatctagttttctcagcaccatttattgattagactgtctttccccaatgtatgttcttggaagctttgttaaaaatgacttcactgtagatgcgtggatttgcttctggttctttattctgttccattggtctgtgtgtctctttttatgtcagaaaaattcttgggcacctcccactgcagtccttgtctttatttttcattggctcatccattcacctctgtctaacaagatttctcatcagattttagcataaaatgggagaactaggtgtatgtctaaaatttgagctgcagttttcatgggaaagacaactgtatttgggtttgtctcctaaagggaatcagaaaatgtggccttattaaaactatgttttaattaccttagacaagcttatactaatcaaagcactaagagtaaatttcacatttaactaaagtttacacaaacatgacagaagtgtcatctgtggtggtaaatggtatataaaatattatttcatttgttaaaactagaagtgtttacatgaaatagtgtttatgattccagaagttaaatgccattggggacaatctggacttctcatatatgtccaaatccgcaatacatacaagaacagcttcagtttgttccccagagaatcccttggtactcttatgagaatttcagttttccattcaatcgtcttctggcaaatgtacagagttgtacaattgaatgactcttctgtttaatccaaatttatataaacagcagtttcctgagtttggggaaagaagcctccaaaaagaatgaataggcaacgaattgctacctgtgttatcggcattcccatgcaattgtattttttctgttttagaaagcctaatggttttagaggctctcttaaatttctttcaaaatatgggtaagaaaaaatatctataattttcattacactttgtagaaatgttgaaaatgctatttaacttaccataattttagattgggtatacaaactgtcaaaatagccaggttgaaattagataactattactggcttatctctatattttagtttcatgactatgatatggatagaataaatagttataagacaacattcttcctttaatgatattttattttgttgttaagcttattatgactttatttgacaacttgtggcaaactaggacattaaacaattgaaactggttttgattataatgattctaagaattattcagattattctgatagaaatactcattctttctaattaatcacattcttagactacaactcttaaggtcagtcacttaaaaattaactcttgtatccttatccccacttctggatataatctgacaactcacactgtcaaatgaaggatgcattcagtggattcattgtattgctgccatggctgagtttacaactaaaatccacttttgatcctgtcttttttttcttcttttatccatattataaatgtaggatcagtgtgtttcattgccatcctagataattatttcttcactctagaggcaagaagaatgggaaaatgagtttctgttttttttggcttctatagcagtaggtaacctctgagcccccaagacatgggtgtcaaaaaagaggattagatcttggccatcttgtaaagaacgtatagtcactttgtacatcattcctaatgatgctttcaaatactacaatgattccaagtaattatttccattaagttcgaataggcccatattactgattgaatctcacctagttgttgagatgtgatgctcacaccaaaaacttgtcagcaattcgagttttcatccccaatgtttaatgtccatctacctggtcaccaactgacttctctctctttcactgatgatgtattccataccaaatatgtcacagtaactagagactctacattctgaattcttttgaatctattcatttgtcttaccatctcttccaatatcatatcacacagggactagacactacacatgcatatcaatcaccttgagggtatttttgaaatacaaattcctagagctcattcttgaaataatcaattcctacattaaaacctcacaatctgtatttttcatgaaaaaactctcccagatgattatcatgtgtaatctaatttgggatccccttgaccttagtatcaagtttctaattaggattcctgaatcagtttctccttcctgcagcacactttttacaccatcaagaactaaatttttaaaatatgctatgatgggctgggcgcagtggctcacgcctataatcccagcactatgggaggagctgagatcgtgccattgcactccagcctgggcaacaaaagcaaagctctgtctcaaaaaaaacaaagaaaaaaatatatatatatgccatttcccattttaaaatatttggtgcatgtttatcatgtgaagaataaagtttgagattcttcacattacattcattccatttttacacaggcctttcaaatatcttttttccttcaccctacatccatgtcccagacagaaggtttttctattacattcggtagagtccacaaaaaattagtacatttagataatgcatttttttaaatctcaacctgttaagtcctacacaattttcaaaccaaaatgtattatttttccatgtatttaaatgctcaaatagagggcacatcaattagagtactgataaaaaaattaagagggctctgataattacatagtttatttcaacactttatccccagtttcaactcacaactccattccaagtgttcctttacatttatttcattttttagaggacatgcagtgaggacatggaggaggaaaatacaacattgctgacagagtttgttctcacaggatttttatatcaaccacagtggaaaatacccctgttcctggcattcttggtaatatagctcatcaccatcatggggaatcttggtctaattgttctcatctggaaagaccctcaccttcatatcccaatgtatttattccgtgggagtttggcctttgtggatgcttggttatcatccacagtgactccaaagatgctgatcaacttcttagctaagagtaagatgatatctctctctgaatgcatggtacaatttttttcctttgtaatcagtgtaaccacagaatgttttatctcggcatcaatggcatatgatcgctatgtagccatttgcaaagctttactttatccagtcattatgaccaacggactatgcatccagctattagtcttgtcatttataggtggccttcttcatgctttaatccatgaaatttttttattcagattaaccttctgtaattccaacataatacaacacttttactgtgacattatcccattgttaaagatttcctgtactgattcttttattaactttctaatggtttttattttcgcagattcaattcaagtttttaccattggaactattcttatatcttatacacttgtcctccttataatcttaaaaaataagtctgtcaaagggatacaaaaagctgtctccacctgtggagctcatctcttatctgtatctttatactatgggccccttgtcttcatgtatgtgggctctgcatccccgcaagcagatgaccaagatatgatggagtctctattttacactgtcatcgttcctttattaaattccatgatctacagcctgagaaacaagcaagtaatagcttcattcacaaaaatgttcaaaagaaatgtttagatctcatacaatctctgttctctgtttactaaaattttcccaagattgttcaagttaaaggtatctgtgttttgctagcattcaaagattttgcaaagtcctagcactttaaggacctaaggtgttaatatctagtaaactaataaatacactcctaatgttattcaacggcatttaaaaatttttagtcatgttcatatcataatcaaataatgtcagcagaaagcaaataaaaatattttacagtgtttatgttattcaatgtggctttataaatgcattaaatgctaagatagtctatgtcatctgataaggacttgagtatgatgattttgatactaatacaactatattacctgagacactcaacacatttaactctgttgtgaaagtagatttgtgttttggtgaacagaggtaaatcccaagaattctgctagccatcaagggatcttttattccacttcattgggaaagagtgaattctacttcttgtagaaaatcaactcacatatcaggtaaagaaataaacaaaaatggaaatgcaatgaggagaaaaactgagaagggagttaacagtgaagatcttgccaaagcctaaaagggtactctttacgtagtgtgcttgcaaaagtaagaagaggtaagttgcctctaactttctacaatggtttctaatgccttttccagctgtggctgtatgtatttagataatctgaaaagctcccttaattcagaaaattaaaagatgaactagaagaactaagctgaagtaggcattgagaagaaaagataagtggcataataagaacaaaatggccttaatcttcccagaaaaaaaaatgaagctatgagatttttaatattcagtgatgttgcaagattattggaatgattttttgacaaccagagactttaaattcttattaccaaagttcaaataatgatcagatgatctgacatcatagtgcctagtgagtgaagggaaaaaacatgaaaatgaggaagtttgtatatttctgcctcaaaaagtccttgcttgttagccttcttcaaacctcatactcttgaagtgcatgagtcatccatctagcagtccactctgcccttcatctttcatcactgaaattttgtttacattctcactgataccatgaggcctttacctaaaaactactcatgtattgttttgcaaatctctggttacttattttctccattcttctagtactcattcattcccttaacattgccatcagatcggttttttgctaacataactctaatatttatgtagctcttcagtttcttttgtaggactgtcattgctaccaaattatatgcatatatggtttaggtatctatatctgtgtgtgtgtaaatatacatttttttatgtgtatgtatagtcatctaatatatgtatatatacacatgtataaagtagtggcattaaaattcagagtttatttgaggaaactgatttatttggtaccaccagactgcaggtgctttggtgctttcctgaagaggaaagaaaagaagctgttatagggtaaatgagaaagtaaggcaaaaagaaatattttattggctaaagtgaagcagtggcatgatttggatcatgtggaagtttaatagttagaggtgagttggtggttgttttaagttaatttttgttttaccatttacactgagttggatttctgtttgcttaggcaggaacccactttgctgcacccacctcagcccaatatccttttatttaactattttagctattttttcccttttggttaggctcccagttatgggatattgactaaaacttaggcacatgggccactttctgtgacgagcacagctggtttagctttgtgtcaacatggaactcatgtcataatgtccggtctcttgcagaagtgtttcttttactattttttctttgttgttgtcattctaatcacagtgaggaaacctggcatactgtgatggctatgaactcacatttaagactcttgagagactacagcactccaggaagattacaatgataatagtcacagtgatagtcccaagagaatggggatatactccatagccaaagtgtgcacgaaccaactgaaataaacccaataaaaacaaaagatcaatggttataacaatctataaacttagtatctgagccctgagggcagttatttgagaagacttttaaatttaagctcaaagcgtctttagatgatgaaataaagtggcagttgcaatatgatgatttttctagtttgcagtctgaatgtctctgtttacgtcattggtcaactacctgagcagacaagtcagctacattcataaagattgtcctctatagtttacatccagttgcccagccctagcttgtagggcttcaggaatagggcaatttataggtagataataaaacctcaaagacaatggagagaacaagaatttaacagtgggcgcactatacttttctactgaaacattattttttcctctacagttcccttcatttctaccaaacataattatagaaagactaatttctttacaaaataagtctactctcattaaacttcaactgagtatttacataagtgcagtaaaaatagtgactgatcatatctttttaatttggccaagttaggacctttaataaataatctcatattagactttaatattctctccaggctatgatgtcatgcaaagacatagcatctgttttgacctgcaacttccatagatttaggtaaattcccttatactcaaaagaagtcctaaaaagttttttcagtttcctgggccttctagaaagtgaccttcctctcagtcagtaaggttggaaaggtgtgagcagatatcaggccagtttctcttgagaaattttctgtagtttgatttgagggacccattcaaatctcatgttgaaatctgaatcaaatgttggaggtgaaacagaatagaggtgtgtgggtcaagagctagaattcctaatgaatggtaatgccattctcatgataattgatgagttctcacattctttgttcccttgattgctttaattggacaatacttctcaatttcacatattatataagcctcattagcttaacatctctctttttgtaacagataatgaaaattctctttcgacattctagaggctcatctgggaaatctcaaagttaattgaggtcaaaaaagatttaatttacagttttattttgggaagtttgttaaaactatcaaatgatttaaataattggttaagtataggcactggttactgaaagaatactaaaatgacaaaagatttcaaagtaaatagaaaaagtgatgttattgaaaaaaagttaaatcttttaatattgagaaaactcagttttcttaaggaatcaaataccagctaaagacaatatggatcacaaaacatcatcttgacaaaacatacattcttttcatttcacagtccatgtacttaaagggtcatgagaaaacttaaccagtgtctaataagagcagaccaacacattgttaaaaccttgccattttaattaagaagaccaaattatagtttttattagtttaattttaatattaagactcattttaaacactcataataacttgaattccggtaacttaactgcaaaagattctctttctcttccaactctctgtacccatttggtttttgtccttcatcatctatcctgaaacaacttttaggtaccatccaaactagacaaaattactccacttttcttttttttttaaatatatgtcctcatacctggtggttttcttatcaataacatttttcactttacttggatactttgcatacagagttatttttcttatgctgtttagaagttttaattaccacacgttaactagaactctcaattctcagcagctttattttcttggatataagtgattgcctagtacatatcacatccaaaatctgtagatggggaaacctatgaatacaccattttataatttgtagaagcatatgtttcttcacagcacaatttctcactgtagcaatgaaatatgtttgctagtgacctcaaatatttttatttcctatgtaataggaagcccaaagcagataagcctattttcagaaattaatgttttaacattttgtcttatttggaaatcagccaggtattcaatgaatgttgatcatttaatttagctttgtgaacctctaagggtataaattaccatagagatttgggaggatatttttatgcaggcacattataaaacataatttaaaaacaattataaatagtttataaataaattataaaacaaagtttaaatctttataaattttgttgtacttacatccttttacttaaatttttattttttatttttatttttatatgttttatatattttatatatttatacacctaaaaaatcactaacatttctatacaccaaaaacagtcaagccaagagccaaatcaggaatgcaatcccattcacaattgccacaaaaagaataaaatacctaagaacacagctaaccagggaggtgaaagtgtaagttcctctgagctggccgcaccatgatcaagccatcacgacattcccccacccttgtgataatatactttgtgatattccccatctttgtgaatgtactttgtaactaacattcctccctgcccttgtgacaatacaccctcccccatccttgtgaatgtactttgtaactttcccccccgaccctggtgacgatacatcctctccccacgtgaatgtactttgtatcaccctccccgcccttgagaatgtattttgtaacatccatccactgccagcaaaaaattgctcctgactccactgcctatcacaaacctataagaaccaacgataatcccaccacccttggctgactcctttctcagactcagcccacttgcacccaagtgaataaacagccttgttgctcacactaagcctgctcaggtggtcccttatacagacacgggtaacatttggtgtcgaagacccgtgacaggggaactcctacgggagagcagtcccctgtcctcgtgctcccaccgtgaggagatccacctgtgacctcgggtcatcagaccagccagcccaaggaccatctcaccaatttcaaatcagtaagcgggttttcgcaattgggtaagtggtttttcgctctctacctaacctctcttgcctcccttaaatctctctcctttcaatttcagtttctctcccttcctggtagagacaaaaggagacacattttatccgtgcattcaaaaactccgacgtcggtcacggacatgggaagacagtcttcccttggtgtctgatcaccgcggtgacgcctgctgtggtcattcacccaccttcccttggtggcaggtcaatcgcaaggacgcctgctttggctgctcacccacattacagcccaggactcagtcaggggtgcctactggaagcctggtagcttcccacctccatttctccatgtctctaccttcctctttaaacttaccttctcctctatgggcaaccttccaccatccattcctccctcttccaccttagcctgtgttcttaaaaacctaaaaccccttcaactaacacctgacttaaaacctaaatgtcttattttcttctgtaatactgcttgaccccaatacaaactcgacaatagttccaagtggccacagaatggcactttcaatttgtctatcctacaagacctagataatttttgtcgacaactgggcaaatgatctgaggtaccttatgtccaggcatttttttacacttcattccctccctagtctctgctcccagtgcaactcctcccagattttccttctttctttcccgttcgctccttcggtctccaccccaagctcagagtcctctgaatcctccttttctactgacccctctgacctctctcttcctcccctggccgctccttcccaggctgaatcaggtgccaattcttccgcagcctccactccaccatcctataacccttctattacctcccctcctcacaccgagtctggcttacagtttcattccacgactagctccccgcaacctgcccaacaatttcctcttagagaggtgactggagctgaaggcatagtcagggcatatgtgcctttttctctgtcagacctttcccatatcagccagcgtttaggctctttctcatcagaccccactaaatatatataggaattccaatatctaactcagtcctacagtttaacctggagtgacttaaatgtcatcctgacctctaccctctccccgtatgaacgagaaagagttcattttctagcccagtcctactcagacacctgctggcttcatgagccaggcctccaagagggcaccagggcagttccccgagaggatctccattggcaataccagacggactcaccaggtataggtaggctagattacatggtctcctgcctagtcgaggggctcagaaaggcagcatagaaagcagttaattatgacaagctgaaggaaattaccccaggtaaagatgaaaacccagcccaattcatggccacttagcagctacccttagacgttttacagccctagacccagaggggtcagaaggccaccttatccttaatatgcattttgtcacccaattctctcctgacattagaaaaaaactccaaaagttggattccggccctcaaaccttacaacaggatttaatcaactttgccttcaaggtgttcaataacagagaagaagccaccaagcggcaacatatctctcagttacagctacttgcctccgctgtaagacaacccacagtcacgtctccagcatacaaaaccttcagaacatctaaaccacagctcccaggggttccttcaaaacctcctcatggaccttgcttcaaatgccaaaatcctggccactgggcctcagaatgcccgcagcccgggattcctcctaagccacgccctgtctgtgcggggcccactggaagttggactgtctgactcacatttccgctgcttctaaagctcctggagctcaaacccaactttccttggccgattccttcccagatctcctcagcttagtagctgaagactgacactgcccaataactttggaagccccctggaccatcacggacaccaagctccgggtaactcttatagtggagggtaagtccatcccctgtttaatcgatatgggggctacccactccacattaccttcttttcaaaggcctgttttccttgcccccgtaactgttgtggttattgatggccaggcttctacaccctttaaaactccccaactctggtgccaacttggacaacattcttttatgcacttttttttagttatctccacctgcccagttcccttattaggctgagacgttttaactgaattatctgcttccctgactattcctggactacagccacacctcattgctgcccttttgcctgattcaaggcctcctttgaattctcctctcgtgtatccctaccttaatccacacgtatgggatcctctactccctgcctggtgaccaatcaggtatcacttaccatcccattaaaacctaatcacccttacccagctcaacgtcagtaccccatcccacaacaggctttaagaggactaaagcctgttactgttcccctgttacagcatggccttttaaagcctacaaattctccttacaactcccctatcctacctgtccagaaattggacaaatcttttttttaatttcttttattattattattattattattatactttaagttttagggtacatgtgcacaacgtgcaggtttgtttcatatgtgtacatcttacaggttggttcaggatcttcattctattaggtctattcatccttaccctactttttgcaacagggctttacgtggtcagtccccacttcttggactgtgccccataaacctgtcatccctactatcttctgtctagttatactcctattcaccattctcaactactcgtaaatgccctgccgtggtttacactgctggtttacacttttcctccaaaccatcataactgaaatctcctggttttacctcaaactgccacccttaactctctcttggagtgaatagaagatcttcagtggcaaggtacactccaattcttctatcctgatgaagtccttttttagttttttttacttttctactcactcttatccttgcccccattctccagtcactctctacctctccctagttacctccagcatactgtaaatctcacccactctctcctcacttcctccaatccttctctagcaaagaattgttggctatgcgtttccctttcttcctgctgttacacagccatccccactccatgggtcaactgggctacctctcctgtctccctgcacctccaaacctcctttaatagccctcatctttacccacctgaggaacttctttactttctagacagatttggtgagaactccccagacattttgcaccaacaagctgccacacttctccacatctactcatggcacctttctcctacatcaattccactccccctccccatatttggacccctaaccacacaaacaactatccctgttgctgcttctttatgcatctcctgacaacagcctgctggaatccctttaggcaaccttccaccgtctaaatattcctttactctttatctccagccacacattaccagatgggagcattccaactttgcattactgataagccctctatcattattgacaaactaaaaaacattggcagtcactactgtttaggaagacacctaccgtgcatccttggctaccgtcccgctgctcatctgtctctcctcctggcccctcctcttgcttgcttatacccagacccatgaatagcagtgaaagcttacttgtagacactatgtgctttctcttattccatgagaactgaacctctccctctatgcagttgcaccatcaatccccttacaaccgctaacggctgctgtccttgctggatctttaggatttggggtgcaggactcctctttcagtacaccctgtcacctttttactttacatttccagttctgcctgacacaacatctcttttttttatgtggctcttccacctacatgtgcctacctgtcaagtggacaggcacatgtactctaatcttccttacccccaaaatccagcttgcagatgggaatgaacaactgcttgtcctcctcatgacaccaacatgacaaaaaagagtcatcccactaatccctttacttgtgggtctaggactttgtgccttcactattgcacttggaactggaatagcaggtgtctcaacctctgtcacaacattctgcagcctctcttatgacttctctgctagcattacagatatatcacaaactttatctgtcctccaagctcaggttgactctttagctacagttgtccttcagaaccaccaaggcctcgatttactcactgctgaaaaaggaggactctgtatatttcttaaagaggagtgttgtttttacttaaatcaatctggcctggtatatgataacatcaaaaaactcaaagacagagctcaaaaacttgctaatcaggcaactaattacactggacccacctggccactctctaactgggtatcctggcttcttccaatcattagtcctcaatacctatcctcctccttctcttattcaggctttgtgtcttccaattaatctctcaattcctacgaaaccgcatcaaggctatcactcattactctatacaacaaatgctgcttttaacaatcccacaatatcaccccttaccccaaagtattacttaagtctaatctctcccacttaaggttcccgtgccacctctaatcctgctcaaagcagccctgagaaacatcacccatcacccctccatacaacccccaaaattttcaccccaagttttcactactctttcttgttttatgtcttccttattaacattaaaaaacagaaatgtaaggtcctttgatctggctgcaccgtggtcaagccatcatgacattccccccaccgttgtgataatgtactttgtgatattccctgtccagtgcatgtactttgtaacattccttcccgcccttatgacaatacatcctccgtgcccttgtgaaggtactttgtaacatcctccccacccttctgacaatacaccctccttgcccttgtgaatgtactttgtaacatcctccccacccttgagaatgtattttgtaacatccatccactgccagcaataaattgctcctgactccaccgcctatcccaaacctataagaatcaatgataatcccaccactctttgctgacttctttctcagactcagcccactcgcacccaagtgaataaacagacttgttgctctcactaagcctgctcagatggtctcacacgggcatgcataacagaaagatctctacaagtagaactacaaaacccttctcaaaaaaatcagagatgactcatacaaatggaaagacatttcatgctcatggataggaagaaccagtatcattaaaatggcctaaacgcccaaagcaatttatagattcaatgctattcctatcattagattcatcagagaactagaaaaaactgttttagaattcatatggaacaattcatatggaaaaagagcctgaatagccaaggccatcccaagcagaaagaacaaagatagagccatcatgctaccctacttcaaactatactacagggctacattaaccaaaacagcatggtactggtacaagaacagatacatagaccaatggaacataatagagaacctagaaataagaccacatacctacaaccatctggtcttcaacaaaacaagcaatggggaaaggattctttatttaaaaagcggtgttaagagaactggctagccttatgcagaaaattgaaactgaacttcttccttacaccatataccaaaataaactcaagataaattaaagagttaaatgtaaaacccaaaactatagaaaccttagaagaatacctaggcaatacaattcaggacataggcatgggcaaagatttcatgacaaagataccaaaactgattgcaacaaaagcacaaattgaccaatgggatctaattaaactaaagagcttctgcagagcaaaagaaactatcaacatggggtaaaca

SEQ ID NO: 423 - DNA, 20001 bp, Homo sapiens
taagaaaactggggcaaatcagtttttctccaatttccattctcccatttttcctaagtacagaatctttacttttaactggtgatcaagacagcattaacttctcaagttaactaaacttcagacagatttcttcctgtccgttttcctatttacttaaaaaacaaactcatcattgcaaattcttttttggctccctttcaagtgtgtatgtctcctcaaaaagcttttacctatttgattacccccagaaatgtctctctcaaaaacctgaaaaccatctctttgaaatgtaatttctgaaggaagataatgcctttatcctccagtctgtgggagggcaaaagcctaccttccgtcatggagataggtcagaattaagcacaggtggcctaccgttacccccaccccagctcttaaaaactctccagccttttgtttcaccctgaactcagaggctgagttgagttcaacctctctcctgtattgcaatagtcttgaataaagtctctcttgcttgtttaactttggctcatttttcactttaataccagatgcacggctgctggaacaatgttccctctgtagcttgtgttgcctttctttggctcctcattacctgtagctggaataaagatgtggtggctgaagtctgaatagcaacatttgatcacaggatagactgcatgggctgaagatgacagagaaataggataaaaagagctaaattcctaacacatggaacagcatcccagccttagaccacctatctccagccttctttaatgtgagagataaatttctgttttacttaagccattgttgttttgagatttctgttattcacaggtggacctaatctaactaatataccccaaaatatcttgatttcatttttcacctaacttcttttaaagaggtagtaaggagtactaaaatgatgtcatttggggtgaagtggggttggcagaatgaaattcactggtattacgttggtgcaaaagtaactgtggtctttgccattaaaagtaatggacaggccaggcgcggtggctcacacctataatcccagcactttgggggaccgaggcaggcggatcacgaggtcaggagttcgagaccagcctgaccaacatggtgaaaccccgtctctactaaaaatacaaaaattagccagacatggtggcacacgcctgtaatcgcagctactcaggaggctgaggcaggagaatcacttgaacctgggaggcagaggttgtagtgagttaagactgcgccactgcactccaacctgggtaacagagcaagactccatctcaaaaaaaaaaaaaagaaagtaatagaaagaccacaattacttttgcaccaacctaatacttttccatgtaccgaatctgctccaaaccactcagaacatttgtagagatgaaagaaaagccagtttcctgtaagattaatatgaaaaattctcacatatgcattaaattgtttcctctccattaaaatttaggatattttatctgtaactatgagaaattaaatttgtatacaattattgcttactatattcacaagttcagaagaaatagttgaaagaataaaattgtaacttaaggagatcaattagaaaatggataagacatatgcagatattttaaataaatattaacctatttttaaaagaccaaccatcccttggctatttacacttcatcttgctgtctaaatcctactatcaaattgttaagggcaatattacttactgtcgctaacttggtatcaattaccaagttagtatcagtttgatctaatttattcaacctcagcaggccttagaagacaaggttccagcaatagacaaataaagccgtctgcagagtttaatgctaagtactggtttgggaaaaagaacaaagaagtggaacagtcagattctaattgggaggcaggagctgcagcctcttgttgcaggggatttaggagagcagggaaacttgtttctctggacagaagtgctgcagtgtcccctgctctctaagtgtctaaacctttgattaccttaagaaagaaagaccttttcttgtgcttgttgacatcttcttgtcaattttgccactcttgtgacattagcatattcctcattagcaaaatcagaatgtggtagattaatgccacacactccttctctcactaagtaaaatcctattcatcctttattccatttctgcaaataaaaatgaagtcttaggcctgcttttcacttcttatgctaagtaatgaagttcctaagcctggccttaaaaaatgcaagtcttcacaatcaacaataggtggctaaaaaagatgaagagatgtcccctctctcctgaagttacaagatagagctttctgcatcataaaataaattcaaatagtctgatgtgataaggtattaaattaagaacattcacaagaatatcaatcttgcttctgtgcaacaaggagacttgtgtgaatattcataactgttgccaacttcttctattctctgttaatataaatttgtccttggaagtatggttagaagagattcttctaagactttgaagactagtttgttgcaatgccctgtgataataaccagaagaaacgtgcaattctgattggttatcttacttgcccttgtaatattataattgacacctcagtgcttgtttgtttgtttgtttgtttttgagatggagtatcgctctgtcacccaggctggggtgcagtggcacaatctcagctcactgcaacctccacctcccaggttcaagcgattctcctgcctcagcctcccaagtagctggggctacagacatcctccaccatgccctgctaattttttttgtatttctagtagagatggggtttcaccatgttggtcaggctggtctcgaactcctgacctcaaatgatccacccacctcagcctcccaaacttctgggattacaagtgtgagtcaccatacccggccacctcagtgtttttaaacaatataaatgcttgaaagattactaggtcatacaaaaaaataatcactggcactttctttttttctgacaggcataatggaaaagttaaagcctatgactgcaacttttttttaacacagagatgaagggtctagctaatttatcgggaacaatatctatttaaatctacctaacaagctattataagaaggggcagctgaggtagtaaaatggagaagtaggcaaaatgcaaggagctgttattttcaaaatgaccctgtaaggcattcttcctacaaaaatttgtgtaagcccactatgtgctagtcactattccagtgtaatggccaacccagtgcccagtcggtgtttggggctatcaacaacagtccccggttttgcatatgcactttccccaccctcattcagccacgtgtctcacaggaaatcgagccgttccccaggtgagaaaaggaaatcaaggtggggcataattagttcaagggtattgtaacagagccacaggaagaaatggtttctcatcacctatctgagcacttttgcatctgatatgacacccagaactgctgcagtcatcttgttactactctgaggatgaagccagaaccaagagactgagcagagagatgggagaatacaaccaaaatcacttggggcagtttactcagccctcacccttgcctcttacccaattaagggacaaaggcctgtggattttgttactatatcccatttcatttttctttttccctcatccaggctcatggcatctttcacctgacttactacaatagacttgtgatttatctctcttccccaagtcttctgcttactctcagagtgtgtctaagacatagctcagattatttccctcctcttttaaaaaacccctactgattttcattgcttagaccaattgttctcaaacttcaatgagaagtaaaaaatcaccaggggattttataaagcatacatatgtgagtcacatacttcagtgattctgactcataagttttctattggagcctagaaatctacgcattaacagcctggtgattcttatgtaatatgacccttgaatcaccatttgataagcatttatttagatgtgaaaggccaaactgttgcagaactttctccttagttcagctaaaaccgggttcttgtcacatgaccaggaaggattaggctcacagacacatagaagggtgaggagtagaaattattgggtgaaaaggaaaaaggaaaaataactctcagcaaagtgagagaaagtcctgctagcaggttttccacctcacagattgaattccaggtcaccaaccaggaactgaagaggccaggctcctccccctgccaatggcatgaacttcccgaggctgcaccctgtcctcccagtgcgcaggtgggcagtattcagtcaggagagggcagcttcatctgggaccagcagtctggtttttcagccttcaggccgttttaggcttgaaggcgaggtttcgccggggacccttggttgtctcatctctatcaaaactacttaactagcatcttatgtcttctttgcccagtccccaaacatctttcaaattgtattcattcacagcatctcctatataccaaccacacttgactactgcttcctaagcataccatgcattttcaaggctctgtgattcaactttccctgcctaagataatcttccccatccttgagatttagcttaaacatcacaaccttcattaagcctcctttgacctgccccttcaacggcattatgtaaatttgttgtccttactatatattccaaaatcacacgacctggtcctctacttagcactttaacaatgtgtcagagccatttttgaatctcagataaattataaacatctgaattagggctttatttcatttatctgtgttaaaaattctcggccgggcgcggtgcctcacgcctgtaatcccagcactttgggaggccaaggcgggcggatcacgaggtcaggagattgagaccatcctggttaacatggtgaaaccacgtctctactaaaaatacaaaaaaattagccgggcgtggtggcaggcgcctgtagtcccagctactcgggaggctgaggcaggagaatggcctgaacccgggaggcggagcttgcagtgagccgagatagcgccactgcactccagcctgggcgacagagtgagactccatttcaaaaaacaaacaaacaagcaaaattctcaccagaccctccaaaatattggaattatatacatgttataatataactctttacattttaaaataataaattagggcattggaaagatgaagagaagaaaacatattaacaaaattgaccaatcaagtttgaaaaaagaacttttagaaaagaaatatagatatttgctatttgaaatatataaaacatttgatgttaaatcagttaaaatagctagtgattgatagtaactgaagaaatgactcagtatgaagtataaagagatgacaaacatgaaaaatgttaagatacttgaaagagagagtaagaagctttatgtagaggtaactgacgttcttgaagagaataaaaatggaaaatttgcaatattcgaaatacctgaaaattttccagaaatgatattaaatcaataagcagatttaggaagtgcagtgaatccatatctagatgctttatactgaatttgcagaacaccaaagactaagagatgatcttaaagtagccagagaaaaaaggtcattataaagaagttattattctgacagttgactcctcaaatgcagcaatacaagccagaaagataatggaatttgatatggttgggttgtgtccccacccaaatctcatcctgaatttccacgtgttgttggagggacacagtgggaggtaattgcatctgaatcatgggcgcaggtctttcctgtgctgttcttgtgatattgaataagtctcacaagatctgatggttataaaaagggaaatttccctacacaagcgcttctctctgcctggtgccgtccatgtgagatgtgacttactcctccttgccttccgccatgattgtgaggcttccccagacgcgtggaaatgtaagtttaattaaacctctttcttttgtaaattgcccagtctcaggtatgtctttatcagcagcatgaaaacggataatacagagtaaaatccttaaaatgctgagataaaatacccctgaagttagaattgtccatccagctaaactattaggttggtgcaaaagtaattgcagttttgccattaaaaggaatgtcaaaaaccccaattatttgcaccaactgaaatattttccaaaaattgttcgacattttcagaaaaataaaaaatgacagaatttacaatgaatagaactatttaaaagaactttatgaagagatttcaggaagaagaaaattgatttcagaaagtctgagttgcaataagaaatatagtaaagaaaatgttaaacttagacataaattggaaaaagaaaccattaaattgcactataaattttttcaatttttggattaaaaaaacttagaccaaaataacatatttatctggaggagataatcaaagtattttaaatgttttatattgttcaaaatgagtataaagatacttactattggccgggcatggtggctcatgcctttactctcagcactttgggaggccgaggcgggcagatcacgaggtcaggagttcgagatcagcatggccaacatagtgaaaccccatctctactaaaaataaaaaaaattacctaggcttggtggcaggtgcctgtagtcccagctacttaggaggctgaggcaggagaatcgcttgaacccaggaggcagaggttgcagtgaaccgagactgtgccactgcactccagctcgggcaacagagcaagactccatctcaaggaaaaaaaaaaaagatatttactctctttgcactaatttaaatgtgattgttaaatttgttagattattattgaaagaaacagaatgtaaaacttccaaataagtgggaggaagaaagagagagggagaaaaccccccaaataagtaaaagcaaaaaactgcaatttctcccaaaagaagcccaaaaagaagaaagggagacaaaaagagaaaagtgacaaaaatcgaagatacaaaataagatggtagaaattatcccaaatatatcaacagtctcagccaatgttactagactaagctctcaatttaaaagacgaatattttgaaaatggagaaaaagatccacctatgcactaactagaagcaatacacctaaaacacaggatacaaaagttgaaaataaaaagtgaagaaaaatatgctaaccaaataacctaaaagaaaactgttgtggctatattatcagccaaaattgatatgtaaacaaaagcaatactagagataaagagggtcattgccattaataaagttaacatttattaagaatatataacaatcctgattatatgcacctaataccatatataaatctgaaatttacagaactacaaagagaaaccataagaataacaagactccaacacaactttataattaatagattaataaattgataaaagtttggaagagttgaaaaatacagttaataatattgacacaacgtaaaacttataagttgctgtgctgggctctggcaaactgttatactgtaaaagggttagaagttgattcagatcttaattttcttcatcataaggatagctaaagtggtctgggtgtcttcaaccttacaggtcagtctcatctgacctcaggcagcttcattcatttactttagcatgacatgacacaagaaagtttgagaagaactgagataatggacttatacagaagactatgttaagtaaccgaacatcattttcaagaatatatggaacatttatgaatattatcgactatattgtaagccataaactaagtctcactatacatcaaagaatcagaattaagcaaacatgttcctttacaattacattaaattagaaatcagtttctaaaaggtaagtaaaagtccatatatttgggaattataaaaatacatttctggctgggctcagtggctcacgcctgtaatcccagcactttgggaggccgaggtgggcggatggatcatgaggtcaggagatcgagaccatcctggctaacaaggtgaaaccccgtctctactaaaaatacaaaaaaaaaaaaaaaaattagccgggcgtggtggtgggcgcctgtggtcctagctacttaggaggctgaggcaggagaatggcgtgaacccgggaggcagagcttgccttgagccgagatcgtgccactgcactccagcctgggccacagagcgagactctgtttcaaaaataaataaataaataaataaataaataaataaataaataaataaatatacacttctaaatacccatgagtaaaaaaacctgaaagctgaaatttaaaatgaaactgaaataccacttacttgtagattatagttacgtgatacttagaggaaaatatgtagccttaagtgtatatattaggaaaccaaaggtgaacattgatttattgaatactaatcataaaaagttaggaaataaacatcaataagccaaattagaaaaagaaaaactggctgggtttggtggcttacacctgtaatcccaacactttgggaggctgaggcgggaggatcaggagtctaggagtttgagagcagcctaggcaacagagtgagatcccacttctacaaaatttttttaaaaattagccaggcagggctgggcgcggtggctcacgcctgtaatcccagcactttgggaggcccaggtgggcggatcacgaggtcggagatcgagaccatcctggctaatatcgtgaaaccccgtctctactaaaaatacaaaaaaattagccgggcgtagtggcgggcgcctgtagtcccagctgctccggaggctgcggcaggagaatggcatgaacctgggaggcggagcttgcagtgagccaagatcgtgccactgcactccagcctgggcgacagaacgagactcttctcaaaaattagccaggcaggccgggcacagtggcccacacctctaaccccagcactttgggagaccaaggcgggcagatcacctgaggtaacgagtttgagaccagcctggcgaacatggtgaaaccccttctctactaaaaatataaaaattaggtgggcgcagtggcaggcacctgtaatcccagctactcaggaggctgaggcatgagaatcacttgaacacaggaggtggaggttgcagtgagccaagaccgtgccacctcactctagcctgggcagcaggctggaatgaagtctcaaaaaaaaaaaaattagccaggcattgtggcacacacctatagtcccagctatttgggaggctgaggtgggaggaccacttgagcctgggaggtcgaggctgcagtgagctgtgatccgccactgcattccagcctggacggcagagtgagaccctgtaacaacaacaacaacaacaacaaacaaacaaacaccaaaaacagaaaaagagcaacgattaattaaagaaaaaagaagaaatagaattaacaaaactcaaattaattctttaaaaacactgatcatactgccaaacgtctagaatagtaatgtgcaacggagggcaattttgccccccaatgccctccctgttcctctttcctaggagatatttggtaacgtctggagacattttgtgtatacaggcacaacctgtggtggggatgctagtggcatctagtaaatagaagccagaaatgctgctaaacatcctacaacgcacaagacagccgcctacaagaaagaagcctcggacccaaaatgtcaaggttgagaaatgccatctagatagatggatcaagagtagagagaagtcacaagtaaacaatattaaggatgagaaatggggccatgtctgcaagtactgcaaaacttaaaaaagaaaataagaatattaacttcatgcaaaaatgggtgaacatttagatgacatagataaattcccagaaaagtataaactaccaaaataaactcaagaagaaacagaaaaatgaaaagattctacaacgattaaaaaatggtctcagtgtaaaactttcctgcagagaacaggcatgctcctacactatgggtatagagtgtagtatagcacatactctgaagggcaatttgccatatttacaaaaattataaatgttttattctgtgacatagcactctcatttttaagaatccattctatagatacagcaggatatatattaaatgatattttaccagcatacatgcagtattatttataatagcaaaagtttgacgacaatagaaatctgcttaaatgaattttgctataactgccacatggaatattacaaaactacaaagaagaataaagataagctctatagactgatgtaaaaaggtctctgcgatatatgttaaaaatgtaagaaaagcatcctggcgcagtggctcacgcctgtaatcccaacactttgggaggccgaggcgggcggatcacaaggtcgggagaacaagaccatcctggccaatatggggaaaccctgtctctgctaaaaatacaaaaattaactgggcctggtggcatgtgcctgtaatcccagctactcaggaggctgaggcaagagaatcgcttgaaccagggagtcggaggttgcagtgagcagatatcacgacactgcactccagcctggcgacagagcgagactctgtctcaaaaaaaaaaaagtaagaaaaccatagtgcagaacaatgtataatgtatgctgccttttgcatacggatggcaggggtggaggaagaaaaatatgcgtatatttgtacttacttatatttgtataaagaaaatcagtgcacacgtgcacgcgcacacacacacacaaaatcaagagaatgggtgaatcttgagagggctggaacatgaattttcagtcaaagaatagaaaaagaaaattctcaattcgttttatgaggttatgataatcttgataacaaaaacagatgacaacaatggtttaagattggaaaatactcaaagccactcaagaatataggtataaaaaactccaaacaaaacattagtaaaaccattactaaaatatatttaaaacatcttgacaagtttgcattccagaggcataaataatttgagtacattaaagatctcaatagatgaagaaatgcaatagagaaaagtcaacatttatttattaaaaaacaaccaaccaaacaaaaaacctcccaggaaactgagtctaaaaaacatcttacttaacgagagcaaaaaactatccaaaaccctaccacaaacatcatatataaatactaaatgcataagccttcaaatcaatagcaagagagggatgcctgttattattgcttttatttggcatgtctctgtggcttccttatcaggaaaataaattgaaaaagaattataactacctatataatataatgtatttcaaaaatcccaaagaaattacagaaatattagaattagagagtttatagggatgccatacataaaaatcagtatgcaaaagtgatttcatttttacacgatagtaaagggtgcaacttaaaatagttaacatttagaaataaataaatggtgccttgatgtaaatctagcaaagatgtgcaaaactctgctgaaaaacattaaagttgatctaaataaatggagaaaagtaccatgtttgtgaataacaaaaaaatgcaatgttgtgaagatatcatttttttcccaaatttatttatagtctcaatgtaattccaatctaaatcccaacacgctttttaatgaaggctgaaagactgattctaaaatttatttgaaagtgtagagggccaagaatagctaaaataactcttgaaggagaagtgtaaagttgtcaacattggatttgttgggacactattgtgttcgcacagtgatagatagaccagtagcacagaatagagagcccagaagaaatccagagtaacattgggtcactgaggtggcactgtagatgggtggtgacattatggcctattaaataagctatattggcacaactgcatagccatctggataaacaaaacaaaacaaaaaccattcctttttcacatgaaacacaacaattatgattaaggttgtaactgtgaaagacaaaaatttacaatttttagaggaaaatgtaaaagaatatctctgtgtcattgagatttggggaagatttttaaaacaaggtataaaaatcacaaacaataaaggaaaagctagataaactcagtaaaattaaaaatctttcttcaaagaaagggtaaagagaatgaaaagacaagttacatactggaatagaatccagaatatttaaataacgtgtttgaactaataaggaagaggcaaataactcaataggaaaatggcaaaaaagacattatggccaacgaacaataaatcttccatttatcaagacatatcatttaaaaattaaaagacaagcttcagactgagaaaagatatttgcaactcatataaccaacaggggattagaatggaggatatctgaaacattctttttttttttctttaagacagagtcttgctctgttgcccagactggagtgcagtggcatgatctcagctcactgcaagctccgactcccgggttcacgccattctcctgcctcagcctcccgagtagctgggactacaggcacctgccaccacacctggctaatttttttgtatttttagtagagacggggtttcaccatgttagtcaggatggtctcgatctcctgacctcgtgatccacccacctcggcctcccaaagtgctgggattacaggcggagccaccacgcctggctggatatctgaaacattcttaaacatcagtaaggaacagataaaccacgtgccaaaaaaatgcacaaaaactataaacaggttatcatacatacaaaacctaatggccatatggaaagatggcgaacctcattaataatcagggaaaagtaataaggtacatttcagacactaaaaagtaataaggtacattacatacacatttggcaacagcaaaaatgttaacatctgacaaaatccattttgtctggaatgtggaagagttggcatgcatattgccactggtgagtttgtactttattacttatactttgaaaaattatttgacaatgtccacttgaaaatgtctgttgaagggatgcatgttcttttatagagcaataacactgctaggttcatatcctagagaaaatcccagacgtgtaaacaagatttgtgtgagaatgtttgcagcagcagtgtttataaagatgaataaatgggtaacatcctaaatgtcctacaacaggcagtgaatatggtcagctgtaaactcttacaaggcacagagcccttgcctaaacactgtgctaagagagtaaactctagcctgctctcaccacaccaggccaccttctaaaggcagccccagctcccaagctaagtctttgctaaagaaaatgcaacggtctggcgcagtggcttggctccctcctgtaatcccagcactttgggaggccaaggtgggtggatcatgaggtcaggagaccgagaccatcctggctaacatggtgaaaccccatctctactaaaaatacaaaaaaatagccaggtgtggtggcacacacctgtaatcccagctacttgggaggctgaggcaggagaatagcttgaacccgggaggtggaggttacagtgagccgagatcgcaccactgcactccagcctgggtgacagagcaagactccatcccataaaaagaaaacgcaataatgccaaactgcaaaatgtatattgttcaacccatcttgccaaaccattttcagcaattcttcacctaattccccttctataattttccattttcacatacccctcttagtcctttttttgttccccttttgcacttcccaataatccttttttattctttatctgttttccccttaaaaacctcagtcatcttcctcttagttggagttgagctaggatttatactggagtctctctcccctacagcagcagtatgaataaaatatctgtcttgctacctttaataagtgtctggctctctttttctttggaaataaaaatatctcattttattcctatactggaatactgcacagcaatgaaaatcaataaactaaagccacatgtattaatatggatatatattacaaatataatgatattgagaaaaaggaaagctgccaaaagtgcacatagaatatttatgtaaaattttaaaaaaatgacactgcactatatattgtttagaaacacatacctaagtagtaaaaatacacagaaatgaaagaaaatgataacaccagattctggatgatgtttacctctgagagagagggaaggaaggaaggaggggaatgcatcagacagtgtgcacacaagacaaggggctgtgactatcttagttttatttctcaaactaagtggtgggtacatagttggccattgtactaagcttgatgtcttcttaaatacatgaaagttttcacaatatgtgtaatagatgactcccaacctaggggaaatttaccaactacattagaagtcctagcatatatacaaaatgtcagtgaaaaaggaggcagatatagattagcacaaagcctagaaaaaagaaggaaaaattatggagcatgacccccaaaaccaatttagagacaatttcccgacccaggcccaagttctggtgtttccatttctctgttgctgaaactgatgtatcaggctaagacatacagtgcactcactctgatctgacttcaatctcgtcaagtgatggcatcatttggtctcctgtacagatattgtctacagggagagaatttactgatcatgttcaaataagtatctggtctagttgccactttatttctaattttcagttaattggtgggcattttgaccttttaattacaatcttgttgacttccatagcacgattcagcatccaagccctgaatctgcacagacaagggataggctctgagtcacagtgaatttacaaggaaggtcatactactttgagcaccttttatatggctggacaattgcattccactggtgaaatccaaccaagaagtgcttttcatcgaaagcacaagcagtaaccgtacctatgtgcatacataacttattaaaatgttcatgtcaggtgttgttgttttagtagaattggaggtatatttacttccttgtaccttgaaggcaggcatgtacttccaagttcctctgtctcaagggggtttgcttatagcatttaccctctgagttaaaaatgaaaacttcaagtccctgctcttcaaccccaggacatttctctgtcttcaattgtttctttgggagtttaattataggtgggcaaaaagggagaagttgatgctgggagtcaaaagagcaaatcttgacatggagaaagagaaagggaaagaggcaagtaggcaggagagaaagagagagagagaatatataactttttcaagcatgagaagataatgagtgtttagggcgtatctttgagggacagagatatatgccccacttacacttgctatgctacattggaggttagctgtgctatgaaacatctgtggagggagacttccaagcacagacactttgagaggacagccaaaagcctctgtggaagaaccttggagaggactcccgtgagaaccagatcaacagcaaaatgcagaaggaacaaagatggggacaggaacctcattttctgggcaacatgaaagactacttctaaggaggtagaggacctcctaaaacactttcataattgaatttcatgcaaccttgagaagtggggccatgacatgagaattaatttgatttacacaaataaagcaatgtaaaatttcttgtagtagagtgttgaataattcatatctactatactacagtggtgaattaatgttttcaataattgcttgatttcacattatcgtatttgaaggccagtcctcctttggagtatgcaaataagaaacttaagagacagaggggttagtactttatttaggatcctgtcattgttacctgttactgcctacaaagacccatatttagaccatacagtctacttagaaatacccacccaaatgcacaggcatctctttgcagaaataagccatgcttgtgctttgttgccactgccctgctttttagcctccaattttacactggagcatttacatcaagtaaacctttcttgatgtagggaagatattatgggaaaagactgagtattataacataggaaagaattacctttctcacaccacatgtatttgcttttgccatatttaattgtttgcctacaatgtggcagcatagttttagacactggggttataaagaggaatgcatgagtctctgccctcaagaagattcaaatcagtgcaattccatctactctgcattgctgaattaagtcagaaaagtctcaggtccttcattagcagtggttggcagagctacattgttctcggatgctggctgctaggcgagttggtgttttatttttcagaaatttatagccctaaagtgttattagggccagagggaagggggaaagggcaactttccctcttaagacttttgtttaatgattgcaccagattcactatggctcaaatggctgacactaagtacactaaatattaagaaagcaatatcacaaaattgactttttaagtgttgacattgtgtcctgattattttacttggctgctgtttgtcaatgttagctgcactaaaatgatacaaatttctgtcttgaaaattttattgtcctcattttctacccatgataattaaagaagtaaagataattgggcaaatgaagatgaaaaaagcatggtaatcacttgtcattctattctaatcagcagataattcatctaatttagacacattactatttaatctaccacctttcaatttgggtaatgttgcactctaatcaggagaattaaaagcttattcaattataaagggatgttccataaggtggaaaaacaggaagatcttagttatttctatgtgcattttgcttaatagcattacttatgtcaccagtgaaaggcaaactcttcagctctacttttggagggcttcaatgaaaagtaaataaaagcttgcttaatcaatacctcatgttcaataggaaaaaagaaacgattctaaagaaaagtgaaaacaaaaggctctactgaaatttcaaattggtctcatttctccaaaattaaatatactcatatgaaatcattccactggttctttcagatttagtaattttatcacacttcattcataatagccttttcctttcatctgtagatacaagagaaaaaagcccaccaaacaacataatgacaaacagctgttggatatgatagacatttcctagggaaaaatatgcttaatattattttttcatgttttgtaagttgcttgtcatggaacagtttgtttataatgtatttgtcattttacataaaaaatgggagattatgcaatgagtctaattacattcattctgcatgttaaaagcagtttttccctgagtatggctaggaaaagaattcctaccaaaaattcaaagtttacaccagttctgcactgctgtctcttacctgtcatgctgggcagcagcagttgattctgacatttttgtttttgtatatttccaagagatctcagaaaagcactgtagtggagccataatatctgagacacagaattctccctataccccaagaactctcaagggtcttgtggggtcccactaggataggcttcaaagaaaagggctttgtcacttttctgacaaaacattaaacgcaagaggaaagcccttctacttgttctatactaaaattcaatttcatttcaaaaataaaagttgagttaaactatttgctacttgttgaatagattcttaagtttttcaaggagctaaatcttttcctagccagaatgtctaaaaagtcaggggtcatttttggtaaatgtttagctatgattatgtttttgttttctaagatgctggctgagtagcttggatacagatgtaaccgttaatagaaggatttgaggattttatttttaaatctaaaattttacaaatctacagagttgtctgagttgtctaagaacattagaaaagaattgattcattcttgggcctctgctttgtcctcttgctgttgctgagagaactgccctaggcaatttatcaagcagaggtacccatttactataccacacgacccaagactgagccaagggattccatggccactgacctacaatgtgatgttataggagctttgtcaattcactggatgagtcagattcttttttttttaaatctagagattattgagaaaaccacatagttggtagtaggtttggactgagaaaggcagagggaagcagagggataaagaatacctaagaaatacagtagaatattaagacagggatccatgtataaatgcttccaaaggaacatgtaatagagttcatcttttgtcatcatcacagctgctgtcactcagaccaccagagctattgctgcatcatgaaaaatttctacctcaacgaagcttggaaggtcatttattcattcagcagatatttattgagcacttcctatatgtcaggcactgtttttaatgtggacaacacagcaataaaatagacaatacatcataccctgcatgggtttatattttaatggagagaggcgaaaagtaaagaaactaaaatagtaaaatgcatgggagagaggagaaaagtaaacaaactaaaatagtaaagtgcatggtatattagaagaggaaattgctacggagaatataaagcaagaagaggaacatggagggtagagaaagtgacagatggttgcagcgttaaccaagatggtaaggaaaggcctgggaaggttatacatttgaacaaagatctgcaagaagtgaaggagctatccacgaggatacatatggggcaagagtgttgcagacaaaggaaagaactaatgcaaagatcctgaggtggggataagccccacatgtgagaggaacaccatggttgcatcagattgagtgaggggcagaataggaggaagtgaggtcaaaagggtgggtgcagaatttgtagggccttgtaagccattgtacagatttctgcttttaccctgagggtggttggggaacacgtgggaaaattttcagcagtgatcagactcatgttttaataggatccctatggattctgtaataaatatagaaagtagcgggtaggggcaagcagtcatgagatcattccaataattcagatgagagacggtcgtggtttggaccacagtagagactgtgatgaaggtgaatagtgtttggattctgggcatatattttgggtatgtccatgttcctttgcgaattatgtagattcttatttactgaactcaagaagagactacatgtggaataaaaatgcattaatcagaaaaattaattgactggcttctgcttctggaaggattgagtagaagtacttatccctattccctctgttaaatacaagtaaaactccggacgttatacataagaaaactctggacattatatggagagaagcagccaaccagctagggccctagagactcagaaaacaacaaagcagtgagttccccggtttccctttctgtatcatatattccttactgggaactgaagaagccagagacct

SEQ ID NO: 424 - DNA, 20001 bp, Homo sapiens
tagatcaatatgacagaaattgggatctttacaatactgagtctccccatacagaaaaaaaaaaaaaaaaggtaagcaattccagttaggtcttctttatgttttccattaaagtttcagcatattattacactttttttttttttttaccaatttcctgccatgttgcttgtgatttttcttcctgtcataaaagttatgaactctacttactgttgcagtttttagttgattttgattgtgttagtgccctcagtgatggcccctcattcatccacaccctctgctgtatgttctcactgggcttggccgtatgacttgttctgcccagtgggtcagagcagacaggatgcaagccgaggtctgaaatgagcttgcaaggtgggccttgctatcttgcagccatgggctataccccagctggcctgctggcccaaggcgaaatgtgagcaacatggagcagagccccagccagcccagcctgagtcacagcagaatccctcgttccccacagacacaggagcaagattaactcaggtcagcagactcccagccaacccacaggatcatagctctagtactaaatcaggactgtttcagagcactgagctttgaggtgggctgtcaattacacagtaattgctgactgaaacattgacatgcaatcagtccatgtatttctgtgggtttatcttgtgtctggccattgattgaacagttttattaattctggcagattttcaattgatcattttcggcccttccggacagataattacatcatatgcgataaaagtcatcttgtcccttcctttcctatcctttcagtcttttttttttcttgtcatattacattggcaaggactttgcaaataataagttgtgtttgtttttgtgggtcttctgggtgcatgctgctatttgtgaatataagtgtgtcctattcaccctttgccttgagagacttaacaagacatttcttcttgatgaatacagtgctcttccctgtgtctcattatttcttgtacttttagcattgtgtgtttatggttgcttctttaacctacctggagtgaattttctgtgcatgatgtgacgatgttaggaaaagctctatcttttctcttttgtcatgtgaataaccagtgtctccagaagcctgagaatgtctatgtctccagtgtctctgaaagaatgagaacatctctctggatatgacaaatttgtccagaatccctctcataagggcagcagaggatgggggagcctcatgggtacccaggcagcagaagctggaagtgaactgacatgaatggggcttgaggatgcaatctgcccctatcctcaggagtctgagggcagcacagaggcagggtagtggggaaggaaaacatcaggcacataagatgcccctcacactcaactccctggtcacaaactagagagtcaccagcccccatcatgagcccctcttctggatgcagggcctgcccttctgtggaggtcttaggagtgatggcataagaggacagagacctaggtataagtcgcaggcatctggtattgaacagagcactccagtgattagcttcctctctgggaatacaaaccaaacccaggaaatgtgcacagccttgtaaaaccactacaatttcagattgggtttatctggtttattgcttgatatgcaattagaagtgtcttgaacacatcagctttcagttcttcccacggttgagtatttaatgacctgtgaatgaaccctgagaagatgcaacttcaactgagccctgcaacccttttgtaagggaatgtgttcaccctccaaaaacctacttgcaagtaatatgttaaggcacagatgctagaaagcatttgatttaataaaatgtctagtgggggggaggagccaagatggccgaataggaacagctccggtctacagctcccagcgtgagcgacgcagaagacgggtgatttctgcatttccatctgaggtaccgggtttatctcactagggagtgccagacagtgggcgcaggccagtgggtgcatgcactgtgtgcaagccgaagcagggcgaggcattgcctcacttgggaagcgcaaggggtcagggagttccctttccgagtcaaagaaaggggtgacggatgcacctggaaaatcgggtgaaccatgagattatatcccacacctggctcggagggtcctacgcccacggaatctcactgactgctagcacagcagtctgagatcaaactgcaaggcgccagcgaggctgggggaggggcgcccgccattgcccaggcttgcttaggtaaacaaagcagccaggaagctcgaactgggtggagcccaccacagctcaaggaggcctgcctgtctctgtaggcgccaccgctgggggcagggcacagacaaacaaaaagacagcagtaacctctgcagacttaagtgtccctgtctgacagctttgaagagagcagtggttctcccagcactcagctggagatctgagaaccagcagactgccttctcaagtgggtcccggacccctgacccccgagcagcctaactgggaggcaccccccagcaggggcacactgacacctcacactgcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgtagagtgcctctcctcctccaaaggaacgcagttcctcaccagcaacggaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaagagaacttccccaatctagcaaggcaggccaacgttcagattcaggaaatacagagaacgccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatacttcacagacaagcaaatgctgagagattttgtcaccactaggcctgccctaaaagagctcctgaaggaagcactaaacatggaaaggaacaaccagtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaattctccaattaaaagacacagactggcaaactggataaagagtcaagacccatcagtgtgctgtattaaggaaacccatctcacgtgcagagacacacataggctcaaaataaaaggatggaggaagatctaccaagcaaatggaaaacaaaaaacggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattggacagatcaacgagacagaaagtcaacagggatacccaggaattgaactcagctctgcaccaagtggacctaatagacatctacagaactctccaccccaaatcaacacaatatacatttttttcagcaccacaccacacctattccaaaattgaccacatagttggaagcaaagctctcctcagcaaatgtaaaagaacagaaattataacaaactatctctcagaccacagtgcgatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaacatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagctgaattataccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattcccattgaaaactggcacaagacagggatgccctctctcaccactcctattcaacatagtgttggaagttctggccagggcaatgaggcaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatgaaagaacattccatgctcatgggcaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcagaacataggcatgggcaaggacttcatgtccaaaacacaaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcgtgtcctttgcagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgatgagttagtgggtgcagcgcaccagcatggcacatgtatacatatgtaactaacctgcacaatgtgcacatgtaccctaaaacttaaagtataattaaaaaaaaagtctagtgggaagagtgctgtattcgttgagaagaaatgtcttattaagtttcctggggtgaagggtggatattaaggatatactcaagtaacaatggataataatacaattgccaccaacaactacagctgttgctctctgccagatgctattctaagtgtgttgcatattttaactcatttagtccacacaatgaccctatgaggaaggtactattattatcatcccttatggggagtctggctctaaattcttctgtttgtttaaacagatggggaatttgaagttccaggaggaagatgaaggtgctttcaaggcgggagaaggtgcaaaaagcaagtccctgggtgccttgtagagaaggcggtgttggtgtacagtttaaataggatgcccagtgtagtgcactccagccgctgtggctcctcatgaccatctggaaagcattttgccagcgtgagagattggcaaagagactcgggcatccggaagactgaacccactgcaccttggtagctttgtgcagggcatcctctgccaggatgtggatggaatcccagctgtgagcccagatttgtagtaaggccaccagcttgggaaggctgggagaggacagggaggggctttgccaaccagcccaaggtgggaaccaggactcctgtgtggcaccagggtgtcctctgatgggcagtggtccagctgtcctcccagcagtgccacgtcagcatgaccgtccacgccttgtccagggattcagggagagaagagcactgccactttgctgtggaaacagacaggtgtccttctttcctctgtcaaggtgacgttcgtgcatttaaacagagccctctggggatagctgttcaacaactcaccaattaaccctacagaaatgacatcaatgtcttttcttcatttcatgcgtaatgcaaagacttctgtgggaaggaggagaccctgagagccacacttcaatccttcacacaatttccctgtctgttcatatcatgggggatttacagccagactagtaatgtcttattactttcacatcgcaaatttcttctctttctctatcaatatttgacatttgcacttaggttttaaacacatttgcaatgatttagacgtatttctgcagaaatgtattttcactcttctcatcaggtatttccagctcccagcacctgctgcgcactcccttccctggcctccctcagctggctctgtcgtagccttgcgcctcactctcgtgatggagccgcctgctacagacactgctcttgctgtctttcagtgtcagctcagctcagggttgaggccaaattcacagaacccagaggatggaaacagcagggaacgtcccggctgggttctgagaacagcctggggaccggctgcgatctctatcagtgctgggtgtggatatgtccgtgcgccaggatggcttggagagcagggtggagcagcagggccaagggaggctgacagtgggggactggtcactcatctccaggtccagacctccaggaggggctcctttggggtccttggtgtcccttcctgacgggcccggctgtttggggcacagagcaggacctcacagaatgggagccgagccagagcccgagctgtcatcatttgtcttctgcagcagtgctgggagttccctgtcctcatgcccactcctgacgttctcccatgtggattttaactctgccctgcatcttttgttttcttgcaatcccccgctatcccttccagctctctttttacctggtcctggtgccctcccactacagcctgggctctctatttcttccttattgaaaacagcagggcgtttctcgtgccctcccggccccccagggcacatcgagatgtgcactttccaggagtgtttgaatgctgctctctttgcctcattctgcatcttttgaacaagccccattttcatctctgttcatcaccaaatgaagtgggacctactcagacatggcccccactctcagccctctcttgtgggttcagatcgcctcctcatgccttcactgtgcaggttgacatgttcattcctcacaggttcccctgccaggccttggatagcctgaaccaataaaacacaaggaaaatgacaattttcctggaagccctggtcctgaggctttctgcctatgtcccctctccacctcccggctctcacggccccacatagactctggaccctattcacgaacagacagtgatggcattgcaagggtttgctgtctgcaggagtcaagattgtcatttgcagccttggtttcccaaccaaggcatcttggctcctacgtagggccttttggctcctctgttcccacagagtttcccttcttaataatctgctgccccagaagtctggctgctgatcccacacttatcagtgatgccctttctgagaatgtggacgaggccatggggagctgaactcacctggcaccaccagacttagccatgctgccagctcgtgggaagggggacccactgtgggcacagctgggacaaaacaatgtgcttacaatggaaactcctggctgccctctgctcctacctccttgccttctcctgcaacatgtgccccacattccagctgtgctcatgctgcccagatgacgactgcattttccagcctccctggcagtggatgaggctgagttactgagttccggccaacagaatgggagtggaagtgagtgtgcaaatcccaggagggcagggcagaaacatggccccttgcctgcttctcccagctggcccagtcctgtggagccaaggggcattggaggagcaacaagagcgaaggaggctgggtgccctgtactcagtctgctgtgccagcccaggctgctccctctgagaccatctaagcagaggaaaataaactgctatgttgtttaagccacaaagtttggggatttctttgttatagtagcctaactcatactctacctagtacagtgatcagtagatggtacttccttcctctctgtgtgccttaggggcaggcgggtgggtggcaccattatggctggagttcctgctctgcagccttccagcttccacctctattcctcaccgtggtgagtccagggcccatctccacctgctttttcagcttgcaggtcaacacagcactccccttccagccacagaaatcacagacggtcagaaaggtggtggcatgggggtctctgaggcaggagccaggccaggcactgtaacagactctcaacccccaccagggccaaggcaatgctgacattggggctgcagcaggaacctgggggtgccacacagctgggctctgcatcctgggctctgcatccagagtcacttaccacgtgccaccacgctgttgcccggggcctttcacactgctctgcagggcgaaggagctgaaatctagagaggtctaggacacacataaagagctggagcccaggatcaacaggcagtgcggccccattatccctgttccctgcactgtgctgtactctccacgactcagccaagacctccaggaggcacactcatcccggggaggtgcaccatatgtgtgcacgtacacacaattcaggtgcaagcctggaagcccagactgaggagaccactaagaccaccccttacacacactccctgccacaagacaacagcaggatgttgggacacacacccaggggaggtgagcagcgtgtccggccggtccttggcacagaaggtgcatatgctcccgaggttattccacgtcccatgtcatcatcctgaccagacaacaatcctccctgtccctctgacgtacctcttatctagggctgaactgcttgtttatggatgaagaaagcccatgttaacaaggctggaaatcaatgccttgcttccctagagtgtgtttgcccacagagggtacatccggtcaggggcaaaggacagaggtcactaggcccagcctcctcctcgggaccatggccagtcaggataggatgtccatcctcctatcagctgtgctgtgtgctgggcggctggtgagaacaacggcctctgccctctgagatgcacgacctcacacagacccccacattcagacatctctctgctgggagcccatgggtgccctacccccagcctccagatctccaaggttttcaccgagaaacacttgacccgacttgcatccagttcttataaagcaaaggatccttctagaaggttcttgcttcccactgcacatgactgggtgaaccagggcagccctctctgtgtgtgtgtgcttcataccagctgagccactgaagcaggccctggtcagcctccatttccttgccattccctgtggggctcatagcccctccttgtgcttgggcccccacttcccccaggctccagccagcacaggacgtgtggatgggtccaacctcaactgtgcaaccacacagcgaagaccccaggcatgttggggagttagggacgatggaggacaggacgtaactgcatatactggcctctccgagtctcacctctgcctgctcaggattcctaacactttcacaattacccacgccagtaggaaatggcacagccacgttcctaagggggtaaatactctgccaaggcacagcaaacatatagggcatgtgtaataggtttggtggactggatgggggtaggaagtgcaagaaagggtctccgatagcagagtaggtgagcctcgcaggactggccaggcctgaggcagcttcccacaggtgctgtcggaatgtgggctggatttgggtttacggagctccaggtcagggagccgggatgagcagaatctcagcagctggcctggagctgagctgtatgggaaccctaccctgctggaccggggctggaccccaaggggcctttctatccctccaaatacaaaacagagttccctgaactctgcgaaggtggagacatagactcggccccagagtcacctccacatcccggcaaagcaggaaaacagcacatgaatgccaaaagctgtgagttctttttctttttattggcaaagtaaatatatttttatgaaggaccaaagaaaatatacgtaattgtaacatatgtacaccagcttcatagatttttttaaatttcaaatttacacaaatgttgatatgttattaaaagatattttatgtggatggacctatgtacagtttatttacatacattcataggatgtgaaataaacctgtcaaaacaagctagttcatttattaatttctagacaaaataaggaatgcatttctaaatcagggttgggaggctctatctagttctctcacacccaggacagcctggccctctcctcccaaggccaccctaaaggctggtgtctggatttgtctgggaaaccggaggaggggacgagcccctgggtacaggcccttctggctctgtctgccctgcacatttaactcaagcacatgcactgccagccccctagtgggggacgcttttcacctctctcccacatgagggcccagcggcccggtcctgcccccccccccccccccccccccccccggctccagggacctgcccacaccctctggtgatcatgctgagcaggcatcttagacaaagccaccctcacaccacagtgcagccctggacttctggcctacttccttctcctccagcatgactctctctggaaacccaacatttcaaaactgcacatttcatcttcccctagcactaaagttctggccttggcccaggatgggggagcccagtgggagaagggccaggtccccaaaactctgcctgcaaccagcggctgcagcagaggcctggccaccgcgggaaggcacgaaggcacgaaggcacgaaggcctgcctccagccccgtgcgcctggggcccagcccccagggacgcgggttcgaggctctaagtactcccgagaaaggcagcggttggcgggccctgggttcacacctcccaggcttcagaaggtgggctggtaacattgccatgtccctctggaggaggcaaataaattattgcttaaaaaaatggggatggggtggggatccggggtgacggacaggctggggttcagggcgctttcagttcacggagcgcacggagcggctgctccgcgggaagcggtgcaccttgatgtgcttggagaggtggtcgctccgcgcgaacttcttctcgcacacaggacactggtacggcttcacacctgagtgcgagcgcctgtgccgcgacagctcgtcagagcgcgagaacctgcgggacatggcgcggtcagcgaggcctggccctgcctgcccctgcctgccccgaccccacgaagttgccgggatgcaaggcgtgcacctggcactcacccaaagggtggctgcgcagacctgcagcctctacaggattaggggagggtcccccatctacgtcggtaaggctataccagttctcaaaataccatttttttttctttttttgagacaggctggagtgcagtggcgccatcacagctcactgcagcctcccgggctcaatcaatcctccttagcctccagagtagctaggattacaggtgtgcccaccacacccagatagtttttgtatttttttttagagaccaggcctccctatgttgcccaggctggtgtcaaactcctgggctcaagcgatcaggctacttcagcttcccaaagtgctgggattaaaggcgtgagccactgtgccaagctgcccctgccacccctccaagatggaaagaactacagtaaaggctcatgctggcacagtgggcattctctgttgggaactgccagagcagctggtaaaagctcccaacaggaaaggaccccaatgctaccagggaccagggcttccctcccacagcccacccagtgtgcaggggtctctgaggccacaggtgcactcagtcgctcaggccctgatgctggctgcctctcaccaccctggcctcatctaccccactggaccagaactccacaggggcatctgtgaaggcctgtacaggaccgcccatccggaggggaaacggaggcctgggaggaggaagcagcacagggagagaggtcctcagacttgagtccacccactcctgaaaccagctgtgctggaagctgggccctctaaggcaggcccaaataaagattgaccctgcaaagtgtatctgggagttcaggtggctcccgacatttcgctttcttggccctgctggcctgggagcaggcactcatgtgacagtcaagagcccaagctgcatcgagggcctggactgcttgccaccaacctcagggatttgaggccctctccacccctggcttggcagcaggtccctcccaccccacctacccctcccacgacacactatcccgctctgtgctccacctgcattgacctttccttggtccttcttgccacaggccatttgcacatactgttccctctttctagaatgttcttccctccccctccttgctctctcctacccattccttagagctcagctcgaatgtcacttccttaggaaatccctccaggactgcatccaattctaggctcctgtggcattacacacctctctctcctcattcttgctgttgttttgattttaaattatcttcaactttttgatgactgtcagtctgtcccactagactgtcagctccatgacaaaggacatgtttgtcttggttcccggtggtcttcccatgaccagcccaatgcctggtatatggtaggtgctgaggaggtggatttcaatgcaagagtgggcacagcaagcagccctaggggggcagacactgtcaaggagcagtcccaaagcatgcacgcacacacacacggacaaatacatgcccacacatacaggcacacaaacatacacggacgaatatgtgcccacacatactcacacacacacacacacaggcacaaattcatgcccccatgtactcacgcacacacacacacacagggacacgaggcccaacacccctttgtggaccagggccacccagcgagaggcggtgcccagagcagcagttcccacccagcaattggtaagggctggtgatgccctggcgccctgaccctgtgggtggaagagcagaaggacccagcagaacatgctctggacaaggcacagggggtggcaggagggcctgcaggaggagacaggaactccgactcacatcacagagtggtggtggcaccaggcacagggcagtgctttcagcacatctccagactaggtgaagcccaactgccctgcctgtcagaggaggaaactgaagctcagggtgctgagggcctggtccaggtcactgacaagacagggcccctgaggctggagcagaggtcttgacacagccccctgccctggcaatggcagatgacctggactcccagtcagcagagccccccagcctcctgtacaggcctggatgggtgtgtgtgtcacagggccctgtgccagtgaggaaatgggataaatgtgccctggcagtcaaagctgacacctgtgctcctgggcaggacacctgcccccagctgcagctgggcacacagcttctgagcagaggagctggcccagggcaggggtaagcagaaagctgcagacacagagtgccacgcctcccaggctgcagccctggggtcacccagcatctcactggccagggaaccaggatgagccagccccattggactggcaagaccatggcaagggtttaaagaggccaagtcacacagcccaggggacagagtctcaggctcctgccttgacagttcccaccccactgggtgccctgaatggtcctttctgggcctcaatttcttcattcatccaatgaagactctggcattcctgcccaccttccaagactcatctcaaaggccacaggtggtgacgtggggccacacagatctctggtcatggtgacaccctgggaaggacaggcagatgagatagaaccaagctggacaacatgctgtcctcacctgaattccctccctgctgccacagggtcctggcacctgagaggaacttccctgggaactgagccctcagaagaccccctgcctcacccctgcatgccacattctcccaaacagcagccaacagagagccctggggactacagtgggggatgtgggaacccggtgggtaagatgcagcccttgtaggcagtaagctctgccacttaccaaccaggcaaactaggaaagtcaccaagctccctgagcctcagtttctctacccagacaaagggagaacaaaagacctattcctgaggactgtgaggattgtacaaggcaaccagtaacggtttagagccctgcttagcacgtggcaattattcaagaatgatgagctcttatcacctgcatggagttgagtgttgggcctggttcctggtgggtcctgctgcagacagggcagcactatgatttgtgctgagctgtagggcagagggtacacaggggtccagtgtctctctagagcagctataatgtcagggctggtgcatacagcacttctgtatgaaggcgtcccttccttgagacactaaccctcatccgccagacaacaccgcaaacagtccagtctcagaaactgcaatggaaatggtgctccctagagttgtgcagttcacaacctgcccaaccatactgggggcctctgcctacagagggaaggaggtcagaaaaagcctcaatgcagaggggtcatgagagcaggctgggagccagacccctaagtttgaatcctgcacctaccacctcttggctctgacgctcaagaggagcctggaactccccttctctgtcccccaccacatccactgtggacgacaaaagtacccaccctacaggctgatgacagttattcatattcatattcactgcagcagaagggattctttctggatggaatggcttggccattctggaacaggacgttctgctgcaaggaacaaaggatgcctatgtctgacagtgaggcaaggaaacttctaggaaggcaggcaagcagcacttcccagacggctggatcagaacagggaaagcctgctctcagccctgttgagggtgccaaaatcatgtcaccagagaagggacagggagtactcttaggaccaaaagcagaaggaagtggaggctgagtacctgggcaggtgacgacctcagcagtggagggagggcactgtccattacacagaggtatgaggggcctgaggggccctggcttgttctccgagcacaggacatggtactaggccagagccagcctgggcagaaagagcatcccattcatctaggccaccaggaagaagagacgcggcctgggagtggagagctcccccacggggagtaggtgagtgtgtagagctgccaccccaaagaccaggctgagctgcagatggaggtggaggttcccaacaccagagttagcacccaacaccggggtgcagagggaggtccctgattctgggcagacagcctcagctgaactcctggctctggggcttactggctggctgactggagaatttacctaactcttctgtgctttaattctctcctctgtgaaatagggacaacatgctgatgcctactaattttgagaattacgtaaattaatatgtgtgaattttgctcagagcagtgccaagtatgcattagaggccctggttattatctcgattgtggtcgttagctcttttcccatagcccagaagcataatgccttttgggccgacctcttggtgggagactggaggcacacatggcgactctgataccagctaggaccaccaggtggccagagcagggctctgctagggcttagtcatgcaacccagatccttgctcactagctatgtccctgtgggcatgtgacgtgagcagtctgtgcctcagtttccctctctgtaaaatgaagattggtgcctacactttaccaggcagttacaaggacctgatgagctaatgcgaaaaccttaagctgtcactacagcctcaagggcaggggtcatttgagacagagggcacagagagggcggatgcccacgcgggagcctgagccacagcagggaggccagcgtggctggatcccactcagtaaggggaagagacaggtaagcacattgtgtgggtctatgggccagaacgagaagcttgaatagaaactgaagcacagcaaagtacacttaaaggcctcagaaggtaatgagctccccatggcaggaagtatgcaagttacaatagtgggcggaggggattccagctctgagaaacttagaatagtgcccagcatacagtgagtggtcagtaaatacgccatctcaccatcatcatcgttacccttccagtcctgtccagacccagctgccccaaagcggggtccatcctccctcctgactgctgtaaggagctgcaggggctccctctcagttgaagactatcaccacattaagagacacaagcagactgggcacatccccagggtttcaagatccctgaaagccagctgaggactccccgcatcctcagaaaagcagccctccctagaggccggtgtcctcagctcccagccgaacagcgcctctgccatgagttaccccaccagggccagacccactccaggggaccttgggggaagctggaggagccctcaggaagcccggggcatggctggcagcagggacagctcctgggggcagtgccactgtgatctcactgggccaggcaaccactacaccttctcttgccaagtgggtcctgggcagcacgaccagtgccagggctcagatgtgtcagagctgaatcccctccacaggtccccactctctcatgtacaccccctgccatgaggaactcattacctcctgaggccactgtatagagaactaagatctgcctcactgagatacactttgggctgaggggcctatcagctctctggccctaagatatccaggaagaaggctggccttggatgaggaccacacctgccctccccatcaccctacccagcctcacggcatctagaggagctac

SEQ ID NO: 425 - DNA, 40001 bp, Homo sapiens
gcatctttagcctgatcatcttcgccaggctgtttatctccttttgcttggctgagaagtcttaataggaggcttattcccagctatttggggacatagaagcagttagccattgcttatattttactgaggtctgtgtggtatgttgattgtagtcagttaacgattttgagaactgaaggcagcctggtatatatagagtaggtattagactgtgtttcttctaattgaatttcccatctcttgtaatctatgccatcatcttctgtactgctgagaaagaaagaaagtttctaatcaaactataccactggttgtaagatgcagtttggctttagtgatgttaacacatgattcaaacgtgaaattgattgagtattggtgaaatacagaggagatttaaagccagaagacctgggtttaaatgctggctgtatgacttcatatctgtgtgatcttgggcatgtcatggttggcacttcaatttcttctctctataatgggggaagtgaggccagtcatggtggctcatacctataatcccagtgctttgggaggccaagatgggaagatcgcttgaggccaggagtttgagcaattgggcaacatcgtgaggccccgtctctacaaaatattttgaaaaaattagccaggcccagtggtgcgtgcctgtggtccgcgccactcaggaggctgagacgggaggatcctttcagcctaggagtttaaggctaaagtgagccatgattgtgctatcgtactccagcctgggcagcagagcaagatcctgactctaaaaaaaagtaaaataaagtaaaatgggggaaatgaactgctttagtaacatcatctgttttttctgtgagcagcgtagcttgacagccattggtgaactcgtgccctgtgcttccctgtccagatccccattctgcccgcaacatggagtataacggtttattcatagtagtcgagaaacactcactgaatgaatgaatgaggtgtagaactaagtggagtgggtaattcaacacatattaatttccttcttttttttatttttagaaagaaagaactttcagctaccaagaaagaccgtgtgaatcattgtctgacaatatgtgaaaacatagtggcacagtctgtcaggtaattgcactttgaactgtctagagaaaataagaactttgtatattttcagtcttaatgggctagaatattctttgtgtcccagctattttaaatggattcagaaatccatttaagatgaagaaggacccttttcccatatttctggctatatacaaggatatccagacactgaaatgaataatgttccctttttgtaatcttttatgcaaaaattaaaaccattatggtaattgaacaacatgtttatgtttagttaacacccttagcaactatagttattttaaaaccatctatggtttgatatttttgcatttgttgcaatagtaggaacagcacaagacagttcagtttgtctctcttatttgctttttcttggcagtttgctgtcctattgtacctctgctcctagcagtggctggagcccactcctctgtgcttcgggattagtggggatcgtggggcattgactgtaggtcagctttccttgcttgatctttctcactgggatgaactagcagcaccttcttttgtagctgctttgcttttgactatctttctgaccgttgttcctagtagctgtagatggtaaatatatttaggcctgtttccaatggctcagtaggagacatattcacctatgatatctgaattctgttacccacatgggcatgcgtgaaatagttgccttgccttactttcccttggaataaataattcatgttattctcctggtagaagctagaaaaagcctttatagtcagtcagaaaaaaatttttagacaaataatcttgattttagtactgacaaaaacgtgtggtgattctttttttaatttttttttgagacggagtttcactcttgttgcccaggctggagtgcaatggcgtgatctcggctcactgcaacctctgcctcctgggttcaagtgattctcctgcctcagcctcccaagtagctggagttacaggcatgtgctactgtgcccagctaattttgtatttttagtagagatgttggtcaggctgatctcgaactcccaaccttaggtgatctgcccgcctcagcctcccaaagtgctgggattacaggcgtgagccagggcgcccggtgattcatttgttttttcaaaaaatttcctcttggccattgcttttcacttttgttttttttttttttttgagacggagtcacgatctgtcacccaggctggagtgcagtggcatgatcttggcttactgcaagctctgcctcccaggttcacgccattctcctgcttcagcctggcgagtagctgggactacaggtgctcgccaccacacccggctaattttttgtatttttagtagagatggggtttcaccgtggtcttgatctcctgacctcatgacccgctcaactcagcctcccaaagtgctgggattacaggcgtgagccaccgcgcccggccctctcttgtctttttattgtggtaaaatgcacataaaattgactgtcttaaccatttttaggggtacagttcagtatatatattcgtaatgttgtacagccatcactgccatctacttcataagtttttcttctgtcaaaactgaacatctgtcttcattaaactccctatcatccattctttcctgtagtccctttctactttctgtctgtatgagtgtaactgctctggagacctcatgtaagtggattcctacaggatttgtgttttttttttggtgatctgcttatttttaatgcctctgtgcatttgtattatatactttcaaagtgatttcacaaaaccgtttcattttaggttaactcatttctgttgtttgtgaaatactgtgtatgattctgttctgtttctgtctaatttgtggaaatgttgtgggaagaaaatgaaataacaaatgagcatatgtcctgaaaataaaaatataaaaattctaagttagcatgctattgtagaatacaacgctatgataaaagtaggaaaaaaaaaggtttgaattctatctctgctacctgtgtaagctgggtgactttagataagctgtaacgtgtttgagccttactggctcatttttgaaatgtaatccctagttacacagttcttgtgggatcagatggtacatgtgaaacactgtgaaaaagcaactgcatagatatgttcattagccacctgagcgggaagcgtatcccattgcgatgcccatcatccaaagctatatgttatctttacttttttttttttgagacagagtcttgctctgttgcccaggctagagtgcagtggtgcaatctcagctcactgcaagctccacctcccgggttcacgctattctcctgccccagcctcccaagtagctgggactacaggcacccgccaccatgcctggctaaatttttgtatttttagtagagatggggtttcaccgtgttagccaggatggtcttgatctcctgacctcgtgatccgcccgcctcggcctcccaaagtgctgggattacaggcgtgagccactgcccctggccatctttactttttttgtgaaatgactttaaatacttggcaaacatttggtcattgttcatctgatctccaccatccaggtctcagagaacataatttctctctgaaagcttattgacccaggaaataagatctctttcaatctgagtgcgtcaggctttattcttgtcattttgtcttttgataattttcaaatggaattcatggaatgttggcttatattcatatattagtaaagtatgttgagacatcttaagattgatttgtggttctatatgccatattaaatcaaaataatagctgttaatggttttcacattagtctgtctcttgtttttatggagtaatgctgagagttcattatgcttgttctacagaagagcatgttaaaaggagtttttggagtcagagaggttattcttggtttcataggatacactctatactttttagggatttcagagtatatagctgaaggtgatattttatgtaaatatgttttatggaaacttattgctcatcgctgtttcctgttaactctcctaaaatataattaaacttttggaacttttttatagcttttgtgctagactaatttttgtctctaatgaggttatataaatggcagcttctgacgttttcaatgtaggaagtcatttaaaacttcatgtatattgtgaaaatgtagtctgctttaagctctctaaagtggtctaagttactggttcctaagtatggatgagcatcaaaatcatctggaaaatttgttaaaaatacagtaatgaaggcacctcactgtcctttttcccaaacatacttctgcattctgtttgagtaggtagggactacacatttttcacaagtatcctcttgggaatacccaggaatgcttacttgagcaacctcttactaatatgtaccttgataaggtggctaggtaaacataaatatacaaaaatccatagatctcccatatattagcataaatcagctagaaaatataacgtttaaagatctagttcacagtagcaccaatatatcgaactctaaggaatcgataaatatgcaaaaactttataaaaacttctgttaatgtttctgaaagatataggtgaccactttctagataggaagattttatattactaagttgaattttctctaaattaacacagaaatttaaaataatcttgatcaaaattctagtagaggtatttttgaacttgttcactgcaagaataaatacataattgcaaagaatatctcaaaatcatcaccaggcctggtgtggtggcccatgcctgtaatcccagcactttgggaggctgaggcaggcagatcacctgaggtcaagagtttgagaccagctggaccagtgcggtgaaacactgcctctactaaaaatacaaaaattagctgggtgtggtggtgcatgcctgtagtcccagctacttgggaggctgaggcaggagaattgcttgaacccaggaggtacaggttgcggtgagcctagatcgcaccactgcattccagcctgggcgacaagagcaaaattctgtctcaagaaaaaagagaaaaaagaaaaagaaatcaacactaatatggtgagacttaatgtatgtgacattaaaatagtgattggatgttaaaacaggtatagaacagaaagaagagtgtatgtgtgtatctgtatgaatttatgatgggtgtaacatatatgtattagggaaatgagggaaatgatacatttctctgactttgggagaacattatatctctacctcatattgcaaacaaacataaagttcagattaattacctaaatgtgaaaaaatgaaataatttctttaaaaaatgtaatcttagtttgaggaaggttaacattataaaggaaaaaactgttttgagtggaatatagttcaatatgtcaaaatccaccttcaacaaaattgaaagtaaattgaacttggggaaagtattgacagcatatagatcaaaggttactagcctgtgtaaagagcagttataaatatcgttaagaaaaacactgtcgacctgtcggcaccttgttctccgactcccagcctccagaactgtgacgagtaagtgcttattgtttaaaccacccagtctgtatgtggtattttgttatagaaactcaagctgattaggacactagtaatcagtagactgaaactgaaacaaaaataagaaccttttttacctgtcaaattggcaaacattaagaatattcagatttttgtcagaggtgatacaaccttctaagaaggcaatttgggaaaatataaagctttagattattatatgtctgacctagcagttttacctctagggtgcttacccctaggaaagtgtgtaatgatattggtgcagtgcccttcatcccattagaaaattaaaaataaccttaatggcctaccactaaaaggggattgaaaatttaagatatatttatttatgtgtttattgagatggagtcttgcactgtccgcctgggccagagtgcaatggtgcgatctcggctcactgcaacctctgcttcccgggttcatgtgattctcctgcctcagcctcctgagtagctgggattacaggctcacaccaccgcacccggctaattttttgtatttttagtagagatggggtttcactgtgttggccagactggtctcgaactcctgacctcatgatccgcgcccctcggcctcccagtgttgggattacaggtgtgagccactgcgcctggccagatacatttatacaagagaatgttagttaacattcatagatatttatattttgtttactttttattaaaaaaattttttttagagacaggatcttactctgtcacccaggcaggatgcagttgcacaatcatagcccactgcagcctgaactcctgggcttaagtgatccttctgcctcagccttttgagtacctgggggactttaggcagtgctactatacctggctaatttttaaatgttttatagatgagatcttgctgtattgcccaggctggtctagaattcctgggcccaagtgatcctcccaccttggcctcccaaagcgctgagattacaggcatgagccaccacttctgaccaatagatatttatatttgtgactggaaaatatattaacaatgtgttaaaaaattcagttaaaaaataatgaaagatttttgcttctggctaagatagaataacaaggacagcatttatcttcttgccttgaaatagttgaaaacggaagaaatatatgtaacagtggttttcaagttattgggcatcaggcaaagaagaatagttatcccaggaaaatgaatgtggagagccctacaatttccttacattactgcctggtcatggcaagaggaaaaactgagaggagactgaggctgagccagtggtttgctgggttgaggaggcagagctgggagtgcagagatgcaaggtggtgagagcccatatggaagaataccagggaagagagctgcagagggagctccggagacctgcaccctgccctctcagtaccctgtcatgtgtgtagctgagtactgacgagcacttgcttgtgcggaaatgacccagggctggaggtagagccacctgaaaggattagaaggaacagttgctgaaagtcacacagggccaggaagaatttctaatcacaccagttggagtggaaaacctcagctctcatagagcaggtagggtactcagaagggtttgcccacctagccccagactaagtttcgttactctgaccctacctaatattaaaaagagattaattaaattgttcgcaacaaaaataatatatttcagtgtttgtaacacgtagaagtgaattgtatgacaatagcataaaggctggaagagcagaaattgacatgtatttgcgctgggcagaataatgctcccctctttccccaaaagatatcaagtcctaatccctggagcctgtaaatattactttatatggaaaattgttttatgatgtgattaaattcaggatcttgagatgagggggctatcttggatgatctgggtaggcactaaatgcaatcacatatatataaaaaggaggcagagggagattttacacacagagagaaggccctgtgaagatggaacagaaagatttgaaggtgctggccttgaaaattggagtgatgaagctataagccaaggaatgcagcagccaccaaagctggaagaggcacggagcagttctcatttagagcctactccagagggaatgtggtgctgccaattccttttttttttttttttttaagatatcatttacccctttaagttggttttttttttttttttttttttttagtatttattgatcattcttgggtgtttcttggagagggggatttggcagggtcataggacaatagtggagggaaggtcagcagataaacatgtaaacaaaggtctctggttttcctaggcagagggccctgccacgttctgcagtgtttgtgtccctgggtacttgagattagggagtggtgatgactcttaacgagtatgctgccttcaagcatctgtttaacaaagcacatcttgcaccgcccttaatccatttaacccttagtggacacagcacatgtttcagagagcacggggttgggggtaaggttatagattaacagcatcccaaggcagaagaatttttcttagtacagaacaaaatggagtgtcctatgtctacttctttctacgcagacacagtaacaatctgatctctctttcttttcccacatttcctccttttctattcgacaaaactgccaccgtcatcatggactgttctcaatgagctattgggtacacctcccagatggggtggcggccgggcagaggggctcctcacttcccagatggggcggccgggcagaggcgccccccaacctcccagacggggcggcggctgggcgggggctgccccccacctcccggacggggcgggtggccgggcgggggctgcccaccacctcccggacggggcggctggccgggcgggggctgccccccacctcccggacggggcgggtggccgggcgggggctgccccccacctcccggacggggcggctggccgggcgggggctgccccccacctcccggacggagcggctgccgggcggaggggctcctcacttcccggacggggcggctgctgggcggaggggctcctcacttctcagacggggcggctggtcagagacgctcctcacctcccagacggggtggcagtggggcagagacattcttaagttcccagacggagtcacggccgggcagaggtgctcttcacatctcagacggggcggcggggcagaggtgctccccacttcccagacgatgggcggccgggcagagatgctcctcacttcctagatgggatgacagccgggaagaggcgctcctcacttcccagactgggcagccaggcagaggggctcctcacatcccagacgatgggcggccaggcagaaacgctcctcacttcctagacggggtggcggctgggcagaggccgcaatcttggcactttgggaggccaaggcaggcggctgggaggtgaaggttgtagtgacccgagatcacgccactgcactccagcctgggcaacactgagcactgagtgagcgagactccgtctgcaatcccggcacctcgggaggccgaggctggcagatcacttgcagtcaggagctggagaccagcccggccaacacggcgaaaccccgtctccaccaaaaaacacgaaaaccagtcagacatggcggtgcgtgcctgcaatcccaggcacttggcaggctgaggcaggagaatcaggtagggaggttgcagtgagtagagatggtggcagtacagtccagccttggctcggcatcagagggagactgtgcgagggcgagggcgagggcgagggaattccttaatttcagtttagtgatactaattttggactctggcctctaaaactgtgaaagaaaaaattttttgtttgtttgtttcttttaagccacatagtttgtggtaatttgttacagcagctgcaggaaactaatttatgctgcatgtgaaatggtgtaataaggtagattgtgatgaagatacatagtataaacaattaagcaacaactaaaagcacaacaaggaattatagctaatgaaccaaaaaaggagattagaataataaaaatggtgaatcccaaagaagccagaaataggggaagaggcaaataaaggaaagaaagagcttgatggtagatttcaacctaactatgtcaaaaaggacattacatgtaaaaggcagcgatttttcagattgaatggaaaagtaagactcggtatatgctgctgcctgcaagaaacacattctaaatataaaggcaaaaataacctacaggtaacagaacggaaagaagttcactgtgcttacaagaattagatgcaagctagactggttctgttaatatcagacaaagtggatttcaaagcaaaggctcttgcccaggatgagatggtcatttcataatgatgaaggggattcgttcatcagcctggcatagcaagctgaaatgtttatgcaccggactacagagctaaaatacatgaagcaaagcctgacagaactacaagtagaaacagacaaatccacagtgatagagatttcagtagccgctctcaatgatttgtagaacacgtagccataatatctggatctagaacacttgaccaacactgtcccctgtgcaacctcattggcatttacaggacactccacccagcaccagcagaagagacactctctcaagtgctcacagaatgtttgccaagatagagcagatgctgggccataaaacaagtctctaaattaaaagcattcaaattattcagagtatgttttctgacctcagtatcattaagttggaatatattataggaagataacctggaaaagcctcagatatgtggaaaaacccatttccacatggcccatgggtcagaagtgaagtcaaaagggaaatttgaaagtcttttggattgactgatataaaaacaatagatttctaaacttgtggggtgctgttacagcatagtaaatggaaatttctagcattaaatgcctgttttaggaaagaaagatttcaaatcaatgacctcagcttctacctttggaaacttgaaaatgacaagcaaatggaatccagagttaccagaagggccaggtacggtggcttatgcctgcagttctgccactttgggaggccgaggcaggtggattgtttgagactggcagttgaagaccagcctgggcagcctagggagaccccatatctacaaaaaacaaaaaaattagccaggtgtggtggcatgtgcctgtagtcccagctaaccaggagtctaaggtgggaggattgcttgagtctgggaggttgaggctgcagtgaactgtgattgtgccactgtgttccatcctgggcaacagaatgagaccctgtctcaaaaacaaaaacagttactagaagaatggacatcataaagataggagcagaagtcagtaaaatagaaaacaaaaatacataggaaatcaataaaaccaaaagctggttcatcaagaacatcaataaattggtaaagctgataggaaaaacagtgaagtcacaaattagcaatatcaggaatgagggagatgacagtagtatagattatatagatattaaaaggactgtatgaggcaggtgtggtggttcacgcctgtaatcccagcaccttgggaggccgaggtggacagatcacctgaggtcaggagtttgggaccagcctggccaacatggtgaaactctgtctctactaaaaatacaaaaattagttggtcgtggtgctgtgtgcctgtaatcccagctacttgggaggctgaggcaggagaattgcttgaacctgggaggcggaggttgcagtgagctgagattgtgccgttgcactccagcctgggtgacagagcaagactccatctcaaaacaaataaataaataaaaaggactatatggtaatattatgaacaactttatgccaataaatttgacaacttatagatgaaatggatgagttccttgaaagacacagaaactattaaagctctctcaagaagatatagataagctgattagccctatatctattttattgaatttaaatgtaaaaatcaatatttagttactggaaaacttttaagtgtggttggaaatggtatacgaactttttcaactgaattttatgaagtctaatcacaggtaaaggttttctgatgaaaatttagtgtctgaattgagatatactgtaaaaaatgttatatatcttaattatttcttcacattaattacatgttgaaataatactttgggtgtattgggttaaattaaatattatgaaaatcttgcctgttttctttttacttttgatgcgtcagctaggaaatataaaagtgtagctcacattctgtttctgttgacagtactgctttggagcacagtgtttgaatgatctatcatttcaaagacctttcctcagttcgttattcatggctgtctgtattccacatagataaggtctgaaatactgctaagtggcatgttttgttttatgcttttataagtttgttgatcattactgatgtggacttttggtgcctcttaggctcattgctatcttccaaccattgtttgcaatttttacctagagataaagagaaagagacatttggtttcagagtagttagattgggatcatgaaagagcaacctcattttgatgcttcaaaaatagcacatcccccgtattactgggatttgctattcttgggattacttcaagaacatccttgtgttactggtttggatgcttctgaatgctgtgaagtcagtttcatgtacatggctcatcagtttagctctctcttggctttgtttagacagttggagcatgatggcctaaacagcttctttcaattaaacattttaaaatagtttacaaatagtaaacaaactccagtttttgtgactctttgtctcgcacaacaaaaacacaatctgaccatgatcatctggcatcttagggtgaaatatggttatactttggcccataccgaaagcaagattaaaaaggggcaggagagatagactgctgaactgattttcaaggttccaagaatattgtaggttaagagtaaaagtaaacttttggtagaaagcagtgggttgtctaggattgaagtatctgaagtttttaaacgaaaatttaaaaagaaaaatgagaattgccttacaagtacaatctcttcttttttaaaaaataaactttattttgaaatagttttagatttatagaaaaaaattagatagggtaggaagttttcatataccctacatccagttaccccagttattatcatcctaatttagtgtgagacattttcatgtttaatgaatcaatattgatatgctattaacttaagtccagactttattcagattttcttaatttctatgtaatgtcctttttctgttccagaattccatgcaggacaccggatacctcattacatttcattgtcatgtcaccttaggctcctcttgacagtttctcttctttttttgcttagaaattctccagaatttcagaaacttctgggcatcgctatggaactttttctgctgtgcagtgatgacgcagagtcagatgtcaggatggtggctgacgaatgcctcaacaaagttatcaaagtaagaaccgtgtggatgatgttctcctcagagctatcattgttgtaggctgagagaagaagcgatcattgagtgttcttctgttttgagtccctgaggatgtctgcacttttttcctttctgatgtatggtttggaggtgctctgttgtatggtttggaggtgctctgttgtatggtttggaggtgctctattgtatggtttggaggtgctctgttgtatggtttggaggtgctcttgtatggtttggaggtgctcttgtatggtttggaggtgctctgttgtatggtttggaggtggtcttgtatggtttgcaggtgctctattgcatggtttgcaggtgctctattgtatggtttggaagtgctcttgtatggtttggaggtgctcttgtatggtttggagatgctctattgtatggtttgcaggtgctctattgtatggtttggaagtgctcttgtatggtttggaggtgctcttgtatggtttggaggtgctctgttgtatggtttggaggtgctctgttgtatggtttggaggtgctcttgtatggtttggaggtgctctattgtatggtttggagatgctctggtatctgcctgcattgcttgccacacctgcccggtcagaaggcgctatgttgacaattgtgcctgcacggtgcctaggtcaatgaagggaaccgatggtagccactggatgctcctgggaaaatgtcactacaggcaccagagaagccagagctatgcccaaatttctatgagtctcagttttcttaaccataaaatgggatcaatgtttttgtggcatgtgtatgagtgtgtgtctgtgtatgtgtgaggattaaattgtgtatgtgtgaggactaattgccactactggatcctcaaagtggtaagaagtgttcttattaataatgacatccttacactcttacccagcaagattgatgggtgtggcactgcttctctttttccatcacatggtttccatggtatccttttgcccagggaatctttgctttgtggctagcactttgttgtttggctaatcacgctttctgtggtcaggacgctggcttctctggagccatgggattctagctccctgtcttgtccctagagtggtcactgtcttctctctccgcttgcaattcctgctttgctcgcatctcacttatgcagtgacgtatatcagtttcaccttgttctccgtgcctgctgatcattggcaccacttgcatggtgccatttagggcctgcttccagttaagcttgcttctccacaggcctaaatatccttgcttgcttcttttattctcactggcaggaccagggcggtctgtctttgcatgagacagggtctcgctcagtcacccaggctggagtgcagtggctgatcacggctcattgcagccttgagctaccgggctcaagctatcctcctggcttggccccttgagtagctgggactacaggcgtgcaccaccatgcccagctaatttttaaaattatttgtagagatgggatctcgccaggttgcccaggctggtcttgaacgcctgggctcaagtgatcctccctccttggtttcccaaagtgctgggatcacaggtgtgagccactgtgcctggcccttgatgtttcagttcttgatatttgatcctcagagtcagaaaatctaaaaagagggctatcccaggttgccttggttcatggcaaatgggacgttaagagggcagagagaatatgaacagaaactgttctaatattggtcatttaatgtgtaagtattgttcttttttaaacctccttcattttttttccaggaattgctggacacagtggcttggtgtgtgtctgaggactgtaggccatggccctaggttgtggttttaggtctcaggtgctcttcctggctgtctccttgcttctttcccatgtcctcttctttgtttccagccatttctcccttatgcttaagtttggtgcagcagggtttggctgctctcagattcctgcttcctcagatgctgtagttgtcaggcccagcgggctggcagcgggatcaggatctggctaggtttgctctcactgtggcagagtagggggaggcgtgggagagcacgtgtgaccccaggccagctgtagggagcataggcatggtcacgtagccttcaggtcctagactttgtcttctcatgagtatggctgtgtgtgtatggtgaaaactaggttctacttagcccaagaaaatgggcacattttgcatgtggtttctgtagagaaatgcactgggtatctgacatagcctggcagcatgcctccctcaggtaggttagtctcaggcggtgaagcacgtgtgtccagcaagaacttcatatgtggcataaagtctccgttctgtgaggtgctggcaaatcaccaccaccgtcaagaggctgaagtgatttttgtctagggaggcaggaaaggcttcctggagtcagcagccagtaggtgaaagagtagattggagaccttcttaatcatcaccgcctcttgtctcaaggggtgccaggaagctgtggaggctgaacccatcttatgctgccagagagtgggacaccatgagggtcaggtcaaggggttgtaccttgtttggtagagaattaggggctcttgaagactttggatgtggtcaggggagtgtatcatttaggaagagtgacccggtgaggacgtggggtagaggaggacaggtgggagggagtccaggtgggagtgagtagacccagcaggagtgcagggcctcgagccaggatggtggcagggctgtgaggagaggcagccacctgtgtgtctgcggaagcaggggcaagagggaagaggccagcagcgtgctgccatcacccagcgactggcgtagattgtgagagaccattccctgctcttaggaggggctgagttttagttttctcttgttatacaataagcttggtatttgtttacaaaacatttgtaaagctaaatcaaggtttgataaggcttctagttttatttaagaagtaatgttgaaataaatgtttgtccaattcgctttgctcatttaaggactttcagtacaaactgcaacaacaggattaggatttaaacgtttctgagatgtttttactcctcagaatttcccagaatgtgatctggttttgattttcaagcttgctgacccaataggttaacccacaagttttacgaagaccatctcagtccacttacatcaactgcccatgccacggttaaagagatcatcgactgatgtttggcacagcttcctccctcttgggtgggcaagcatttggaagagaaggctcctatgggtgagagtggggcaccaaagtcttccctgtcccatcccctagcttgagaagcccttctctaatgtggactttgtgccgttagcatcgttactagcttgaagttgaccatctggacgtactttctggtttagcctcacaagtgagcaaggagggttgagagatgtgctgtgaggaatgtggggccccagctggcagcaggctctgggtcaggggggcagggaccacgggcatacctgacagtgaggaggggccacacctgcagaaaaggatgcaggactccgccttgggaagtgttctaggccagagcgagggtctgtggtttataagtacacccacagtgctcgggaccctgcagatgtccagggtgccgtctgagcccgtatcatccaacagaatgttctgctagtgaagattaaagatttactccaggggctttaggatttattatatatatataaatcctatatatataattttttttttttttttttttgagatggagtttcgctcttgttgcccaggctggagtgcaatggcgtgatcttggctcactgcaacctccgcctcccgggttcaaactattctcctgcctcagcctctcgagtagctgggattacaggcgcccaccaccacacccggctaatttttgtattttttagtagagacggagtttctccatgttggtcaggctggtcttgaactcctgacctcaggtgatctgcccgccttggcctcccaaagtgctgggattacaggcatgagccaccccacctggccaggatttattgtatttgaaccatctaccattttaattttgatgttatgtagtatttgatgataatgaaagttaaattgtttttctttccatttttctgtttaagtgaatgacctgtatctagtttattcagtaacttcctgcatatatttgtttctttcattcttaatgaatatattcttaatttagttgctattatgttttgctttgccccaaaattgaaatcttagtttccttttagctcgttttagaactagtgatgggatgtgtcttccataaatctcttgtgatttgttgtaggctttgatggattctaatcttccaaggttacagctcgagctctataaggaaattaaaaaggtgggccttgcttttcttttttaaaaatgttttaaattttaaatttttataggtacacgtattttgtaggtacatgtaaatgtatatatttatggggtacatgagatattttgatacaggtatacaatacataataatcacaccatggaaagttggatatccatgccctcaagcatttatcctttgtgttacaaacaatccagttacatgctttacttattttattttatttttgagacagagtcttgctttcacccatgctagagtacagtggcatgaccttggctcactgcaacctccgcctcccgggttcaaccgaactttgggctggtctcaaactcctgacctcaggtgatccgcccgcctcggcctcccaaagtgttgggattacaggcgtgagccactgtgccgggcctgattgtacattttaaaataactaaaacagtcagggcacagtggctcatgcctgtaatcccagcattttgggaggctgaggcaggtgatcacctgagatcaggagttcgagaccagcctggccaacatggagaaaccctgtctctactaaaaatacaaaaattagccaagtgtggtggcgggcgcctgtaatcctggctactcgggaggctgaggtaggggaatcgcttgaacctgggggtggaggttgcagtgagccgagatcacgccactgcattccagcctgagcgacagagtgagactttgtctcaaaaaataaaaatgaaataaaattgggccgggtgtggtggctcacaccttagtcccagcactttgggaacctgaggcaggtggatgcttgagaccaggagtttgagaccagcatgggcaacatggcaaaacgctgtctgtacagaaattagctgggtgtggtggtgcacaactatagtctcagctacttgggagattgaggtgggaggattaattgagcctggaaggttgaatctataggtagctgagattgtgccactgcccttcagcctgggcgaccaagtgagaccctgtctcaaaagaaaaacaaaaaaacaaaaaacaaaccactattatcgactatatattattgtctatgatccctctgctgtgctgtcgaataccaggtcttgggcccttatttccatcactgagcaaacttcactctgttaagcagcaggtgtgggatttcatcgttattcagtaattcacaatgttagaaggaaatgctgtttggtagacgattgctttacttttcttcaaaaggttactctttattagatgagatgagaattaaaaatggtaacttactttatatctttataattgaagcccactagaccttaaagtagttaccagatgttttatgcatttaaatggccttttctctaaaattagaaagtaacaaggaaagaaaatgcttcgtttctatgcaaccctcttggtgactagtatgtgactcttaatgcaaccctcattgcaccccctcagaatggtgcccctcggagtttgcgtgctgccctgtggaggtttgctgagctggctcacctggttcggcctcagaaatgcaggtaagttgtacactctggatgttggtttttgtcgggggccagctgctactgatcctttatgtctcagctcagatgtcatttcaaaagtctgctctgccctctccaaattgcagtcgaccttgccctgtttatgtttccctcatagcactaatccatgtcagaaattgtcacgtacagtctatctgtgtgcttgtttattttctatcccacccttccgcaagagacttatgggatgtgtgccccaggacagcaggggtcttactgtcttatgctctgttgcagcccagcagcgataacagtgtctgcacatagtacttgcttaaaagatacttgccaaattgttgaaggttgaggtaccaatttcattattgctgactataggagttatagcaaaatatccatttgtctgttacatgagttaaaaatatggttgttgcactgtgaatagtttggtttagtcaaaacagttgtatcttaacggattgagaaacaaaagcaggaccacttttcatcagctccctccttctccttaaccagcaatacatgctgatgctgatatcccatagaccctcagctccatcctgagtcactgggaatgtggtctaaaccctcactattaatatgaactgagtttcaataagaatcttatatgggtcgggcatagtggctcatacctttgatcccagcacttcaggaggccaaggcaggtggattgcttgacccagactaggcaacatggtgaaacgccgcctctacaaaaaatacaaaacttagccaggcatggtggtgcgtgcctgtggtcacagccactcgagaggctgaggtgggaggatcacttgagcctgggaggtggaggtcgtgttgagccaagatcgcaccactgcactccagcctgggcaacagagtgagacctgtctcaaaaaaaccaaaatccagaaaagaacttatatggctgcagaggtataatcactaaggaaatttccttttgtataatcttttttcttttactatcatttaaaaaaatgtgttatatttctgaagcaacacatccaggttctgcacatagcagccaaagtgaccttaaagaatataactgggtcttgtcattcccttatttaaactcttgtacccatttcccagtgccgtttagatagagattccagactcgtcaatggctctgtcacctcagacaccctgcattgactcattagtctgattagagtcaggtttttcttcctcctgatggtttttttttcccccttagttctcagcggaacagtcacttccttagggaggtttccccagccaccctctgaggccgtgcttgttgccagactctgccactagagggcagggctgcaccactcctggcacctcgcacccggcctgccctgtcactctgtgtgttgggtgaattcctgtgatctgtgactcactgctctgtgtcctacacattcggcttttcttctctccccacaaccccattttataattctcctttttcaggaaagctttattcccatttaaaaatttttgtttttaaaatggtattttcttacacttattttctaattaaaaatgagtgttttaagaagtattatgatttactgcaaataatttttaaacccagccttttagatcctctgtgatcataagagaaatgaaggatgtctcccaacacttgagcttcatccacatttcatcctcctgttctttcagctgagttttccccatcccattagggactgttggaatataaaactggcttttccctaacagggaatgaattgcttctgtttctcctgaaggagagctggaagaatgacttgcgttcttttgcatacacaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggtatgattgttgcctcaggtcacaaacatgcgagtgatgctgtgagtgagtctgtggagggtgagggcttctgaacagggagtcctgtgggagtgcttcttggggtatgttgtatgtcgtaatttagactaccatcatttgtgttatttttgaggcacctaaggacttctttccacttctcatttcttactgtggggtgaagagttgaattgggagatggtttctagatgcaaattgaaaaggcatttttccagagcagatttgttttcggcgtactagagtgactctttaacctagctgcgggaagatgactgtgccaagactgcaggtaggagaaagctcactgacgaggccttgtgggtctgaacgtcctgcagctatcagagcctgttggcttcctgttgtgcattccaacaaatcatcttcaaacccactttagtgttttgtttataatgtccagaaatagtgaccctgtcacatgctctacagattacaggattcttagcctcttcctttttggtaggtcagtcctgggtttgagcccaagtgaccctcctgggaggtgatgatacacactgggtagagtggaatcagatggacttggattagaattctgtcctctttactagttattttcctctaggcaaactgcccaacagctctaagctatttccttcgtattctgaaaaataagccttaatgggacccatatagggcaactctgagagtaaaataaaggaatatgtgttagagtgtagcatagtcacccacgggaagggcttagatgttagctgctactgctcttattagctgaatgatttggaataaactgttagcctctctcatgttttttctcttgagcttcgaagttttcttgttaatactaaggagatattcaaactagtcatggggttttggaatgacgaagggagatgatgaatctaaagaatttagtgtaatatttcttcatgctcagtaaatggtagtttctgctgctgttatttttattaccatctctttggaatgggagtaggtgctcctttgtggtcagaggctgtgagagctccacagcgccagtttgcccatctgtacactggggtctgttgaaggcagtcccctctgtgatatctctggctgtcagagctcagatgatagatggtatttttgtactcttagttctcatcattttcatgatttcgatcaccatttgagtatgatgatgctaacactttgttgaacgtagaatccgttaattacttccttcctgaacctttggcattaaaaaaaatctattctgctacctctctgctcatttatggttattcaaatttattatcaagagcctggtacagtggcttgtgcctataattgtagctacttgggaggctgaggtaggaggattgcttgaggccaggagtttgagaccagcctgggcaagatagtgagaccctatctctaaaaaaactgaaaaaaaattagctggacatgatggcatgtgcctgtggtcctagctactcaggaggctgagacaggaggctcggttgagcccaggagttggagttcgaggctacactgagctgtgattgtgccaccacactccagcatgggtggtaaaacaagatgccatttcttaaaaaaaaaaaatatatatatatatattatcaatgaaattcagtagtaccaacaggattataaacaaagatagtagttcccttcctactttttctcttaatccttgtgtctcacaggcaaacataactcttagtatttcttccaatatttactttcatgtttctttctttctttctttttttttctttgagatggagttttgctcttgttgccaaggctggagtgcaatgacgcaatcttggctcaccacaacctctgtctcccgggttcaagcgattctcctgcctcagcctcctagtagctgggattacaggcatgcatcaccacgctcggctaattttgtacttttagtagagatggggtttctccgggttggtcaggctggtctcgaactcctgacctcaggtgatcctcccacctcagcctcccaaagtgctgggattacaggcgtgagccactgcgcccagcaacttccacatttctaaataacatgcttctactgctattttttttttcaattttagacatttttttactttcactatagttctatcagaattcagtgtgtacgttattatgcctaagtaaatagtcatggttgcttacgtattatatttctttgattgtgtttcttatttgatgagaaagctgtgttttttgctctgggttgaaactggagagaggacctggggaggaggaggaggacagatgaagttggtgactgtaccttcatggccatagctgggttctcagcacccggggatctgctgatcacctactcataggccaggcccctatcgaagttctaggtgacccagtgctggggacgggggggccacctgcaaggtctaatcatggaggtgggggctacagtgttggcttgtgctggggccagcatccttaggaaggcatcttggaggtggaggagacagccgcccacttcttgattggggccttcagcagcaccagcttcttgggcaggctggtgctggctttcatcaccatgtcgtgttcaatcttcttccagatcctgacttctaggttcagctttcctcagaccctggttcctttcagaggccattgctgctgccttgctctttgctggcttgtgccttgattatatgtctttgtacaactttttgttttcctggagttaatcttcacatctgttttcttggagttaatcgttacctctatatcgcttgcttattattctttggcctttttgtcttctcacaccttccaacttctttgtaatatgtgtttagtacaatttttcatgacaggtagtttactgaatcagtttttccccagtgtggtcatccaacttgagttatccagctctctgccccagtctgggcaggttgatcttcaggtctgtagtacacttgtatcctaggacttctctttgccattagcctggaatttcctttgcagttctcccgttggatgcccagttcctagatgccatatgtttttctatcgtctagtagcttcctgagagaagatgaatgggagggaaattgtatgaggttttgcattcataaaaatgccattttttttcctgtacacttggctgggtatggtgttctggggtagaaatcattttccctcagaaatgcaaagtctttgccctgttgtcttaaaatctccaacgtgacccgattccttaacctatgaatgtacttttctttggaagctttccatttttggggaggtgaagtgctaggtacttagtaggccttttaatttggaaacttacatcccttcagttctgggaaaattttcttaacatttctctgagaagttcttgccttttattttctgtgttctctcctgaaattggttagttggatgttggtcctcctagattgactcacatcttacctttttcttttctttttctggtactttttagatatccatctcaaactcttctattcattgttatgtttttaacttctttcttttctttgtctcttgatggggtcttgccctgttgcccaggttgtggtgcagtggtgcgatcatagctcactgcagcctcaaattcctgggctcaagcagctgttctgcctcaccctcccaagtagttgggactacaggtatgcaccaccacgtccagctattttctttacttttttttttttttttttgagatggagtcctactctgtcgcccaggctagagtgcggtggtgggattttggctcacttaagcctctgcctcccaggttcaagcagttctcctgcctcagcctctcaagtagctgggattacaggtgtgcaccaccatgcccggctaatttttgtatttttagtagagccagagtttcaccatgttggccaggctggtctcgaacgcctgacctcaggtgatccgcctgccttggcctccgaaagtgccgggattacaggcgtgagcccatcattagatctttaaataccagtatctataagtcttttcctcttgagtcagctagtatccctggaaggaaattactcattttcctgcttggaggctataagcttggctatgtttatcctgcaaccggggactggaagggaggggactgacagtgttgctggtcagggtgccctcttactttttgttttctgtgtgcatctcacgtctgtcctcagcctatgtaaacacctcttgagattatccctctcaatctttgccggaggtgggggaggggctgcttcctgggctgccttggattggagggaagacctcaggtgagtgggtgggaatttgcccaaggagccatgagaccagccactatttcaccctctccatccctccactttcagatgtatgtggcgcctccaaagcccgagctcttcttggcgtctgtggcttcaataagcttgctttttgctggtatccctcctaccctcccctgtccccagcaaagcttgcatttgaacttcttcctacgggctaacaaatcagtcagttatgtagctcttgttactttttagcttccgaagttttgttgacacccgtagtctgctaatgtccctgttctgttctttctgttcgtgtaaatatatgctttatacaacttctttacatgatttttgtggggtttctgggtagcagagcttcacaagttcaatccagcgtgttggattagaaatctcccaccctctggtttattcttattctcaaaattacctgccaaacactgatactcccttgtttttccttttcctgacaggaaatgtacataccatacaggacagaaatcattagtgtatcccttggtgaataaccacaaagtgaacttaacccttgtaaccgccacccaggtcaagacagaatattaccaagcactcagaagcctctcccctattcccccgtcactgctcctgccttcctccccaaggtcatgactgctggcttctaattccagagtctgtttttaaattctgtgtacatagaccatggattaagtgttctttttgtctggtttattttggtcgacattaagttcatgagagtcttctatattatcgtgtgtattagtattcctgtagttttaggagcttcatagcattccattgtagggatataccacagtttattcattgtattatcactgggttgtttctagttcttggctattgcgagcagtgctactgtgaccactcttaggtgtgtcttttggagtacatgtgcaggtttccatcttgcacagctagaggtggagttgttgggtgatagggtgtgtgcatctcagctgcagtagaaactgccaaatagctttccttgagtgcttgtaccagctcacccttttgccactgtgtatggggattccaggagctctggtcctcgctagcacttggaattgctgatgcttttactcttagccttcctgatgggtgttttctggaatcacattatgattttaatttccattccttaaagtacccttggctctgaagtttaatgattcatgcatctcttcccttttgaagtactcttacaggtatgttgtgcatgtgttgaaaagtggcactatctattctaaaatacagtatgcctcctctgtgtttgaacagttgtagcgtggccttggggcctcctgttagctggcttggagaagggattcttgggattgtagagattagacctgaggaggccccttggagctctctgactaaattttattctttattattccaaactatttaagctcaccgtgtgctgactcatcataataatgagtagctctcattgtgcttgtctatttggactcatacaatgattttttttttttctttgagacagagtcttgctctgttgcctaggctggagtgcagtggcacaatctcggctcactgcagcctccacctcccaggttcaagtgattcttgtgcctcagcttctcaagtagctgagactgcaggtgcgtaccaccatgcctggctaatgtttgtatttttagtagagacggggtttcaccatgttggccaggttggtctcaaactcctgacctcaagtgatctgccttcttcagcctcccaaagtgctgggattacaggtgtgagccactgagcttggccaaagtagttttttaagatgttagtatcttttcttgcagctaaaaaagtttgtcagagatgattctactttgttctccaggtgttttctcagggagaaattggaggcagtaagccactgggggagtcctgtggctggggggtggggtagtcctgtggctccttgtcagggagtcctgtggctggcaaggagagaagtcctgtggctgggttgggagggagtcctgtggctggggtctcatcctgtgcctaacagtgtccagaggtgccgagaccagctcagtcggggagaccctaacccagcagcgctagaggaattaaagacacacacacagaaatatagaggtgtgaagtgggaaatcaggggtctcacagcctttagagctgagagccctgaacagagatttacccacatatttattaatagcaaaccagtcattagcattgtttctatagatgttaaattaactaaaagtatcccttatgggaaacgaggggatgggccgaattaaaagaagaggttgggctagttaaccgcagcaggagcatgtccttaaggcacagatcgctcatgctattgtttgtggcttaagaatgcctttaagcggttttccaccctgggtgggccaggtgttccttgccctcattcctgtcaacccacaaccttccagtgtgggcattagggccattatgaacatgttacagtgcttcagagattttgtttatggccagttttggggccagtttatggccagattttggggggcctgctcccaatacagaggtctcgtgtaaattccctgggaggcgataagcctctgagaaacagactatgctaaccacgccatgaaagagaaacttatttataaatcagatgccagttactagtttactgcttatttgcccaggcgtagctctgacagagtccccgactcatagtgcttgctcagtgcatgctgaacaatgattggaatcaagtcatggctcagagcatagttttgaataatgggaaatggatgttcttaagtaacatagtcaccaagataatgcgactagctgggtcaccccttttcaattttaggatatttttatcaagatttaaatggccatcattagagttatagcactttctcctttggattgtcctagaggcccatgagaaagtattccctaatttcttaggagaacagtttgtgggtagtatgcggtcatgtccagttaaattgcagatatttccgatcgaagatgttccagtcctgagaacttcgtgacattagcaggacttctacaagccatctcttagggtggggcatttactgcagttggctagtactcttttctccttaactttgtcatttgttgatttttttttaactgtccccaaatactgtgggcagagtgtatctagaattgaggcctccaccattgcggagaggacatggatgctgagcagtcccctgagtgaaggttataaagaagcaaatagactacacatgtctgtaaactgctcttgagtgtcccaaatttggggtacttcagttcagctgtaggaaaagcctcaaactgtttatactttgcaagaattggaaacttctaattcacgttaagttttatgtaatacatgataagcttcataggagcttcatcttttatctacttggacttttgcttccgtaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggtaaggtggaggcatatgagtggaagagtctccagcatgtactcaagatagacctttgaaataaataaaaccagatgatccctcagcttctagaccaggctatttggcactggttgattgaatgtgaactgcactggggctgctgtgagcccgcatgggtctctgtgaccctgcagatgcagccgtgcccagggactgggcagtgggtgtgggctggtgtgagccctgtctgccacccagggcctggccctctgtctgtgtcggccatgactatggtgagtcttgtaggcttgagactgtgcctcgggttcctgcgggttctctgtaggtcagttgacagtttctcctgttgtttgggtaactgtggaaacgaacactggcaagtgctgaagcgagcatgtggacgtgcgatatgaaataacgacctggctttcaaaggcagtgaggctctctggaaaggaccttgctgagctagggatgtgggtgtgtagccattcccagtgggcctcatggcgtactcgttcatgatcatgtttgtgccatcttgatctctcaggatctcttcttttttaacagattaagccgggaatctccaaacagtgagtcagatgttaagatgtcttgcttccacccccacaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtaggagcacagggtttactctaggccctgcatgtgaatgactgacattcaaagaaccgattaatttggaagagaagcggcagaaccgagagttagaggtgtggactctggagctgcgctgctcgtttccaaccctaggtgctgacctctagctgtcttccctctgtatgtccctgtcaccgtgagtcaaatgcgggtgatgcctcctcaggtgccgtgttacctaagcctctcagagaccactgctaccctgtttctaaaaccagaggtcacgatatgtgttcatccacccagtaaatactgattgagcacccactgtgtgctaggctctgggataggggctgggtatacaatggtgagtatttcagctgcagcttctgccccgtggaggctgtggcctagcacactggtctaggcacggtggtatatgctcactcaaggagatagggacgtggtcgtttggggtgtcggaacaaaatgtcggaacttctctttccaatgcagagaaaccttgcagtaattctaatgtactgtgattggcagttgacttcagttctttgtagcacgcttactcaggttatttcactaactatgtaaccatgcagcctcattttaagcaattggattttttgaactttacttaaaatgttatgtcagggtttttattgtgcttaatgtgtgccatttagctaagttttgtaggatacgaaattgtaagtggcttaaaatgattcttaatagaatcatgaattgaagataatgctaataatttaagcactgagttaggtagtgtttgtaaaatgcttagaatgcttcctggcacatgttaaggccatgtaagtgctgcgtgttgataaacagctgagcaaaagtggactcttaagaaagtattggggctgagagttctgttccaaccagctgccctttggttatttttcagaataaaagcagagtctcatgggatatgacatttatatttccttcacaaaaaacactgctgagtgttttgttgagtaaaaagggtgtagccatggtaataatacatttaaaatatagtttatttcatctttaccttgccttgttttttttttaagctagctttttattgagaattccacacatacaaaagtatcaactcatgaccagttatatttcatttataatcctacttctccctttttttattatttgaaagcaaaccccaattatcctcttatttcatctataagtatttcagtatctctatagatgaggactcttctttatttttaaaactttatttttaaaatgatggtcagatgcagtgttcatgcctgtaatcccagaactttgggaggccaagctgggcggatcacttgaacctgggagtttgagaccagcccgggaaacatggcgaaaccccatgtcttaaagaaaaaaatcagccaagtgtggtgatgcatgcctgtagtcccagctacttgggaggctgagatgggagggtcacatgagcctggaagatcaaggctgcagtgatccatgattgtaccactgcactccatcctgggtgatggagcaagattctgtctcaaaaaaacaaaactgcaaaacaacgtcacaaaacagtgccattgttagacctgaaaatattaaacatttcctacatcaaatacccaccaactcattatcaatttttctctctactcttttggaatcagcatctaaataaaattggtcgataaggattgtaaatctctttgatgaactggttcccctccatcccagtttttttcccttagagttcatttattgagaaaccagattgtttgtcttctaagttttcctgtggtctgatatactgcttccatctccactgtgtaaattaacacctttttctcttctctgtatttcctgtaaatcaataattggaggaaaagccttgtcagatttagtgtatattttatatctgagtccagtatttcttatataatattttaagataagtgtactcttttaaaaagtattgaaactatatgctcaattttttttaactgatgcttttaagaaggctgcttgatcataaaagtttagagatcattggtctgatgggaaaagcaaataattactaaaccgtttagcaaggttgaggtgcacatggtggggcctggagaagttcagtcatgagccgtcacttatgggcacgtggaatctgacccggcacagagttgggagaagacaggagctttatagacagaaaatgtggtctttgctaagtcccaggagtgaaagggtgagacagtgctcacagcacacgagtgtgggtgcgtagacagagcaagggtgggtcctgaaaaggcctgcaggctttctcatagattagcaagagtgctggttacggaggtttctaacatttgtgaacagatcgaaactgtgttaaattgggattgcagtaatcctggaaggacagggatagagggtgaaggggaaaaaagggtatggatgtgagacttaattgctgattttcttaagacctttctccaaagtaaataaatgatgtggcacatttttgaactggcaaattctaaactctagatatgattatctctataacatatcttactccatcttcttttgactaaaaactgttcttaattaaattaccatgagacgttcaattcagcaaatgtagtttggctaaccatatttaattagaatttaatataatcctaggcctggccaaactattaagcaagtgtgggcaaaatattgataattttagatatgcaggaacttagtttgctttccatgtgtgcttttcgaaaaaggaataaattgaaaaatagaggaagccctgaaatccaagaagcaaactctctcacctaggcatgcagtaaaagcaattctaggatgattgctgtttggcgcgtagttcgtattagaaaccattcttcttgaataaatagtatgtttaagaagctgggcagagggaaggcatatgcatatattatcaacaaggagggagaaaaaggcaattagtaaccatccataggagggtcagcaagatttataaaggaaatttgtgatccaagtatgaagcaaaataaggtgcagaataaattttaagcaagtaatagattagagtaagagaacccatttgaccattaaccttgggacattctctttcaaatgacatggagtagtactgaaatctttctttctttctgagtctaggttattgtgactggactcagaaagaaatatttcattattgcagtgaataacatttgtgaacattattgttcataaattatgcagtgaataacatttatgaacacgtgatgtgtaagatacatactgtttatttttagttaagttttttggctcaacttctaggcagagaacattaaatgtaaatagtgttacctaggagcatgtaaatggaaatctccatagtatgaaagcagtgctgttgctaacagaatttaggagggggcagatgaggtgaaggaaatgtgggtgctgatttccttattacattgagaggagccaggagattctttgttcaaaatggatggcttaagaagtcaaagtataagctgattacgtagagcaggtacccaaaaatgttttgtgtaaggggccagatagtaaatattttcagtcttgcaggccatcccaagtctgtggcagctactcaacactacctttgtagcatgaaagcagccacaggcagcccataaatgtggctctgttccggtgaaactttaggtacaaaagcaggtgcaggccagacctgacctgtgcactgtggtttgctgacctgggattcaggggtatagaagttaccatcagaagagctaaaagtgagactttttactttatactcttctacactgtctgattttgaaaaaaagaaacatgtattttataatattaaagatagggttggcaaatagcaaataaaaatacagaataccagtgaaatttgaacttcagatacattatgagtaattttatggtgtaagtatattccaaatcatgtgggacatacttacactacaaaattatttgttgtttgtttacagtttaaatttgagtgccttgtattttatctggcaactgtaattaaagggaaaaagaataaattcattatgttcatataatgtgatatagcaggggtccccaacccccaggctgcagagtggtactggtccatgggtccccaacccccaggctgcagagcggtattggtccatggcctgttaggaaccaggctgcccagcaggaagtgagcagcaggtgagctggcattcccacctgagcaccgcctcctgtcagatcagtggcagcattagattcccataggagtgcaaaccctattgtgaactgcacatgtgaggggtctaggttgtgcgctccttatgagaatctaatgcctgatgatctgaggtggaacagtctcgtcttgaaaccatcccctggccctgtggaaaaattgtctcccatgaaaccagtctctggtgccagaaaggttgggtagcactgtgatatagtattaaaagtgctaataaatatggcatactgcctttaaaatgtctggtagctctttctcagtggcactcataatagtgttttttgatttttaaatgtgtgtcaagctgactctcccctccgtgtatgctgggctttattttccctttcctagtcaccagttttgggaaatagagatcttcattctcatgctgctcctctagtgcaagtgctccatttatttttaaggaattaatataacaaaaaatcatgggaatttagaaaacaacatggaagctaatgatcacattggtggaagtgatagggaaatatttagggggagaagttaaggtataaactttgtcaatgaagtcctattaaaaacaacaaaaaagtgaagcttaggatgcattttataaactctgaccagaacacctgtgtttctctgtttctaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttattttataaataggggagttgggctgggtgtggtggctcacgcctgtaatttcagcactttggaaggatcgcttcagcccaggagtttgagacaacctggccaagtgagaccctgtctctacaaaaaaaaaaaaaaaaaaaaaattagctgggcatggtggcacatgcctgtagtcccagctgctttggaggctgaggtggtaggattgcttaagcccaagaggttgaggctgcagtgaatcttgatggcagctgcactgagcctggtgacagagcaagatgctgtctcaaaataaatttaaaaataaaataagagaattaaagtttagcaggttgggtggcaaaatgaggccacacatttaaagcccctcctcctgattcttttctctgccttggctgcctcctgtggcattttaggtgctgagaaatgaaaacagtagggaaaatagttccaggatcctcatgttaatttgccagaaatggcatcttcaagtcgtcagagggatctgagagttccttcctggcctgacttgagaaaatccgtctgtccccagctctgcgtctgcctccactgcccagtcacctcctctccatgctcttggggctgggccctaccccaccatgcagtgctgccctggagcagtgagcttggtgggtcctgtctggcatgagagctgcctttgggagctggatcccagcctctaccactgggtctggtgcctagcaggctatggataaacttctgctgactccggcctctcctaagccactgcaacgtggtcggtgtagtgcacagtgtgtgtgcagcgtggccttactcacagcctccacattagagagaatctgactgaagtcttactgctgcctcgtgtgaacataaatgtttgccagaaccatgagcaggaaatgttaatctgccttgtttcctgtcctttacacggaagaatttttttctgtatggaatgcgtgccttacaaataatgagtggaaatacccatcgctaatgaaaagttatacttgactgttagtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcgatgttaagtgtttcctgtggaaaaacgttcacattttctctagttttaaagttgaatcaagctgtttgaagattttcacatttcttctagattttatcagcttgttactttatctgtcactttctgtgatttgcagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaacatcttagctttatgggccatatggtctcttttgcaacattcagctctgccctgtgacaggaatgcagttgtaaagacatgagctactggccagctatgttccagtagaactttacttacagaaacagacaggctgtagtttgccaatacctgccttagggaatgtgttgttatattttgtgagttaccttctcagtaaattttatttagtattagtcaggaatattattaagtagcttcttttccagcctggtcaacatagtgagacccggtctctaccaaaacaaaacaaaacaaaaaaacagccacgcatgtggcatgtgcctgtagcctcagctgctgctcagggggctgaggcaagaggattgtttgagcccaggagtttgaggtcacagtgagctgtagtcatgccactgcactccagcctaggcaacagaatgagaccttgtgtcttaaaaaaaaaaagtttcctttgttgggttattttaatttggacctggttatcatttttcagccatatttaactttgtacatatcagaatgttctgataaaacttaacttttattaaagtgtttgtgatataatctgctagttttggtacacattatcttttgcaatgccagttattttcttttccagtgtgggtttgcataggaaaagaattgctgtcactttctattttgaaatcttaaaagactgatccttttttgtgtcatgatttgagtatttaattgagagcctaatgcctaatattatttgcagtattaaatgggatcttaacaggaatagcattctagccttcattgaattaagtaaacatttcttaagagaacttggaatctataatatttgcgtcatcatagtatgagatacttaatcaagtttgagattttagtgaaacattgtttagaagccaaaaggattctaggaaaaattaatgtctatattcttgaattaggagagattttgggacgtgtgactaagttacgctgacacttgtttgtttcttagtcgctttttccagtggcggtgagaacgaagatgactgattcacattgctcagatgagtttatcctcttctggctgggacatgggatatatcctgtctcttttaagcctttttggtatttttcccccattgagagctgtgtcttcaaactcttctgttatagctggaaaatcctttttaagtgaaatctgcccaaattataagacagatgaaggtagagttgtgttggatataggattagggtgaaagtagtgggggtgtcctggagcctctcttctggtggcagcctagctcttgtgcctttgaggaaattaccctggggacggctctgtggaacatatttgcaaaccactgatttggaagatagagatggcttttgttaagatctgaattcacctttttggcattttatttgatttctcaaggtaaagaacttattttgtaataaagtttcctattatttagtagataggccaagttgctgtgttaattccatgtagattttgggtttcctttgctcattttttcactcttaatctcacatcattgtaagtttatggaagttatcatacttctgactttttctttgaagagcagaaattagaaattcccaataattattttgatagtgtcatttaatgacactcacatgtgatgtagccacaaagatttaatgagttcagttttaaatcatattaagactgttggtttcatttgttctcattaatgtaattctgaagatgaacaataaaatgtatttttagaactttcaaatgaaatattatttcatccttccagatcatataatgcttaagttctgattgttaatcataaagtctagaaaattaaaagataataaaatgaaagtgacttttaggtattagagttttattataaattctggtgtgtcattggagctatgacatgaatatttcaaaggccaatagcattggatctttacagttataacttaccatttttaagtttaagtagtaatatagattatttaataatcaaaatcaataaatattaattattaaaatgttttgtggtatagtttgagaatcattgcttttaactttttccatataggtttattgactttaatagcattctaaacataacatctctacattctttgtgtttaatactgtggaggtataaaaatacttatatatgatgataaactatattagagtaaattaaatattcttatgagtttcattttagagtgcatttacttaattttgaagtccttatttttagcaaactaaaaggaatgttggtacattatttactaggcaaagtgctcttaggagaagaagaagccttggaggatgactctgaatcgagatcggatgtcagcagctctgccttaacaggtagttctcactagttagccgctggtgtggaccttcactgtctgccttccaccccttgcccttcctgctcgtccccctgcacctggtggacagcacgactgggggcagcagtggagccaggttgcttaaatggggcatattcgggcttcttttataatacttactctgaagcttgtgtgtctgtggtgtttgcatcatatatttgttgttttccatggtttaggctgttttaaaattaggtttatggc

SEQ ID NO: 426 - DNA, 83901 bp, Homo sapiens
gaatgctttaacagactgaaaaaatgaaacttatattaaaaaaatacatcgtaattgtttcaaacaatctggagacattgaggaaaacaatatgatcacatttgaatttcagaaaaaaaaattttaatatcagagtaggcattgtccagtaaaatgtgagagccttagagtagaggtactatcctcttgtcttcacccggcaaaaaccctagttcaagacataggtttttaaatgcatgatgcatgcaggtttgaagaagtaaaggcgccaggatggtaaagccacccctggcattgagtagacactcgattatttctgttaggtgaatgaattaattaataaataaaagcaaaagaggatgggaggtaagttagaagatgattagagtaatcatgataagagattaagaagaataaaaccaatgttgtagaaacgatgagaaaataggtggaagagatatgtaacatactagtctgcgggttctcttaaatgtagaggctaacagagattttgagaaagcatgaaatgttatatgttagttcagaagtttatttaagatcattcaaaaaagcaactgttccaacccaagtttccttagagcattgagtggataaagaaaacgtggtatgtaatacaccatggaatactactcagctgtaaaaaagaatgatatgatgtcttttgcaacaaattgaatggagctggagaccattattctaagtgaagtaactaggatggaaaatcaaatacaataggttctcatttgtaagtaggagctaagctgtgggtacacaaaagcatacagagtggtataatggactttggagactcataaaggagagggtgggaatgggagtgagggataaaaaaactacatattgggtacaaggtacactacttgggtgacagatgcactaaaatctgattttactaccatacaatccatctgtgcaaccaaaaaacatttgtaccccaaaagctattgaaattaaattttaaaaaagtaactcttctatatattttaatactatttttaatactaaatcctgcaccaaaaacagaatctgcttggtttatctgagataattcatagtcccaaggttcaggcaccagacaaatagttttaatatgttcccctttcttatacaatttgttgctgtatatttataaatttgaaacagtcaagataatgaaggaaactttacttttttatctacctgaaaattaattcaatgaattcatagtggttatacaattcataaagtttataatattcattccacttaaaatgaaattaatccatttgatagcattcactttgaaattatgtctatactatcggtattatactttaccgtcatagcatatatttcagaaacctgatttaattgatccatatttgacaatagacttattaaagggtctatttcattaaaatgttttgctatgcacaattttagagagtagaggatattttgatccctaaccaaaattaaaccagtccatttgtgaaatttctttgcttcacctttgtgttttcctcgttccattggtttttgttgttgttgttttgttttattttgttttttctttttaggttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcatcccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacatcatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgagagaaattgtgtggaattttatatcagagtgcttgtctaagacaaggcagtaagactaatgcaactaaaaaagaaaaataagggctgctgttccacagttagtccagctctctttccattctgtacctgaacctgagtcaatggatccactcttacgactgcaattacaatacataatatgaggatacgtggatcttcatttttcagacaagacctttcttcttaacttcaattctgtatctctaccggccaatagaccatgtccacatgggtgtctcaccagcaaatcaaatctcaaacagaacctgccatttcaatgcacacctcatcccatctcccctccacgttgtcttcccgtattctctgtctcaatcatgacactactatgtacctatttcccaaaagccttacattttggaatcaccctttacaagtctctttatcgcatgtatctaattaattcccacatcttgttttaattcctacgtgtttctttaatcgacttacttttttccattcccttggtccaggctatgattgtctccccagactgctattatgtctcatctggattaatataggtacttcctaattggtctctatatcttgctttcttcccatctaatctgactctaactcattagccatagtgatttttcaaaaactcagattttatcaaatcactcttctgatgaaaacactttaacgtctccttatatgataaactctgcatctttttatgacatggaaggttgtttagaacctgactgtgcctgtgttttttatctcatatagattctttttttccactaatatttgctgctagattttaagcatcatgagggccaggacagggactgtcttaaccattgtggttatcacagatacttgcaattcttgacatcaagttagtagtcaataaatatccttcaaggaaattgagtttatgaagtgaagtgtatttactaaagccaagacttgaagatagatttgcaaggttgtaaaccataaatgtttcccattttagcatatgtcttctaggaaaagaaggttttagctacacaagagtccagtaaagatatatttgttcagaatcaggttggttttctttcgttttttggaggccattaaacatagacacacgcgtaagtataaagggctctatacatagatttcattcatggctcactcaaaattagctagaactttatgaccagggaagaatggaggaggcagtcatgattcagatagctagaaaagccattgcaggtatttctagcagaaagttatttaattcaagaaattaaagtcttataaaaccactggaagagctagggaagttaaagttaggaaaagtatccactagtattgaagaaaccaggaagtgcaaaattgcaagaaactactattaatgtgaacagtacgaaagtggatgatgtacaggaaaagtacagatttatctataaaatcttattgtcgctcgctaagcccacactcctgcccatctctactgtagatccattaatgccttttgcttctcttctggtttccaaaatttatacaactctagccttactggcatggatctagggaaatgttcttaggtttcaaatccctaagatacaggggaaagcatggaggggaggatatggcactcagttgctatcagagagtctggcaatcttagggtgtaatttctagtttcaacctcatcttctccttagtacctgcgtaggttctccaaagttacagtgatgcaaattgactacatcttttccttttcttttaacaaggctcaggtgtcaaaaatactctttaaaactgccccatttgtacaggtagactgaggagtaaagtataaataaaggccatttttcctacaatgggctgattggaatggaggaagaaaggataaatccgatataattataccaatactggaacaatgatctgaaaactacagaagaatctaaattctggattagcttcctaggatgagcaaaaggaaataataatgtctcagggagagaagagtcttcaaaattttcaaattgataagagatgaaatattaatatatatggcagcaaaagacaaaaatgttattttttcttaagaaaacaaaaaaattaaagaaacaacacaaagatagtagagaacgcaaacaactcaatgattttatcccatgatattaaactcaggtaagaattttgttaaggagtttctaaggactgatttgaggatttacaaagataactgtctgttagaccattgacctttttctgccttagtacacttgaaagacgtccacagactccacaagttctcatagatatggaagaggttataaaaagaatagtctgcaggttataacaattcgcattcatgttatctgtaactccagctcttccttgctaacttgagattgtgtaattgaatgcaagtaagtgaaaatggctaaccctgaacctactctcctttataaacaaataattgccaatttttcaacactttaacaaattacttgcaaaacaccacgtggctgatcatgacaaaggattatgttataacagtaaaattaaaaagcactataacttcacaataaatgaaggaaaacaataacaagtcaataattatttttaaattaattttgcccttgtcatagaaaattaacaaactataaaaaaataagtacatatatgtatatacacacatatatttaatgacaaatatatcttcttgacgtacagtattatctaatatcacatattatctgtgtatagaacatctaactatctaaaagtggtgactagcctttttccaaatgacctatttatttccaccattgtccctacaggagtaactaccactgggctgtgggtggagtggggtgaagaggaaaggagaatgcactctggaatgtaaacaaaataatttgaatatatgcagtttgaaaaagctccttggtgagtgtggcctacttcccccaaccagttgataatcaaaaatgacagacgtcaaactggtgcttatcattttgaacactgacacgtttttaaatgattagtatccattaggatacacaagctacgatctgcctccaaagacttgtgaattgttggagggcacctattgtgcaatcattcctgttctctggtataagcaaatcagaacttgtttccagaatgcaactgagaagggagaaacaaaagacttcgagggacatacatagtgttagcactactgcatgcattgtgtataagttgaagccaaataccatcagtcaaaacgcatctacaataatctcttgatcccatcagaccatattgagggatgtaacaacaggatctagggcaacatagataatgtaattttatgttcactgaagcaataatataggtttgacactgaaggattgtttctgcctttttattccaggaaaaataatttactgaaaataagaacttcctacttacttacaaagataattccatctaaacaattgcctcaatagttttcccacaaatatggtgtactcagtaacttatgacctcaaaagctccacaggagttatacaaatctggtttgtctccaagatacggattttatatttactttctgatatttagcttaaaagtctaaaattagatggaggcattccttacctacaaggaccctcatgagaattgcttataattgtcattatatcccaagacagcacaaaacagtttattatagtcatgagtattagaatgttttttaaagcacaggccccccaaaagataatttcttagtggatataactaggaaatatgaatgacattttggaactgtcaatattgtgatgtggtgctaatcttattcaaaacatggttgaacatggtttagcgattttgctactagtgataatcacttgtcctgatatagtcaccatctgctgtggtttgtatatttcctccaaaattcaggtgatgaaagttaatggccaatgtgatggtattaagaggtagggcttttaagacgtgactaaattatgagggctccttccatcgtgaatgatattaaatcccttataaaaggggcttcatgcaaatttggctgttttgcctttccacctttcaccatataaaaacacagtgatatcccctccggaggttgcagcaataaggcgccatcttggaagcagagaatagtcttcaacagaccaccaaacctgccccatcctgatcttggacttcctaatctccagaatggtaagaaatgaattttacaagttatccagtctcaggtattttgttataacagtacagactgttactgaatacattttatccaccaacacattcttaaagatagttgcatgatggtgcaacagagttatgtcatcctcgcagaaaattcatggctttaaacaaattaacatcatcatgcacagaaagcaagtgggtgaatctgctttaggcaaggcttaaagctgaagctagagaatccagagcaacagccaagtctaaggtaacagactcttaaaggggacatggaactaagtatccgcacctgggcaggaacaggctcaaatcaggaacagatgaggggagagggaaaaggctgcaccagtgtggatatgcaatgctgagtgaagggtcctgggccaaggtgggaaaaatctttgatatgcctcttcttctgtgaactgagtaagcttatgacaccaacactatttttgttaaaatcacctaaaagctctcataatgctccagaataacattttaattatttttaaaatataacttattagagttccttctttcaacggttatatcatacatttgttgaggcttaaatagtaaattactgtgttaattggctcctgattttcacccagctggggatgagggtatgctgtagaaaagtatgaggagtgtgctgtagcaagagtgtttatcttctgtgggaagaggaagacatcgaggggaaggtaagaatggaaaggtaaagggcagaaaacagtctaaagaaatgggtcagaacatttccagtacttttccatttgcctagattcagtaagtcaaatgggtatctactcactggaagatgattattttggtcctcataattcacagagtgttggtggagtgcctagaagggttcttgcctcagtaatgagaaataattagacccagacaaaatgcttatctaattcttctcaacaaatcttaaaggcagcactggaaggaatcaaactgtttctaagaaatttaaatgtattacaaaatatagctcaaaacatttatcagtaggcaaaatatatataggatgacacaggaaaacatttacaaattctgtcatctaatcaaagattatcaggcataaaaaagcaagaaaataagacccacagtgaaaagagaaataaatcaatctaaattgatccagaactgatacatgtgttcaaatcagcaaagagctgatttatgttatgtgttaagcaaagagcttaacacataaaactattctgtactttaaaaaatttaagtagatgtatggaaattataaaaagttatcgagaccaaatatctggagatgaaaattacaatatctgtgataaaaactatattggaggggattcacagcagactagaaatttcagaagattagtaaacttgaagacacagcaatagaaattatgcaaaaggaaacacacagagaattttaaaaatgtaaagagattcagtgatttgtgggacaacttcaaatggctttacatatatgtaattggagtcaccaaaggcattgtggtgaggaagaaacaatattttaaaaaccaagttcacttactcctaatgccatcagcaattatgttgaatgtaaatgtagaggcagaaactagtagcacttacctatgtaataccagcgactccggaggcaggaggatcacttaagtataggaatgtgagagcagcctgggcaacatagtgagacccccatctctaaaaacattacaaaataaaattagcctggcatggtggcatgcacctgtagtcccagcttcttgggaggctgaggcaggaggattgctcgagcccagaagtttgaggctgcagtgagctatgagcctgtcactgcactccagcctgggtgacagaatgatatgctgtttctgaaaacatttttaaaatgtaaatagtctaaatgccttaatttaggaggcagaaattgtcgtatctgatataggttgttgcaaaagtattatggtttctgtcattactttttttttttttttccgagatggagcctccctctgtcatccaggctggagtgtagtggcgcaatctcagctcactgtgacctccacctcctgggttcaagcgattctcctgactcagcctcccgagtgctgggagtacggcacgtgccaccacgcctggctaatttttgtatttttagtagagacagcgttttaccatgttggccaggctgctctcgaactccttacctcaggtgaggaggtaagcctcgcaaagtgctgggattacaagcgtgagccaccgcgcccagcctctgccattacttttaaaggcagaaaccgcaattacttttgcatcaacctaaataaaagactcaactatatatcaataaattattttaaatacataaataattctacaaaatatgaaagttatgattagaatccagaatgcacatgttaataactttgttaatatagaaataataccatgacaccaaaactaccagagtttgtgaaggcaaattgggaaaaactgaaattgcacattttttaaaagtaataatagctaaattgacaatgtcgaaagcagctaaaccaacttatacattttaactataaagattaaatatatatatatgagaatggaacaaacaagatcaaattttagcatgtatgaaaatctctgatacatgttaaaatgcttattcttagatcctattctattcttacagattctgaattgaaattctcatctgggcccaagaaactgcctggtaaataattacccttggtaattccatgtagatggtgtctatgtatcacataaagaaatattctggtttaataatcaaaccagccaaaatgtgatggtgagaaaagatggaaggtaagagtaaaattaagttctttaaaactacagatgtatattcctcagaagcattatattaaaaagaaaatacaccatgacccagtgggattattttgacttaacattagaaaatctataaatgtaacttattatattaacaaacttaataaagaaaaagcatatagttatctcaataaacatctgaaaaacatttatatcaatttctgataaaaattgatattacaaagtctacaattttgatttttccattttaattatttttacccgctttatatttcatagattgagagacaagttaaaattttctggtgactattttatgatttatttttacctgtattccttaaatttctcatagagtttattcaaaattaattttgatgttaccttacttggtgcaaaagaaaattcatgacaattgaatctttatttttgccttgaatttgactttatttggtaataatattacaaacctgttttcgtttaattttcatttctatgttacatctatcaatttttttcacttcagtatctgtgttttgctttatgaggcatatttcttttgtacaacacattatcgggctttgattttaatctaagtctacattttttaattgactcatctcttttatattgattgatctggtatgaatgtatactccttaattctgatatttttttctatattgaatatggactttgttttttactttagatatctagtctatgcttcccttggtttggtggttggggttacagtgatggttttaacggtgataatgtatgtgttgtatttttgatagtttctgagacttacatatagtttttacatctccaaatggttttaatattattatttcttgatttagtaattttagagaatatctgttgatatgttccccaccatgaatgattaagcaaataaaatttaaataatgtaatataactacacactaccaaatagctaaaagtaaaatgaaaaaaaaaccaatgttgatgaagatttgaagcaactagaactctcaagcactgcatgagtaggagtataaattggtaaagtctcttcagaaagctctttggaaatgtagacaatagataaataattcagccttattaccaaggagttccatttctagatgtagagccaacagaaatgcaagcatatgtttgccaaaacacatgcactggaatattctttgctgcactattcataagagctaaaaattggaatacgactttagtgtacattgacaatacattggataaacaaagtatcaaattctatattcacagagttaagtactatagagcaattaaaagaaactatttttgcatgcatgcaacaatagtaatgaatcttacaaatattttgaggaacataaggcaaacacaaaggatttcatactttatttaattacttttatacaaatttaacaagtggtcaaaggcaggctatgttattagaaatcatgataatggccacctgtgctaggaggatctacaaggaaggcttctgtaatgcttttaacattctgtttaggtgtgttcatattgttaaagtttattaagctgtatatgtatgatttgtatacttttctgcataataattctgcaataaaacatttaaaaactagtagcattcggccaggtgtggtggctcaagcctgtaatcccagcactttgggaggccgaggcgggcggatcatgaggtcaggagtttgagaccagcctgaccaacatggtgaaaccccgtctctactaaaaatacaaaaattagctgggtgtggtggcgtgcacctgtaatcccagctacttaggaggttgaggcaggagaatcacttgaacccgggaggtggaggttgcagtgagccaagattgtgccactgcagtccagcctgggtgacagagcgagattctgtctgaaaaaaaaaaacaacaaaaaaaaacctggtagcattcagtgctggtgagattaggaaagctaggcatatgttatgctgcatatgtatgctgatggaaatgccaattaatataataattttggaaagcaaccatacaattgctattaaaatttaacatgaatgaataattggagccagcagtccacttttgggaaatctgattagtggaagaaaagcagcaagagagaaggatacattaaagaaaattgtgaagaattttaataactattattatgaaagtatttaaaataattatagtacagtcagtcagactgtgatatattatgcaactattaagtagaatatgttttatacataactgatgaactagaagaatttctctgaagtgttactaattgagaaatacctaaaaaatacataaaacatattcaagtattcatttagctatataaccagattattaatgttgtttagctaatgggagtagggtgggaaaggaaagtagaggggagaaaacaaaataatctatgcatgaagatctgtgtttctttttctttttaaataaaggcaaaatcttgaaagtaattctttgttcacataaagattgtaggaaaacacttgaacctgggaggcggaggttgcagtgagccaagatcatgccattgcactccagcctgggcaacaagagtgaaactccgtctcaaaaaaaaaaaaaaaaaaagattgtaggaaaaaatacagttatctggtgtcactaacaatattagtcattttggtgtgtgtgtacaagtgtatatattttgaacataaaaggatatttgttatttaatttttaagaaaaatttaaatattggttccatctacttataattttagataagtataaaaatgtatttgagtgatatacctcaaaacagtaaaagttgatatctatagttgtgggatgagtgttttactcatttatctcatgtattttctagacttttctgaatttactcaaattaaaaattgtaaatgcaaacagtaacagaaaataaaaagaaaatagaaaacaaataaaaataaataatataaaaataacacgttaagaaattggaaacaaatgtaccctaagttaacagaatgatagctcttccagaacgtgaagcaaagccagcatggccacattcttatttgagagcagaaggaagaagcaatgtgagttttatgtaaacagtatcatctgtcttttgctttttctccccttcagaaagctcatgttctacaagagtaggctttttggaaaaaatagctttgcttgctgtctcattacttatgccaaaatatattttcactgaatcaatgttttataaatcagtaacaatgtaaaaggaacaggagaaaatgtgagtaattagattaaaaatttgggaataagactttttgatacaagaaacaaaattttaaaaaggaatttctctattaaaatagaatggtttaattgttttgcaagagaaaagtaccatagaaaaaatgaaaagacaaatgataaactgggaaaatattcacagcacatatgacggacaaaatgtaagccagtaacactggctaacaacttgttggagatacagagagaactgtgctaatataagtacagacgtttaaaaatagttccttgttaaagaaattcatattcaaacataagattacgattttcacccattagagtagcaaatttccaaagttttatagtacatacttgggtaaacaaagatttatacactgtttattatgtttgtaaattggtgtaaattctttgaaatgaaatttggcaagtttatgtgtgtcagatttaaaatgcataaatcttttgatccattgatttaaactgtagacattttatttgtaatgtaaacaaaaatggtatcattacagcactttttggataaaggcagaaaattgggaagagtctaaacttcatcagatatatgctttactaaattatggtaaacctgtacattgacatattctgcatctttcaaaaaagagtgtagtggcactaaatatgttgatttgaaaagattattagatatttagttacttatttggtggaaaaataggaaaaataagaggtaaaactgtttatagtatgatctcatattatcaaatatttaaatatcaagtattatttaaatataatttatatgtgtaaacatttccaaaagagtgaataaaatactgactatagactcttctggagaataatgttgggaattttgcataggaaactaagtttcactgtataatcattcttaggtgtttatgtgcatgcattgtatgtcaattaatgataggtaaataacaataccagaaatacgggcatggcaagagcacatgaaaagtcacagaaaagaagtgagcaagaagataataaagaaaaattacatgttttgagggaaaaaatgtcaagaacagggatggctaatattttatgtgattttagttcctgaaatgtaaccatcctcccctgagctctcccctaaacctttaggaaaatatgtggcaagcaaaagcctgttaagttgttttattgtagtagcaaccaaggaactgagctaagtataaaacaaatcataaatacttaatgaaatgaaaaactaaaatctgatggcactcaaaatttgcattcatttcagaaatggcattgaaattttccagaagatgtgaactagggcatcaaactaatcatatctagatcttaagaagcaggactctccaatgtgcacttcaattacacctatattaaaaagtacattactaaattaatgtcacttcaatatcaaggaatataaaacagataaaattaacttaagagatggaactacaaatgggcaatgaaataaagaagagcattttggtattgtaatggattgatttgtcatggcaacattactttgaaaagacatcaaagggtgtaagtagtgtgccttatctcttccctgagattatactctgcttgctgggagaagattgtgtacagagtttatttcttcttggaaccaaagggtctatgataatattttattagcctcagaagcccaatggcctctagagatgcacagggccattgggatagtgcagaaacacaggaggatcactggagtcagtctctcagtgctcgtacatttgtgttggattattgctgctattctgtgacctctgcttcaggaatgggtgaaaagtactggtaggagctctcatgagaccctgctaagcttggtctcttggataaatacaccaagctcaaagaagagacttaagctctatacccttattgcatttgtcgttaatattcttaataactactgggaaattgagataagtaaactgagcttttttatgtgtactcggccttatgtgatttgccttaacagatattttatttggggatacatagaggaagcatgttaaatgcatgcaagtaatttcttaacaatttttgatgatttaaatgatgataatggttttttgttgttgttgttgttgttgtttctggcagagaaggaaatgcaattccttattagaactctaagtttgtgtctccaaacatttaacagtagggaaaaacaaaaacacaccattcttcctccagcttgtggggcagaaataggacctggaagaatcgggcttttggggggattccagtttaacacctgactgccctcactccaggccctgagatgccttcataatctgttttgttttgtttttaaaatgatagatgtcagtcatttatttcttccaagctctttagtgttgcttctgtgacaagtttctgcagtacagtagatttattttgtttatcatctgtctccctccacccctactgcaatgtgagttccaagagagcagggattgttgacttcttttttttttttttttttttttagagatggggatctcactaaattgcctaggctggtctcaaacccctgggctcaagtgatcctcctgccttggcttcccaaagtgctgggattacaggcatgagccactgcacccatatatggaaaatggttatggtagacatttgtcactgccatgtttactagtatttttttatacagcttagttatgtttgagtaacatttcccaatagtatagtaataaattaatatacaaatttaaatttcatgaagtatctccttttttctttaaaaaaatcagtcaatacatatacattataaaaatgcttactccataatctaggttataccacaaatactatgtcaaataatttttaaaattgtcacaaatttttggcatgatttttttgtataacatggttattaatagatatgttactcctgaagagtaatgacttgacataggaaaccatatctaacttttttgacaacttccttgtgaaatgaacatataatggtgttcatttcatacggtgaaatgaattgcaccagagttaagtagaggaattttcatagcatcaacaatattgtttgagatgctaaatcttttcttagcttatgttaaaacaataacaattctattattttaaaaattataatttgttgtaatactacagaaatttttacatattctataactttctgattaactgtttcataaataatttattgaagtgacactttagttggcatgatgatatttaatttctatttacttttattctttaaaaagtattgcaaatatttggctgagtttcaggattcaaaagttgaaagaaatgataagttcacgatatttttcatttttgctctccaaaagcaaagaaattttttatataatattttcggtgatctattttttctgagaataaaaactctatttttgtcttagtttcacacggtatagcctagtttattttcctgttggcccctactactctctcaaagtgtctgttttttagttttatatgagtcatttttttcttgaaaaataaggaagagattgacacactaatgataatattgcacattaaagctaaaggtttaaaagagttttcattttcaaaatgcttacactcatttctcaacttttataaaatcaaatggcttgaagttttccaaagtgtttttgcaacttcagtagtaaagccacaactttgaggactatttattcttccaattttcattattcaagttcatatggaatctgatatatgctttaattctacactgttcatgtaatagacagtaataaatataaagttcaccaagaaaatatttaatttatttactttcttaaggcaacatccaaagatttagattagtactaatgtaaaatacagaactattatcttaaaaattgggctgaaaaaacagactttcttattaaaattacactagtactatttacatagaatcaaaaaacaaataggatttttaaacttatgtgttttccttattgttctttttccctcaggcattgataataaatttgatatacaatctaactcatatttattttagcacaattgagctagaatttaagtttttaataaattattacaatttatttaggggaaaccgttgaatataagttgatagtaattgaagtttcactgtcttaatcacaatattttttaaaatgttgttttctcatttcagtaggtacatcacttcttgcaataagataaactctagggtgctgcagtccaccaatttggtactttaaaaattctgttcaatgtatcataatttctaaatattttagattattttcagtaaataaaaaaattttttttaaagttaatggctctttaaaatgattttaatctgttttttgactaattatttttacaaaagttattgttttaattacatagattcatggtgttttaaaaatttttcttgttgatgattaaaactttttggtatttcagtcttaagctttaacagaatggaattaccattttgataaagtatttatatgttcagcactttcaacttgtaataataaaacacctaagcatcatttcctgtagatcgctagtcacagcacaaatacacttttgttgaaattgtcaaggagtttttcgttccagaaatagaaatctttttgttttgtttgcactgattatcacacagattcaagagatgctccaggatgtagtgatttctgcagaacattagaagactttacaaactgtagtactttattaataccattgttttatgatatttgatactttaaaaattctattcaatgtatcataatgtctaaacatatccagacattgttttctcttaattatgggtgttcatttttaatatagtgtttatacattttagagttttttatatactgtgtatttactacttacatgagaattacccagaatgggttgtatattactaatcagattcattcaaaattaacctatttaggataagaagcaactacagaattggcaaatagtattatattttgccatgaaaagtaatggcaaaaaattcaattatttttgcaccaatctaataataaacttaggactgccataaatcatccagtgctttttaaggaatgtgtattgctgctttaccatctgttgtgactcatgctaatttagcagagattgctgaaaggcttctcagaagctcccatatcaggaggcccaattatcaattattattataaaatcttaaagcaattagcttgaaacaattagtgtattgacattaatcaatatttatacttatttccattattatttattgacagcggtgtaggagttttactatttcttctactgttgtagccacagctgatatcagctccagaaattgccagattatttgtacattctccccaaaacagaagcaagaaactcactttctgtccttccttgcagtttgactatagacacgtgccttagagtctaccaattacacacactcatgccagactgactccaaaggaaacaatatgaagaaaaagatggctcaagtaaattatttagtagtccacaggtcaaattttgagtttggtttttagctcctttaaccctgcaatggcaatagacaggtgtttcttttccacagtcaataggaagatggtacatgaaggctcagagactgccaaataaaagcctttgaattccagaggcaaagtgagtttggttactatgataggcaacagacctgagcaataatcagaaggttttgacctgtagatatttctggtggtgagatggatttgtataactgaaatagatgggagccaccaatattctatatgacctgtataaccaaaaatattctaggtatagtaaagccatcagaatataaagcatctattaattacaccttttaaacatatgtactctagtctcaatttctaataatctaccaaaggaaatcatatgcatatacaaattattttggcaaagggcatactatgtcaatgttgtgagaaaggtagatgtgctacataaacacagaaaagactgaaattctaggtagggagattaaagaagtttttgtgaataatttcattgtctgttcttgggtgaaatttgctgtccttccagttacctacatttttcacaattcataatgactccattttcttcaaaattatatgttccaccctcatttttaagctgcttctttgtctagtttagacatcatggcctatcattttaatcactatctagccaacgagactaaattttattgtatccttgctcatctttttggatctttttggatccctcttcaacttgtctactccgacacttgggttctggaaagtctcgtctacattaactgacccgtcatctctatgcaataattcatttaaatgatataacaattctgtctcatttttcacacagttagcttcctcctttcagaggctgcttctttctccacctctcactaacagaattaagaataagatgtccttccacccagttttttgaaaaagtcatgataaataaatgcacccaatgtcctgttcccccagttaaaaatatctacattcactttttgtggcttatttccttcattaatttattaaatggagataatacagttgcatagagttgctatgaagattgaataatctaaaatatgtgtcatgtgtcctgcatgtagttagctaatttagataatagctttctttccactttcccaaatttagttcaattacctgcgttctggattccattttctctgagccatatttgcctcttctatacctgtgagccatttgtttccaccctttctattgacttcacacaccaatatgagtcaattatgagtcaattctcacttgaagcaacacctcctatgaaataccatgcctacatttcctttccttcaaggttaatttttttgaaagtcttatttatgttgaagaatggtaatattcataaaaaactattttagttacccataatagggattaacaagaattaaactcagatggacagaaaactttttgagtatcttatccaaacagaaacaggaaatgatttcttggtatatgttgttctaagcaaattgtttaatagtaatataaagtgataattcagttccattcctctgtcataaatatgcaaaattcaggtaatagaattttcaaaagcccaatactgaagtcataagcaattactatattgtgctttttttggccaaaatagagggcaatggaattgggaataaagtatattgtaacattaaggcaaaattattgtaaattatgatgacatatacagtctggggtgtttttgtttttttgttcttctcattgacttcttagctctctttaacctggtgtcctgtaaaacaactcattaaatgcaatgggctctttggtatcttttttattcctaagttcagtggcctcttaatttcttaacttgctggtccttctagtgtttgaccttgctgaccatgttttccttgaaaaaaattcctccttggcttccccaccaggacacatttgtggtctctttctactcatctggcaaattcttagtccttcaatccccccatttttcctatctacctattcatggtttatcattccattcccacctcttcaccagattttaagatatactctgtttcctttaagtcttaccatagaaataacagaatattctactaaatgtatcaaagtcttgcattagtcaatacctttacctttttctcaggaaacatacacattttaaagcatcttacatccatctagccttttcttgaccttgtcatgttgtagtgaattttaattttatcttatttatttgaaaacctataagatgctgttagtattgctatacagggccaaccctcatttttattttcatcatttttacaattcatttttgttcattctctcttacatctcagatttttcatataaaaccattttacttctgaagtatattctttgatttggtgatgtaacctctttaaaataaatccaaaatgttcttattttctcttcattattgaaggaatttttcttagtatataattatgacaattattttattttaaattacaataaaggcattctactgcttcctgattctcaatattgcagtccagtcgactgccacttaacttctctgataaaccatattttcccctcacttctgactgcttttaggagcctctcttttattggtattattctgcttctctctgatgtggccagttgaagatttatttttttatttgctgtgcttaggatttgatggacctctggctgtttcaagagttttgaaagtctttcaatcttggtcttttcaaatattaaccttccccagattctctctcttccctttttctgagacatcaattagatacattttagaacctttcacttctttttctatgtcccttaacctcttacatgtttgcaatctttttttctgtgtaatacgttttggataattttttctattatatcctttcaattataattccttcctcagctttgtcaaaacagtgtttaaaccatcgtttgaattttaaatttgaatcattgcatcttccacacctattttggtacatcaggaggtaattttatagttaacttttagtttcttaatctctgcatatatctgtgcagattgtctatctagttaacatctacctatctatagctagctatctattcagtgtacttgataatttgcatctaataatcctaaaaactgtcatatctatacatttccttttatgtatgcttattctttttttttttttttttttttttttttgagatggagtcttgctctgtcttccaggctggagtgcagtggcacaatcttggctcactgcagcctccaactcctggtttccagcgattctcctgcctcagcctcccagatagctgggattacaggcacatgccactgtgtctggaattggttccttccggtgggttattggtctcgcttacttcaggaatgaagccgtggacccttgcggtgagtgttacagttcttaaagacagtgtgtccagagtttgttccttcagatgttcagatgtgtccagagtttgttccttctggtgggtttgtggtcttgctgacttcaggaatgaagccgcacaccttcgccgtgagtgttacagttcttaaaggtggcgcgtctggagttgtttgctcctcctggtgggttcgtggtctcactgatttcaggagtgaagccaaaaaccttcacagtgagtgttacagctcttaaaggtggtgcgtccggagttgtttgttcctcccttccggaattgtttgctcctcctggtggattcgtggtctcgctgacttcagcagtgaagccgcagtccctcttggtgagtgttacagctcataaaggtagtgcagactcaaagagtgagcagcagcaagagttattgtgaagagtgaaagaacaaaactttcacagcgtggaaggggaccccagcgggttgccgctgctggctggagtggccagcttttattcccttatttgtccccacccacgtcctgctgataggtccattttgcagacagctgattggtccattttacggagtgctgattggtccattttacagagtgctgattggtgcgtttacaatcctttagctagacacagagtgctgattggtgtgtttttacagagtgtggattggtgtgtttacaatcctttagctagacgcagagcactgatttgtgcctccctcacttgctgaactctagtcccaggttaaaaatgagatctctctccacaattctataattttaaataataatgtttttacaatgctttgacaatatacatcaacttttctaaaatacttcatcattttccaaatgacattgacactgagggcgtatattattctccattagtgatgttgaaaactatttgcatataaaatgattagagcaattaaacactttaacaatgtaatttttcttaaaaatatatctaaaaattaacctcctggtattttattattagagagtcacataaggaagaatgatttctgtacagatctttttcttttagcagcataattcattttcctgctctgaagcttccaatgtcttctgattacctaaaatattttagtttgggatttaattgcctccagaaactggctataatctaatttgagcctattttcctttgctccctacagacccatatgctcaactatctactgtttatcttcagtgaaatgtcccacaagcatttaaaattcaacatgtgcaaaatttaactttcttctccccgatttattcttcttcctattgttttgtctcagtggtttaaatcccctgattaaccagttatccaaaacaccctaaaataataatagcttacttgagaaccagggacattgttaacagtatatcatttgatttctaaaacgttatctgtgaatttctattattccaaatatatatgtaaggactgagacttggcaaggtaaagaaatttgtctcccagctagaaagtacagcaggtggaatttgattgaggtttgtctggcctgtaagcccctgttcataatgggtatgctgaactagaatctctgaatcactctttcctttatcttcacagaaacacgtcctgtcacattgttttttgatactttctttccaaatagcagtcagtaacactgtcagatggctcaaatgccagtctattcccctgtataatgcagggatctatgtgccaccagatagagatacaaagagagtcgctgactaaagactttctatgacctgtcaggcacaattatgtttctcaaaagtatttgagatgttcctacacccttattataaatatatttttatttggcttaatttgggtagtatttttgtttgtgtctttcaatttaataaattccaactgttcgaattacttattactatataataaactatctccaaacagaatgtctatagatgacaatttcttattattgaacctcacaattctttccttggaactttgagttccaagagtatagagtataaagagtataaagagtgtggtccatctctgtctcataaggtttgggacctcagttgggttgactcagaggctgatgccgggagcagctgggagccatcgcattagctgttctctcactattcattccctttgatctttattactttctttgtcttattttggattaattgagctttgtatggttccattttattttctttactgatttatcatttatgtcctagaatttacaatatacttctttaattaatcaggttctcccttcaaatatcatacatgtagcacggggatctcaaaatagtatattcccaatcgcttccgtccatgctttgtaccactgatatcatttgttttacttttacatgtactgtaaacacaaaccatattgctattattttttcttgcaactgtctgttatttttcagactattttacctaagaaataagaagttcttttatcttaattatactccagccctctacatttctttgagtgggtccaaaattctgtttgtattatatttattctcctttaagaaccttaatacagtttcttgtagtgtctgtttactagaaatgaattacttcagtttttttttctatatctgctttctttttggaagatattttttacagagtataaattatggattgacacatttatttttcagtacatcgaagatatcattctatggctcctaaatacaggatcaattatatagatgaaatttttctgttgtcattcaattttggatggatttaattcaggtcaacagatttactctatagtaacatttagttagtaagatctcatttatattggctttagggaggggggagggaaagcattaggagatatacctaatgtaactgacaagttaatgggtgcagcacaccaacatggcacatgtatacatatgtaacaaacctgcacgttgtgcacatgtaccctagaacttacagtataataaaaaaaactaagtatatacttcataggctttatgatgactgttacgtttataagcagtcactatgaaaattgcaatggtaattttatgttagtttatcaaacataaatcttgtttaattttatattttgttacctatactttgggggatcaagggaagagatggaactcttcctctgaaaatgcttcttggtacttaaagtagtaaaactataaaacaataaacatccagtattgagagatgatatgatagggcattatgaattcctgtgggtgtctaaattatgtatgtcagttgaacattgtagaagttatgtaaatcagcatagttatgtataacttaaccttgatttataaggtcttaactcagattatgactattcattgacatttcatgagaagctttagaaaactttctatttttaaacaccatttgtatgtagacttctgctgtcactgactttgggctttatattttcatagagtctttatggaaaaaatagaatttattttccacttttgtagctatagctgctgcacattttcacgctgatttatttttttgtttcttagctttgatgttttcaaaccaaggattgtgattttaggttagaatcacatactagaagcattaagactacgtctgtggatcagaatgctttagtgataaacctactttgaagacatactcttaagcaatctggatcttaaatttatgtgaatacttttttagaaaatgataaagaaaaatggaattacttcaaagtgtttcttgagtcgttgactcttttagtatctcaaatgttaattagaataattggaatcactttttagacttttcaacttaccttccttgggaagtttgtgcagtgttatagtttagtttagctctcttatagggtaatggtttgctagtttaaaactgtaaccaaaccaactgatcggacaacatttatccaaaatacttaaaatgttagaaagtttaggaatgttataacctaagtgtttttgctgataactttttgttatttatagatatttgtgtatttaacatacttacttctggaaatatatgcctttcctaaaacgtaaccatgcattcaataccatggcctatctatagaattgaatattttggaccacgttatctgtggcacagtcagttctgtgtttgaggtaaaagcagtaacggttagttttctactttgtcttgtagaaggtagaaaccatgtgtatgttatgtttgtctataaaagaaaaaatactaatattaaataagttcttatgactgagtcattcacttatttttccaataattcagattgtatgttcctagtgccattaggtatgtatgtatgtaacttttatagtttttcagctgaaagttgtattttttttatcaggactctttaatctcattttaatttcctttgaatgaactgtagttattttatttattcctatatttaccatctaaaccaactgtaatgacatgtacactaataaagaattgaacatttataaaaaaaagatagcattctatagtcttcaggctttcacagtttcatataagaattctactgtaattttaatctttgttcctctgtgtgtaatgtgacttttatatctgcttgatgtcagcattttcagtttgaattttaatttcatcagtttgaacatgatacgtctatgtatatggttctattttgttctgttttctttcatttgttttcatctcttttggtatttttcttattggtgttctataaatttttggatctgttgtttgttatgtgctattacttttaggaaatccttagtcatcattttttcattatttcaaaaaaaattcttctaccaaattctctcttttccttctgcattttacctatgtgtatgttatgttgctcggttttgtaccaatgtttgcggatgctctgttttatttttgtttcactctttcttcttttcgtgtttcagtttgggtaatttctactgacctgccttccagttcactgattatttccttgcctgtgttgagtgtactcatgaacacattaggagcactctttatctttcttactgtatttttgaacttctagaattttcatttgattatttttaattgcttccatctctctgctgaaattacccacttgatcttgcatgttgtctaccatctccactagagcctgaacacattagtcatagttattttcaatttcctctcacatagttccaacatctgtgctatatctgagtttggatctgatgactgttttgtttcatggctgtggcttttcatatatataatttagcctgggaatggtacatctttctatctgctaggccattagtgtagaggtttgaggctgtggtttctatagttaaaatcaatgcaacctttgtattcccatagtgaaacattatgtggagaatgaggactgacttgccatattaatatttgcttgccctcagctttagatgttcctttctaattgcaccccagagaggatctctttgtacactgtcattactgaagctcgtttgcttgtgggtggtgggtggtggtgaggggttccctgttctgattaagcctcaaccttagacaggcacaatatctttaaccctcatagatgtggccttctcagttatcctgcccctgggctgactgtgtgggcccagcctctctaggagttggtttttcctggtatttttatcagcagtactctacaggcaaaagtgtttgtttcctttcttcccatgggcttttttcagtcagaggagatgagaaaaaaggttcaagtagagtttcttgctcctcgttttggggtgctattcttctaccccaggtctgcatgaaatccaatactttcttcaggttctctcattttttctgtgattacatgggaggattcgtggagaaaaatcctgcaagaagatgagaacttccccactttctacaggtctcaagggttctgcactgcccttccagccttccctgagccttcaccaattcattgactattgtatctgaattctacttgttggtgcccagtggcatctgggaagcaagcacacagtatcctctttccctgcaggtgcctgcccctcgttagagtttggcccattggttgctctgcaacctcagttatctgaaagattacaaaagaatcatgaatttgaagttattccaactcgtttttgttataagggtgggagtgatattcttccctgctctttgcattctggaaaggatactagaagtccttaatgagatattttgcattagtttaaaaataataggtcttgtcttcaaaatctagtatgaattgtttacagcacatctcaatttggagtcaccatatttcaagtgcttaactgtcatgtgggattaatggctttcatatctgacaattcaacccaatgcgctcagctgctgaatatctcacacataatagtcataatatgcatattctttaagtctgtctgggctgccataacaaaaatatcacagactgggtggcttatcaacaagaaacatttatttctcatagttctggaggctaaaagtccaagatcagggcactggcagatttggtgtctgatcagggctatttctcatagatggcatctttttgctgagtcctcaagtgggtgaaagagacaagctcccttgtgtcttttataggggcactaatatttttaataaggacgatgccctcatgatctaatcacttcacaatgggctcatcttcaaataccataaccttcagtgtttggatttcaatatatgaatttgggggtatgccaacagtcagacaatagcacatatttcaaattaatattatctggcctccattctttgaggagttaaaagtttagagtttgatatttttggtgattttgtattattcatcttaataatgttaagtgcccatttgaaatgaacatagaatatgaagacaaatatattatcctaaatgtgtattttaccttcattatttgtttataaacctgaagatatcaggactgttactgtagatagttgaggtaaaaatttgttaagtttattcaaaagatcattttctagtgcatattgtagtacctatctttaatcctgagttgttatattaaagtcttgctttaatgtgatgtaaacattttcagtttctttatactaaaattcttcttattattcaacatcaaaataatgattttgcctttaaagcaccagaagcaagttgtaagatggtatgaatcaagtcattttcttgaatagcaacaccaaatagaaatcctttaacaaattcatcagttttgatttatgccagatgcatagatgtgaatttgaattcctaatgtagaattgaagcagaaatactgaggaggtctataatggcagcaaagtcagatgttttacagtttatttattttattaaattcattatttttccagataaagtatgttctttcagcccatttattaatgtgacatttaattgtggtcccaaaacctaaccagttataataaatctttgttcctctcacttcatgtactgtactgttttctgccttcatctgttttagtatgagacacactctgattgagagaaattgtttcaggaaatcagttgttctaaggttcttcctcaccacccctcccaacccccgcttaggtatgttctaaatgatgctggtggtcaataatgacatctttattatttttcatacttactatgataccataaagacaaaaacatgtatggttacttcataaataaccctaaatgcattagaatttaaaaatcaatgcttagattcttgagatagccatgaatcacagagaggtctacagtaagctggcagagaagggacacagcagcaggctataaagcatcataatgtttgtccataacaactacccaacctctgcccaccaaatagctcagttagcaggtcaattcatgtgaatttgcacgaaaggtttaggttgctagtctgtaataacagttagcatgcaatagattgtggctgtaggtttcacaattattctggttgtgactaagggttatacatttcttataagttttttcttgtgttttctaggcccagcatacaaatttgtgcatgactaaaccttgttggttacagtattttatagttttggtagaatggtgctggtttggagtgggcttaaagagacaatagaagtgggagaattggagaaaaactacaaataactctttgggggaattttgcttaaaatcaagcaaaacaatggaaaagcgctattggacaaaacaggatcaagagcgttcttttaatgagagaaaaagggcatatttgtacactaaggagaatggtgtgagagacagagggggaggaaagacagaaagagaagagaattgctggagaaattgagtgatggtgggatccggtgcacatatgcaagaactagcttgagacaggcttgtgtagtcaaaccacagtcagagcaggggacagtgtaagagggtgcagaggctggtaggtgcagtttgaggcatccagaacttttcttctgattgcttccgtttcttcagtgactctggaacaaggtctttatctgagagtgagaacggaggaggaagagcgttgaaaaaaagagaaggtatgaaatagacatttagaaaagaaagagagaagggataagggatagtgtcccaggcatttcgcaataaagccatattaaattgaacttcaagtcctgtacttatgaactcaaatccagtatctcatctccatttccactattgttaccctagctcaaactgccactctctcttgcctaaactcctaaactggcctcctattggcttacacatgtccactcatgctgctctccaatccattcttctcattgcagtgagggtcatcttttcaattgggtatgttcatgatcctgctccatttaaaactctaagcccatgcaagatacaagcaaccccttctatgacatcttcacctcaactctttgttcctccctcacacttagcagttctacagcaatggcttttttcactctcttaatgagcagtgtttcctcatctcatgtggcttcataaatgctgcctggaaaaatctttctctgtatcttatttctatttttcctttatatttcagttgaattgtcactttctcgaggaaaccttcactagtatctttaattaatttaatttccctgttaaattcttttatggtgccatgtactttttgcagttgtaattttattataaatttacttgtgagatcatttgattaaagaattttccctgctgaactggggagctctgagagagttaggactatgcttgcttttgcccaccagtgtattgctacatagtaagtaaatcatgtctggcacacaatggacctcaataaatatttgtcaaattaattttgactgagtaaatctcatgggtaccaattatcaaaattcactacctgtagaattctgagctacattctttataaaattcatttcatctttataaaaacttatacagtaaaaattattgtctaattttaaagatggagaaattgagacttagagatgtctctctaggtctttggagaactcttaagtaagttccccaaagttatccagctgatatttaagccagacaaatttgactccaaaagaacataccattaatcactctgaattgtgatttttaccaagttgctcatttactgcctgatttttgttcccctctttcagcttagataatgtatccgttcctttttagaatacttcaatttgcacaatatacctgattaacttaaaataatttgttttgtaggcacatgtttcaggactttatattatcaaaacaagtgctcattcttcttggccaaaataaatagcattccggttgtatatgtgtattagtccattttcacactgctgataaagacatacccgagactgggaagaaaaagaggcttaattagacttatagttctacatggctgaggaggcctcagaatcatggcgggaggtgaaagggacatcttacatggcagcagcaagagaaaatgaggacgatgcaaaagcggaaactcctgataaaaccatcagatctcacgagattcattcactaccatgagaacagtatgggggatccgcacccatgagtcaaattatctctcaccggtccctcccacaacacatgggaagtatgggagtacaattcaagatgagatttgggtggggtcacatggccaaaccatatcattctgctcctggcccctccaaatctcatgtcctcacatttcaaaaccaatcatgccttcctaacagtcccccaaagtcttaactaatttcagcattaacccaaaagtccacacacagtccaaagtctcatctgagacaaggcaagtcccttccacctatgagcctgtaaaatcaaaagcaagctagttacttcctagatataatgggggtacaggtattggataaatacagccatccaaatgggagaaattggccaaaacaaagtaattacagggcccttgcaagtctaaaatccagtggggcagtcgaattttaaagctccaaaatgatcttctttgacgccaggtctcacatccaagtcatgctgatgcaagaggtaggttcccatggtcttgggcagctccacccctgtggctttacagggtacagccaccctccaggctgctttcatgggctggcgtttagtgtctatggctttttcaggtgaatggtacaatctgtcggtggatctaccattctgggatttggaggacagtggcccttttctcacagctccactacgcagttccccagtagggactcagtatgggggcttcaaccccacatttccattctgcactgccgtaacagagattctctgtgagcgccccacccctgcagcaaacttctgcctgggcatccaggcatttccaggagtcaggagtcaggagtttgaggccagcctggccaacatggggaaaccccatctctactaaaaatataaaaaaattagccaggtgtggtggtgagtgcctgtaatcccagatactcaggaggttgaggcaggagaatcgcttgaacccagaacgtggaggttgcagtgatccgagattgggccactgggccactgcactgcagcccaggcaacagagtaagatcccatctcaaaaaaaaaaaaaaaaaaaaggcagaaaaggattaatgttttagataaaacaatagtaatgctaaagtttaaagttatataattctatagaacatctatgtttcatctccaaaataattttacagtacagattcattacaaacaaatgagattttcagctctcagtgtgcctgtgaactagttaaagcaagagaacattaaattacaggcttactaatttatattcttgattttacactgaccaaagcaataaaatccttccaggccactttactttgaaactaccaaccttaaggcatttttaaagtataaagagtcaatctctagtcattcaaagaactgcttgcttcccacaagcatgctattgtgagcagatcctccttttcttacacataagagtgcaacagggccacctgtggcgaagaactggagccaccactaattatctcaggcagaatcagtcagaaactttgtgacctaggctaatttcaccatcagtctttaaggcattatattttcggtagggtgaatggcaattaaactgtgtgaattcccattatggacatttatcagaactgaaaagtacaggggctgcaagtcattttaaattcatgagtgggggaagcagcagtgagcaggcacttgaccacattgagcttgtattagatccattttggggttaataaagccacagggatgttgtgttagccctaatcgtaggtcttggctgagtagtctcagtccgcatttcccaaacggttcattactcttacatagtcatttcctaaatgttcattgacttctctgccactcagaaagggcacacagaatcctctttcttttgctctcgcatgcgtactcacgaatttatgagaattttttgacaagccattgcttcagatttgaacaggaggcaccatgattcatgtaaaatgcagtatttcatcaaaggatgtgaaaaatgtttctggcaggacttctgatatcctgtgccagactgaccacaagtccctgccttggcatcgtagtgccaatataaaagccagggtaaaatattatctttcaaaatgtaaggctccagtgacctttagtacttttaccaacaaaagctattttcacagttataattcaagcatccagatttccccactgcttaatacacctgtagttgcaaagaagtcatttgggatgagtattggtcacttcaactcatataggtgctttttcgtttatggcagaccttctaaaacagaggatccaactctcaggagatctaaggcaaccaaaaagtgggttctttgtattcagaacatgtgttaaaaacgaaaaactctcatagtgaagccaaagcacattaatcctcctaatctgctttcagagtaatgaggcacaagcctttgtcgctggcatgctctgtctgccgtgctaacacagtcagtggtaatcacagccaccactcacaattaggaaggctaaaggcaaagaactagggtgagaggtgactacaccaccatcccggtcttcctgtaccctttccaattgtctcgtctggagttacccatgagctatttaagtgaagggttaggtgagttacttctgattcactgtaaagagcaaggaaagccatttgctcttgagcaaacatttccaacgcttatgtaaataacataatccatttaaaattatgtctaggaaaataatcatttagaaatgtgttgtcaggagaaatcatcgtaccatatctgcatgaataggatacataggtcactgtaggcaaaacagctcttcaacactactgtcattttgagtgcatgaagctaagaagaaaagtcttgtttaggtttattttttcccttaaacttttcagtttatcctcactcagttcttctccaataaatgggaattctctgtttagccagttttatttttgatttttgcttctgccatcacagtgcagtatggggtgttggaatcctgaagtattgttccgtaatgtctcttaccacagcttatttctcaaactgtactgggattttctgaaaatgttccagtaagtccagtattttatgataatttttacattttttattataaaaattttttaagtgtattataagcatatctggaatcattaagattgttttgtaacctaaaactaccagaaaatttatttgtatttatttatatcaaatgtggctgctctatgttaagactattaccacaatactttgtgcaaatgaaatgtttttaaaagttcaaatagatataagcaataaaataatttgtcctcactcattcttggtagtaaagacatgcccaattaaacaacaaacagaagacaacctgcattctggcagtcaggaccatattcacattatgtgagaatgtatttgggagatcccacatttgtagatagaagaaagactaaagcagttcattgataatacatgtttaagcaatgaaggcttattttgttcttgatttcaataattgctttatatactgttgacactcttggttacccaccagacatccatcactcctcctcttcctctttcatggcatgtgattatgttagccctctgtccgcctgcatggccctaccccagttcctatcccttgtccctttcttttctcttataatttagatactaggaaagtcttctggaagtcagggattataaactccatacttgcggttctgtgtaatacccaacatatatacattcacaaactacaaaaactgaaatggtacttctgaaacttaatctagtgcttcaccctatgcttcaaaaagatcagcaaatgatctagaaaataaacttgaatataactctaccaatttttagtaacatgctcatgcaaatagtcggtctttacatgaatattgttaaagggcaattcagaaactaatttaatataaaagtgaacttagttacatcattccactattaaaaccaactttaattttaaatttggcaaaataatatcatatcttagattaaattaatattattaatatgaatttccttggcatcattgtttgttcacagttaatttgtacattagttttggttttaaaattgaccaaaccccacatgcaaaatgtgtttaaacctgcttaacagactgtcaggcttcactgactatttagtctaatggataatttagactggagagagagagagagaaaaagagagggagagagagaataaaccacaatggttaatggcatagaatgcagaggaagaattctgtatttgaactttaacttcacccctcagaaaatttgtgacactgggaaaatatgaaactctccataaaaagaaaataataccagcacttccctagtttgtcattaggattagatcagttaatacatgtgaaggacttaaaatagtacttggcacatggtatgtgcaagaattacttttttctgttctcattactattctttattatttaattattttatcatatgcaataattgaagtggttatttactggagggaccagccttgagctgataattgtaaagcatccaagaaaaaaaattctgatgtccataattttatgtctaaggaagctaccttaagactggccattctgctatgattcctaggtactaaccaagtttgaattcggtgtataaagctaaacacagcccacataaacttaccttctgcataaatgtttttgctgagttaatttctggtgttttgcccttggctattacaaggagatgacattttaaatgaccatatttgtttgcaataaatgctaggttattcacgatctgttacttcctcccacacaccaagttcccagaaggcacaattcaaactcatttttcagaaaaattagaaacttgtatttgaatttatgaataattatgccagcttagctctagggacattatgctttggtttggttaccggaggatacacctcttacagctttgccttgcccagtgacttatactaccaactccagctttgttctgcatgttccctggacacttaaaagaaaatgatctgctgtatgggactggggctccaattagcatcttttttgcttaatttatactattttcttgacaggtgatcagcatgtagacttgtgtggcctatcaatggagaagacatttattattctctttgcccagttcttacccttgtttggataatcttcaaaatgtggcttccagatatgcagataaatgttaaaacactttgctaatgcttctgctgtctgtacaagaaccatgcctttataagaatattgaacaccagaaggacttggtccacaaggagaccccattgctgaggagctaatgtcttgaaagtgcattaaaagtctattttactaatcaccggggaaatggcaatcaaacccacaatgacatatcgtctcacatctgttaggatagctattattaaaaagacaaaagataacaaatattggtgagaatgtggagaaatgggaacccttgtacactggtgatagaaatggaaaacggtgcagccactatggcaaacagcatgacacttcctcaaaaaattaaaaacagagctaccatatcatccagcaatcccacttctgagtctttgtccaaaagatttgaaatcagtatctcgaagagatatttgtagagtatttctcccttatcttcagtttcactttccctggtttcagttacacacagtcaatggcagtctgaaaatgttgagtggaaaatttcagaaataaacaatttatgaggtttaaattgcagactattctgcctggtgtgatgaaatcatttaccatcctaccctgtcccacccaaaacatgaatttgcacatgccaaaaagaagcaatacagtgcttcctctaagtaaaaaggtgaaaattattgacttaatgaggaaagaaaaaaattcagatgctgagtttactaagatctataataagaacaaatcttctattagtgaaatttaaaggaggaaaaagaaatgtgtgcaagtacagttgacccttgaacaatgcaagggttagggttgccaacccctgtacagttgaaaatctgtgcataaacttttgactcccccaaaagttaactactaatagcctgctgtccatcagaaaccttacctataacataagacagttgattaacatgtattttgtttgttgtatttattatatactttatattacaataaagtaagctaaagaaaatattttattgagaaaatcataataaaaagaaaatatatttagtattcattaagtggaaatggatcatcaataaggtcttcatcctcatcttcttcatgttgaataggcagaggaggaggaagagaagggattgctcttactgtatcaggaggggcagaagtggaagaggtggaggagttggaagtgaaggcagaagaggcaggcacactcagtgtgacttcacggaaatacagcattgtttttgtctgagttttttgcctttttatttctctaaaaatatttctatatggtaccaacctttcttccaccatttgctttagtttcagtgcccatataatagaaaaacctatgttgtaaaagagtcaataacagccttgaaaatcagcacccttatgtcagattgtctaaagccaatttctttcttggcactgcttcttctacatcttctccttcctagtctggaactggctcagaatcactcatctccatcaagtcaccttttgctaattcctctggggtggtgtctattagtgctttaatttctccaagatccataagctgaaagccttcactcccaccttttttgtcatatccacaatctgtttcatgattcccttgattggctctgttgtgaatcttgtgaagttgtgcactacatctggacccagttttctccagcaggaatttgctgtttggtgcttggtgactttcacagctttttctaaacaacaatggcatcttcaatgatataatcctttcagattttgatgctctgtgtatcagggttttcttccatattattgacatttttttccgtaaagtactgtatgtaatgagccttaaatgttcttatgatctcctgatctagaggctgaattagagaggttgtttttggggacaagtaggtcattttgatatcctccatgttgaactcatggggttctgggtgggcagggccattgtccaatgtcagaagaactttaaaagtcagtcctttattggcaagatacttcatgacttcagggacaaagcaaggatggagccaacccagaaagtggcttcccctgtccaggctttcttactgtacaaccaaaatcctggcagctggtggttatttttttccttcaaggctcggaagttagcagctttataggtaaaggaagtctgatcataaacccaactgcatttgcacaaaactacaaatctctttctaccttaaatcctggtgcttgcatctcttacttactaataaatgtcctttgtggcattttttttccagagtagggcactttgatcttcattaaaaacctgtctaggcagatattctttctcctcaaatgactctcttaaaggtgcctgggaactcagttcctgcctcttagttggcagaagctgcttctcctgttatcttgacattttttaagttaaaccacattctaaaattatcaaaccatccattgctggccctaaattctccagctttagattcttcacctttcttttgctttaagttgtcatataatgactttgcttttctttgaatcatattagagtttgtagttatacctttcttgtagcaatcctgcacccacataaaagctgcattttcaataggagattaaaaggtattttgcaaaaagtgcgcggtttctatgcctcctggcatagctgcagcgacacattcatgaattttcttttctttttaacaatggtccttatgctaatcttgaaattgcaggcaactgcagctgcagaccccaatctaaggtacatataaagcaattcaactttctatagtaatgtcataatttttctttgtttcttggaaacacttccagcacttgttgtgggtctgatggtgttattaagggtctatgatattataatacactaaacatgatgaaaaatatacaagaaacttcagagatcaatttttagtgtgacacacaatttactggaaagacacacttcttacaagcagctgatcagtgtcacagggcatttcaagcatatacttgcaacaggagctcagctcaccacaacaacaagaacaggtggctgcaacattattacagtagtacagtgtgtgctacagttaattttatgcagttatgatttcattctgcatcttcacatatctgtcaactgcaaatggtaccaggtatggtctgtaagtgtttgtgtgggtaagttttgagaaattttaattttgtgtaatagatttatgtatattttatgatagtaaatgataaaatagactagtatctacatatattttatatattcatcaaataacttgttctcatttcttttgatatttctaggctacatgactcatttccaagttttttcaagtcattgcaacaatccaaaaaatttttcaatatgtttattgaaaaaatctgcatataagtgcacctgcccagttcaaacccatgctattcaagggttaactgtatatgtagagttcagtgctatccacaatttcaagcatccactgggagtctaggaatgtttctcccatgcataaagggaggctactgtaatcccatgtttatcccagtattactcacataaccaagatgtggaagcaatctaaatgttcatcagtgaatgaatgaataaagaatatgtggtaaatacatacaatggagtattattcaaccttaaaaagaaggacatcctgctctatgtgaccacatggaggaacctggaggatattacactaagtgaaataagccagtcacagtaggacaaatactgcatgactccaacttataaaaagggtcaaaaataatcaaactcttagaagcagagagtagaatggtggtttccagggcatgtggggaggaggaaataaaaaattactattcgaaactttgctattcataaatagttgtgctattcataaattttagttatccactgtcaataagttctagagatctggtgtacaacatcacttttatagttaataataatgtataatacacacaaaaatttgtgaaaagggtagatctcaggtttaatgctcttactacaattttacaaaagaaaaaattgaataaaaaacaatattgccaccaaaacatctatttcatttatattagaacagtagaatttcagttatgactaacgaatctacaatggcttaatgtcattataaattgtttaatagcagatatcttacttgacctgggacaaaatgctatagaaatattacaagtaccttcaaaattcaatgagaaaaaaaagttaagttttttctccaaattatttaaggttatggagtgtagtttgtactaactgtgacttcaaaaaaattaccttttccgctttcccacctatgaaaataacttttatttttatagtgatttattcatcacaatcttcataattcttcctaaaaatatctgacgttcattaaacattgatttattgaattaattgctggaaaaaatctagcatctacttttccattttgtttcaggatatttgatgtagagcatgactattcttagctcttaaagtcttagagttcgctttaatcatgaaattgcatttgagataaaataaaaaataagccagagaagttattgaaagtagtgtaaatatgacctataagaacagctacattcacctctatccttcaagagacacactggacaattttaatatttatattaaagccacaagggatttgaagtgatccatagaaatgtgtgaattttacaagacaagattaaataacttagggagttcggggtgaagggaactgctagtgaaaaaaatggaagtgaggggtaagagttacacatgaatattcatgacactgtgttctataaaatggctagaagttggactagagaatccttaaccctagttagagaagtaaaatggaatgtactataaaaccaaaatcctttcacaatgttcttttgcaataaaacatcagaaagataaagttatgtgtaagatttttaaaaatcattaatatttaaataaacagtaaagggactcacactatttgctaatctgcttgtaaaggttggtatagaagtagtgacatgaggatctagatagacgaaatggactactatgtactattcagctttctagctttcgtgcctaacattgctaagttagcctcagtgggtaactcaataaatactcattggatgaataaatgagtatagcaatcaattaattaatagacaaaattaaaaaagaaagatgactgggaaaaaatgtctaaaaaatttctacagtgtatttataactttcattttttacatgcagaaaattcaaactcatattaggttgtaaactcataagattagtgactattgtttactcatcatttatttttcctcctacccttaccctctaaaaacatagcagctgtcattttaaaaactcctactctatgtctggtgcttttcgtttatctcacttagtgtcttagctcaggctgccataacaaaatagcatatactggatgatttgaacaacagaaagttatttctcaccattccggaggctggaaacctaagatcacggttatagcatggttgggttttggtgagtctctcttcctggcttgcgaatggctgccctcttgctgtatactcacatggcctcttctgtgcaagtgtgtgttggggtaagggaaagctctctggtgtctcttcttataaaagcactaatcccaacaggagggcccaatgtcatgatttcatctaaccttaattacctctcaaaggccttttctccaagtaccattgcactggggattggggctttaatatacaaatttgggggtagcacacatatttagtctgtaacatctagtctttactagaccctgtgaagttagcagattgctgaagtaaatgggcatgaggttgaaattgtatatatttgttttatttatttgcttaagcagaatctgtaatttattagggtctgatatgatcagcccctagaaaacaaattcattctaaacatactctaggccgggtgcggtggctcacagggtaatcccagcattttgggaggccagggcaggcagatcacctcaggtcaggagttcgagaccagcctggccaacatggtgaaaccctatctcttctaaaaatacaaaaattagccagatgtggtgccacgtgcctgtaatctgagctacgcaggagactgagacaagaagatcacctgaacccaggaagttgcagtgagctgagattgcatcactgcactccagcctgggtgacagaacaagactccatctcaaaaaataaaaataataaataaacatatgctcaagcttgataaatattttaagcccaaatgctaatttattactctaacgttacaggaatcctgctagcagataatggttgacttgaaaacaaaaaatctccttggaatgaaaaataggaaactaaattttggtcagtagtgccaattaattaagttattccccaatgctttccatatagtgtggcctcattaattatttgtcaaatttctgctagaattatagaagaaatgagaaaattattcttttgttcttgtgtctgcattcaatttattgtgatatgttgtattagttgaggtatgtgaagaaaatacagccttaacacacatatgaaattagaaaagggaggaacatttcaatatactttttcagataattgtgaacataccttttgatagtacaccaaaactaaagaagtggtagtttctaaattaattttgatactcatctattcttaaagattggttgcaatgaagaaactgaaattacatctaaactttattttgttaatttgtgacattaaaatctcttgatctatcttgtacttttaaaattacataacaattgtacatatttatgaggcacagtgtaatattttgatatatgtaaacaatatgtaatgatcacatcaggataattaagataaccatcacctcaaacagttactgtttctctgtgttgggaacattcaaaatcctctcctatagctatttgaaaatatacggtaaattgttgttaactatagtcaccctactgtgctgtagaacactagaacttatagaacttattcctcctatgtagctttaatcttgtatttgttaactaacctctccctatgctgcccttccccctagtcttcctattctcacctttttttagcttttacatatgagtgagaacatgcagtatttacttactgtgcctggtttatttcacttaacataatgtcctccagcctcattcatcttgttgcaaacgacaggatttcattttttatggctcaatagtattccactgtgtatataggccacattttctttattcattcatctgtttatggacacttaggttgattccatattctggctattgtgaatagtgctgcaataagaatgggagtgctagtatctcttctccatactgacttattttcttttggatatatataaattactacaatcgtagatcatatggtagttctatttttagttttttgaaaaccctctgtattatttcccataatgactgtagtaatttccatcccactaacagtgtgtaagaattcacttttctctgtatccttactaacacttgttattttttgtcttttttataatagctattttaacttgggtgagacaatatctcattgtggttttgatttccatttccctgatgattagtgatgttgagcatttttctttatacttgttggccatttatatgtcttcttttgaaaagtgcctattgggatcatttgttcattttaaaaatggattattggatttttgctatcgagttgttagtttttttatattcttaatattaatcccttgtgtaatgaatagtttgcaaatgatttctcctattctgtagtttatctcttcactccgctgattgtttcctttgctatgcagaaactttttagtttgatataattccctttgtctattttgtttcctgtgctcttaaggtcctatgcctaaaattgttgcgcagaccaatgttctgaagcatttcctcaatgttttcttctagcagtttcatagtttcggatattacatttaagtctatcttaattgagttgatttttgtatgtttgtatatttttgtatattgtgacagtggtctagtttctcaaactaaaagtagaactatcatatgatccacaattatactgcttgatatatatccaaaaaagtggtctacttgtctaatttttgtatatggtgagagatagtggtttagtttcattcttctgcatataaatatccagtttacccagcagtatttattaaatacactgtcttttcccctatgtatgttctttgtggaaaatgagattgctgtaaatgtatggatttatttcttggttctctattctgttacattgatctgtttgtttttatgcaactgtcatgctgttttaatcaagtcaggtattgtgatgcttccagctgtattcttcttgctcaggattgtattgcttttcagggtcttttgtagttcaatataaattttaggaggtgtttaggagtgaagccatctggtcttgggattttctttgttgggagactttttattactgagtcagtttcattcctcattttcaatttgttcaggtttgctgtctctttcacattcaatcttgctaggtttaatgtgttcagtaatgtatctatttcctctaggtcttctatttttcttggtgtatagttattcatgtagtctctactgattttgtatttccgtggtatcagttgtaatgtctccttttccatttctgatattacttatttagatgttctctattttttcttagtctagctaatagtttatagattttgtttatcttttcataaccctaaaatttactcttttacctaagagttttttggtggagtccttaggtttttctgaatatgagagcacgttgtctacaaacagggacaatttgacttccttctttccaattttgctgtcctttatttatttctcttgcctaattgctctggctagaacttccagtactgtgtggaataaaagtggtgaaagtgagcatctttgtcctgcccgttccagttcttagaggaaaaagctttcaatgtttccctattcagtacaatgttagctgtgagtaagtcatatatggcctttgctatgttgaagtacattccttttttacctcatttttgagagtttttatcatgaagagatattgaattttattaagtatgaattctacatctgttgagatgatcatatgggttttgtccttcattctgttgatgtgctgcattgcatttatcagtttacttatgttgagtcattcttgcatccctgggataaattccacttgatcatagtgttcagtctttttggtgtgctgtttgattcggtctgctagcatttttttgagaatcgttgtatctatatttatcaagggtattggtctgtggttttcttttttgttgttgttgtgtccttgtcttgttttgatatcagggtaatgttggcctgtaaaatgagattgaaagaattcctttacctttaaatttttgaaatattttgaaaataataggtggtagttattctttaaacatttggtagaaatcagcagtgaaaacttgactagtcttgggcttttctttgttgggagactttttattgctgtcagtttcattcctcattttctgtttgttcaagttttctgtttctttcacattcaatcttgctaggttgaatgtgttcaggaatgtatcgatttcctctaggtcttctgtttttcttgatgtatagttattcatagtagtgtctactgattttatatttctgtggtatcagttgtaatgtctcctttttcatttctgatattacttatttagatgtcctctattttttcttagtctagctagtagtttgtagattttatcttttcataacacccccttttcattttgttgatcttttggtttttttagtctcaattttgtttattttagctctgatttctattacttatttcttctactaatttcgagtttgatttttttcttgctttcatagtatcttgatgtaaatcattgggttaattatttgaaatctttctatttcttcttgatgtaggtatttattgctctaaacattccaattaagactgcttttattgtacatcataggttttgctatgctgtgcttctgttttcatttgtttcaatatatttttaatttccttcataatttcttcattgaccttttggtcattcaggtcatttggcatattgtttaatttacatgtatttgtacagtttctgcaattatttcattaaataggttttctatctctttactcaactcttttccttttagaattttcatagtgctaatatttatttgcttaaaggtgccccatagttcctgtaggctttcttcattcattcatgttttttttttcttttctttttttttttttttttttttggtctgactgggttatttcaaaagacttgacttgcctttaaattcagagagtcttctgctgggtctagactgttgttgaggctctctattgtatttttggatttcattcgttaaatcctttagctccaagatttcaatttggttcctttttatatctatctctttgttgaatttctcactcagatcatgcatcacttttctaattttgtcaaattgtatatttataatctcttgtaactcactgagtttccttaagatcataattttgaaattttttaggcatttcatagattttgtttcctttaagctccgctactagagaattattgtgttcctttggggatatcatgcttcttgcttggtcacgtttcttgtgtctctttgttgatatcagtgcatctggtggagtggttgcctctttcaattttatggagtagatattattaaaaaaatgagttttctttctatagatgtgccctatagtttcagtgcagggtactttgactttggttctgggtgggtgcaatagcgtagttttcctgtgatttctttggctgtaatcagcatcagcagtgtcagaaagtgcctcagtggcctagattgtgggtgtttgtggaggcagtggtgtagctttgctaaggaccagggtcactacataggctgattgtcaggctctgtggggatatacacaaggcacagttgctccgttggtcagtcggcaaaggttgtcagtggtattgggtgccagtcaagacagtcctcaggttccaagatgcatgtgtggggtgtggcagctcaacttaccttgcgttttggaaagatcttatacttccgtatgattttgcaatcccacgtattggtcattgaaaaatatcaatttactgagtgatacagatatttttaatgttgacacatttcattatacagagttctgtgtctttcagcacactttgtttaaactctcagtttcacttttgtcatttgaatatggaggctgaggaatccaaagatctactgttgacaagctgaagacccaggagaactgataatatacttccagtctaagtttgagtccaaagacaggatgaaataagaaaataatacataaataataaataaaatgtaataaaataaaatataataaaaaataataaataaataaataaataataaaatcagcttagaagctgattgctgccatgaagtttcctgaaatatgtaaccttgactttgtggccaggtagcagacagttacaaaactattccagacatctgtgtacttattattatttcacagatgccacactattcaaagaatttccgttttgattatgccttaatttccagagagttattgctattaaaagtgatatattatttttaattacattttctaatcagttattggggatataaagagatatcattatttttctttttttaacttttactttaagttcaggggtgcaggtgcaggtttgttacataggtaaatttctgtcgggggggttgttgtacagatgattttatcacccaagtattaagcatagtacccattagttgtttttcttgatcctctccctcctcccattctccatcctccgaaaggccccagtgtgtgttgttcccctatgtgtaaatgcattctcatcatttagctaccacttgtaagtaagaacatacaagagctaccattattttcatccacaaatgtagtatatcgattttatcattttgtataatttgctgattatcttttttaatgtaaatgtttccatcattacaagtaataattgatttatcctttcacttctaattcttctaggtcatttaatttcctggccagttctgttaaatagtagaagtgataatgcacatcgtaatttgtttcttaccttaaaataaatgtatataacattgaacacagatggatataaacatgggaccagtagatactctggaccactagaagtaggggagagaggtagtggggaggggggtgaaaagctacctattgggtgctatgctccctacctgggtgcaatacacccatgtaacaaacctgcacatgtacccccataatcaaaaataaaagctgaaattttaaaaaaagaaatgaaactataaaaacaatcgatattattaaattatatttaaatttagaaatgtaaattaaatacattcttcaccatgaaaaaacaaaaataaatgtatttgtaaatttctggtaaagcttttgtcagcacaagaacatttttatgtattcttagttttctgatttttaaattattttattagccttgttttactcaataaacagtaccaaagtataattacaattaatgccattaataacagaaacgagactaatatgaatgcgataagagctgagtgagtgaaggtcaggaagagtggcagttgaggggtcaaggcaagactcactgatgatttcaatctgaaccactaaacaagtgactctcccaagtttgccaggaaactgctgcaactctccgatttctgggaaaggccaaggtgttggtcttgatctgcagcagccaagtaggaatttgtgcagaaatctatgaaaccatggtatctggctctcacaacctccgtggaataaaaacctctcctatagttcactttccaaatatcgtgcaaggtcctttcattggcaggctctagcctgaaagtatatagggaagaaaattctgtaaaataaattttctggcatctgcaatgcagagtagaccacagaagagggtgggtggagtaaagcaaagttgacagctgatcctgcagcccaatgcagttttttttttcctgtacatattgagatgactgtgtagattttcttttttttgactcaatatagtgaatcacactagtatatctttctgatgtggaacactttggattcctagaataaactctgttttgtcttgatgtcctatctaaaaaaacactttaggattcaaaatcttaaatatactattatctgtgtttcccacagatagatactcattgtaaggaatctaagaggatgtactccactaaaggaaaatgaatttagaagaaacttctgtgatatggaaagtaataacaaataaaatacttagtaataattatactgtcaatatttgcagtgactaaagtatttgccatgtaaatttgcttttaaaattccattttccacttaataaacattaatatttatttatataataaaatactacttttatagtatttattatttataaaagatactagctgattagatactagttgatattaatcatctggtatctgataaatataattcatttaattcttatgacaaatactaattcatttaattattatgacaatattttgaggaaggtaatactaatatccccattttacaaattaaaaaactgagacatgaagaatagttgactttgctcaaggtcacagattgatcaactgtgtagctgggatttatacccaggcagttagttccatgtactgctattacctactatgttaagctacctcgatgccaacatttggtaaagagagaatggagataatccagaagaagataaagacatgacaaaattcttatattattcatgaggaaaatatagaacatgagacattgttcttttgctttttaaatcaaatacttgtattcacgacatgattgaatatgaccacattacagctgttaaatttacaaatcatatttctatccacccacatacactaattttttgtcattgtattccacatttggagttcatacaaattggtgggcccaccatgggctgtatgattattcctggtctagagaactatggtgagagagtggcatgaatataaacatgtttgatggtgatcaatccttactgttaaataatttttcaggggaagtgagggaaatagaagaacaccactcccagaaaagaagcattgtgttgtgtaagtgaagtatgttccttagtgtaaaaatgaaacttaatttaagaaagttttatctttctagaactggtgtaattgggcctctactcctgtggtgtattttttgtggaaaggtatgtgccagtacaccttaagagtgctctttataatttcctctgagacaattttaaataatatatgttttactaacaatgtttttcttatttttagtcagacctctcttaactgacacctgtcattctgtaaaactcatatgccagagacagcaaatttattaaggcatgaagggataaatacatatagttatctcttttttccctaggaaaacattgacctcagctatttcctggtcattttgtttcagttttctgaaaatatggcttaacatagcatcatcccataacatttactctatggagcagtccatcagcagtaagagaacaacaaagtgatggcaagcacgtaatcaccatcacatacccacagaatgttttaattaagaaaacctaccagaaagacaaagatatggcaatatcctgtgattggaagaaaacatgggagaatatttcaaaaaagttgaatatatacaagctaataaattcctattgtaattgtgtaattcccacaatggtagttgtagaaatagaactatccacctgcttaccctgtcttcctcattctatccctcctagacttgagaatttgcttctgcctctagaaatccatctaatgttatcatgttgacacatttgtcttataaataaatgacttgaaagcaaactataggcttttagagggggtcaggattatagtggggcaatgtaacaggagggcagcataagtggggagcattggaggcattttggggtgctgccagggaagatggttcaaaggatctatatctgagattcattgataacattactacttaataaagacaataaatgtgaagaaaataacatcttagaatcataatcaagccaaaagctgatgttgtgctcagtttttccacatagctttatgacatagaaatacggagtcacaagaaggctgaacaatgtggaaaatgattctaaatactcctaagagaaaaaaaatgttgttttggtgccacagttctgaaagagatttagggaaaagaaaaatgagcagatccttaactcttgctactatggggtttctagtaaattgattctgtcctttaggatctgctatactcctgctttcgagctctgaattgcttaggaataggttcagcagcatataaaaatgcttaatgtggctgaacaaaatagggagattttttccctcatgcaactaggagtttgaaagttggtaattcagggctaatacattagaatcacagtctcatcagtgtctcaggcttactctggtccccaaggttgcaagatttctcttccccaattccccagcatcacgaattttcctttccccaagagaagaaaggaaagctatgagccagctaagtctgtgactgttttgcagagcatttctcaaagttccgcataatggcctccacttatatttttagccagaactgtgtctaaagctacttctgtctacaaaggaaaatggaagatgtagttcttagttgttcccattactgtcttcagaaaaaaaaagacatttgttgagagagaataaagggaaattgaatactggatagtcaggcacagtgcactatgtggtatacacttcatacacttcactatctggcaggggctataataatatcagatattattgttacttgagcaaatatgtatgattttcctacaaggcatatttagaatagtacttccttccctcattgaaattaggtgggtccatgtttcttgtttagccaataacatcaagaaaagtgatatgtgtcttttcatggagaaaactaagagctattgtgcaattggcaactctgctacaggatttttagtgttccagatggtggtaactgcttcagcctaaagaccctgagtgattacaatgagcagggttcctctgttgataataataggcatgaaacctgaagcctgtacatggtgtcaagccacagagagtcaggggttactttttactaccatatcatctagcctaccatgatcattgcctcctggcgctagactctatagaatatctggtcatttctatttctttatcatatttttagtcatcttccccttttatgtttctgatccctttctcttccttcctttcattagccaccctcctccacccctttatctttatccaagtgagctgcacttgtgaataccacctagccttattatttgcactgaggtcaaaagagttactttctctgagctgtggaataagataccataatttacagaagctctgttttgctctacttagcacaacttaaaacagccaagtgctgttgaccagccaagtgctctgtgcagcatctgagattgtctttttctcagcattcctttcaatatttggataagattaaagactggcacaaaaagaagtcttcactaacataattatgttactggattaaacttgatgatagctgagcaagtaaataatggttttaatttaaatttttactgtaccagccaagaatgcagagaagaaataggaaactggatgtgctatcacaaaatgtaagtcctgaaatctaattgaaatgacataaaagagcatgtatctggaagcttcacacattctacttagagtaggcttaattggctatatagtgctatatttagatgtcatgattatggtatgtttttaaagcagagataaataataactttcactgctaagcaagattttatgattattatatcctacacagatgataaaaatcatctaaatatgtcttgctttagaagcaagatattgtgtagtaattagatcaggatgaccagatttttaagaagtgtattaagtgcatattaagagtagaggatatataagactcttagaacttagaactcattttggaagtttaattaagttaactcatgagtgccttggcatgaagattaggagttaaagatcctatttttaccactctcaaatggtttaggatcctatttaattagacatattcttctttttgtcctaaccacctttttactgatattcagggagttgcattcatttattcaagttaaaataacacctctaaaatctgagttaattgtctcagcaaaagtgtgcataatgtcatcagaaatatcagaaattttgccatttgtggtaggtaccagttgtttttgttgttgactatttttttccacgttcctcttcaggctgtggagttgctcctaccatacctcatgtggttctttcgtagtggtcaattcttgtgttcaagggataattcacgaattatgtatttgttggatgtgatttgctaatatttttaaagtattttttccatctatttacgtgaggcatactggtcggtaatattcttccgggttttttgttataattctttatcagattttagtattagtgttatattgacctcataaaatgagttgggcatttatttcatctcctctaaattgtctgtagaagattaattctattttgtccttgaatatttttaacgtattaataattcattaatgaaaatatctttgcctggatacttcctatcaggatttaggcaaaaacacttcatttctgtaatagacgtagagctgtttcttcccgttgatggaacaagttcaaaaatttgtccttatttcaaatttgtcaaatttgttgccataaaattgttcatagtattttcttattatccttttaatgtctttcttatagggacaccatcataaaacgtatactaaagactcactacttttaaattttttaaccttttaaatattggtaatttccagggtataatctttactccttttcttttctcactttatgagctacctgaaagaggtcttctctacttcataacatttgagagtaaggccaggcactagtataacaaacatctctcctaatggttcaaatgtgcatccataattgagaattgctgctttaaatgctcaagattctaacctctaacttctgattcttccaaattacttccaagaacctccagtaaatttgttttcagctgcatactagaatgtttgagaaatttgagttcattatcattatctctaagacttgctcttctttctctaagttttttctttataagccaactcagttaagataaatttatactaaaatgcctcatttttagtgtagagaccaaaagcttttgaaaaatgtattcacatatgtaacaaccaccctaatcaagatatgcattcctgccatcccaaaaagctcccttatgttcctttgcattcattttcccttttatgtatcatgtcaaattagtaaaaataaatgcaatgaattggaaaacaagtagagttaagattgggccttggaaaagccaaagaaatgagttagccagaaccccagcacttcttatatacttcctgctatgcctgatcttactcttattataatctactgagatatttcccaggaacagaggacattttgatctgccttgcaactgaagtctgaggccatgggggagactgttaaacaagactagagcaatagtcgtagggccaaataagtcctagactaaaggtttctctgaattcgtaccaacaaggcattagacaagctttgaaagggtataatttacttgagtaacttaactaaattaaggtaactgtgtaacagtgcaaactccatcaatagataaagtatacaaaaatctagtaccaaacagaattgaaaatagccagtattcaatttttaaaaatttactaggcatgcaagtaagttgaaaattaagacctttagttatgagaatatttaatcattaaaaagagatacagatatgggataattaacataaataagttaatacagctgttttaaatatactgtatatgtttaaaaagtagaggaatcatgattatgatgaggagagaaacataaaatttaaaaaataattcaaaacctagaaataaaaaatacagcatctgaaatggataatacaactgaaagtgatcaatagaaattagacaatgtagaagcaaaattttgaacataaatacttagctataaaaactattcccaaaataaaacaccaaaagaaaaaatatgacataaaaaattgaacagagcatcagttatgtgtgatacactatcaaatggtgcaacacacgtgtaattggagtcctaggaaaaagaaaagatgttgagggtagtggaaagaaaatatatttgatgacataaaggcaaaattttctaaatttgatgaaacatttttaaataaaataaaacacagagaaaatactaccaatgtacatcacaatagaaatgctaaaaaccagtgaagaaaaagtcacacagagccagtgaaaaaaagactctatctatctatctgtctatgcaggaacaaatttaagagttattgtagatgccttgtaatgacctaaggaagccagaaaacaatgtaatgacattttaatgtactgaaaaaaaactgtcatcctagaattctatttacagagagataagaagaaattttaaaaattaaaaaatttagagaatacattattagcagacctgcatcacatgaaacgttaagaaagttttataggcagaaaagcaatgatactagatagaaatttggatctaaagaaataaagaacactaaaatggtaatgtgtatggaaatataaaagtttgtacctcactttttagactctttaaaagataatttactatttaaacaaaaagtagtaacagtatattgaaagatttataaattatgtggaagtaagatgaatgataaaattattacaaaagataaggaaaatggaagtacattactgtgtgattcttacactgtatatggagtgatataacattatttgatagtagccacaataagttgaagatatgttatgtaaattttaaagcaatcactaaaaaagaaagaaaacagatactgctaatgggtcaaaagaagagatcaaatggagtcataaaatatactcaatcaacaagaaagcagggaaatggaacaaaaaggatataaaaaattagaaaaaaataccaagatggtagatttaaattcgacaatatcaataattgtattaaacttaaattgtctaagaaatccaagtaaaaggaacatttttctgatttccttttaattagaagaaacaattatccttttctacagggaagcctctttaaatatataaacatagataaattaaaagtaaaaggatacaaaaagacatatcatgcaagtatatattgaaagaaaactggagtagatatattaacatcagacaaagtacatttcagggcaaggagtatcaccagagataaagtggtcaattcatcaaatgaaataacatttaataacatttaataaaagagcttcagaatatatgaaaaataggtgcagttgcctgcagctgtagttctataacagctactcaggaggctgaggcaggagaatcatgttggcccaggaattcaaggttgcagtgagctgtgatcacaccactgcactccagtctggatgatctggatgatagagtaagaccctgtatatctaaaaaaattaaataaataaaagaaagaaacaaagagaaattgctactacttaatggaaaaatagaaaaatccacaatccaagtcttgcttaaattgcatactgaaaaaaaaccttggcattataagaaacatctatcttgatagtccatatcagaaagatacaactttttttctaccattgccagatcttagcctgttcatgaacttagaactctgaataaagcaaatgtctgctccctttgaaactactggcacaggtatgtgctatcaatctttcttctagcctctactaaagacttgtagtcatttactagagtggtagtgcattgggaaaaggacatattgagactttgggggggacttttgaacatttctttaaactactttaattttttgtgatccaagaaacatcactgtgatgagaatgaggggttgagaagttatggcagccagctgatatgtgaacatttggtgagaactcattttacaattgtccagtgaatctaagaacatactccgtggttatacaaatgcataattggaatagacatggaaatattgagcagatggtagaattcctagattggctctttaaaccaaggaatgagaattgttatgatagaaatcattaagtagaagcttgattttccttgtccatcaaaagagtagactgaaaagcaatagtgtattcttgaaaaataatcctagagtttattccatcatcaaagatgtatgagggatgatatcacacccctacttaactcatttattaggactatgtgagaaaagcagggaatttgaggaatgacaggggattatcataaatttaataaggtggtgattcaaagtacagttaccgttccagatgtgatttcttttttctattttttttttttaattttgagacagagtctcactctgttgcccaggctggagtgcactagcacaatctcagctcactgaaacctctgcctcctcagttcaagcaattctcatgcctcagcctcccaagtagctgggattacaggtgtgtgccaccatacccggctaattttgtatttttagtagagacagggtttctccacgttggccaggctgatcttgaactcctgacctcaagtgatctgcctgcctcagcttctcaaagggctgagattacaggcatgagccactgtgcctggcccggaagtgatttctttactggccacaactaagctttgatctggcaaaagaactttttttttgattagcaaaaacttccaaaagtagtttgtattcacgtgcaaagacagtagtatattcttttaagacctctcaaactctgtgttttaatagaggatgcaaagaccttgatatttcaccattccttgaggtatctatttttttgcttattaaattgatggcatcgtgtttatttgacctttaaataggaagtagcatacacacatagtaaaacgtgtatgtcatggggagagaagtcaaccccattacaattaggtgcttgcctctccagggaagtttctaggcatccagctatctaggacataataatttttctaacccaaagtgtaagaaaagttgctgcacattgcataacctgccactgagaaagaggaacatttgatggatctcgtagtaatttctagacaatatatgtccatttctctatgatgctttggctcatttactaagaaatttggaaggcttctttttagtagatcccagaaccagagaaagttcactagctagactcatctccaaaataattttctttcaattaggttttattacccaaaatttcaaagatgctcaaaatgtctgctgtaggtacagattacttgtggagtctctggcaaactctaatacaagaatcacagttccgtttcatagggtttggaatgaaactgtaccacgttcaaagaaaaaccttcttttttaaaaaaaactaaattaaacaaaaccatacatttcttagctcactaatggtctgtagtagagaccaaatatctgaccaagtgacaccaaatgactataaaatctcagctgcccatcatgaattagatatcagctggttcaacaaagcataaagttgaacatattagctctatggtcaagtagaagggatatatgaaagagaaagagaggtctaatagacactgaagttataggtatactttgttcacagaatggtaagatgccagtagcctctatcacttcttgcatcatcctcacctttgacctcatgatgagttttctaaaattcctattgaatacgaaaagattcacactttacttacagatcatttcacccagtatcttgttgctagactgaagtggatttctgcaacattataatttatcaggagtgaccctgaatgacagaggaaagggaagtcctacaaatgggcaaatcttcaagcagttgtccacttgcttagtaacataaatggcccaaagtataggtttatagcattactttttagaaatggctaaaggttttgtcagattctcatgaacttggaaggaatgaaatgagatggttggtaaaaaagatgtccagaaaagttgtcttaatgaatttcttggaatagtcacaaaatgtgaggatatttgcatctcagcgaaataatcattgacgtgcacccactaataaggaggttctctgtgatcaggttgacaagaagatgtgtcctgtaaatattaatcagcctctttcccttgcacagtttttacacaataggcttatgtggccatggaggcagatatgaaagttacaaatgtactcaacaaaatagactggtcctcatgaagttttatctggccgttaagtggccatctaagtgcccaaactgtcaagattagagagcactgttgagccctttccttagccccattctgcagagaaccaatcaaccataacgtggtgggttgattacatagaggcatcagtgatgatttgttctcaaatagacatgtagtctggatatggatctgtatttcctacctgcaatgcttgtataagtataacaatttgtgaagttgctgaatgccttgtttgccatttatggtatcctgccatttatggtatcttaccaaagaactcattttacagtaaaataggtaagaaaaaggccaacactcataagattcatgggtatgatcatgtactccattagctgacttgatgaaatggtacaatagcctaatgttgactgattcatgttccttactggttgacaaatcctgcaggaatactgagctcccctatcaggttgcgatatatgcttgcagataacggcagcatacgtaagttcaaaaaccaaggtgtggaaagggaattgcttctatttttttacatagtgttctcatttgggcttaattttgcactcctactcccaccagacatctggcaatgtctggatacattttttattttcatgactgtgggagaggtagagggcaaagatgctgctaaacatcttgcaataaataggaaaactccctacaatgagaataatccagtctgaaatttcagttacggtaagtctgataaactttgatctatacctaatgacacacttaaaaaatacatgattcccattagcacaaccttgggttctgctgattaagaatccttcttagttctcaggagtggaactaatatgatttatggcctcatgaccaattatagaaatgaaaacagtagtagctatgcatgtttttctgtttctttgtcaggtatgtatgtattatgtatgaaatttccttcttcatttagctgaatatcttacataaagtgcattgaggggagttatcttaataatttagtctctaggttataaaatgcccagaagggctgtgactaactggaaaaaggaattacatgatccagatatgaatatggtgttttctgaaatgtgttttcattttggggggataagttaagctcatcttggtttgtacaaggagaatttcatcattttagatggaaacatgatgttattctttttgttgtttggaagcttaatggaaacatgatgttattctttttgttgtttggaagcttaatactggcataatgatggaaatggatgctgactggaagccaattggggctttgaaactttcctgttagcaacttagtacaatttccacttccttctatgctctcctgttgcacaaccaaattcacaccttatctttgcagaattctgttggttaactttcccacatccacttcattcactctaaactccattcccgtgaatgccttctgctgctgacatgtctttatatgtttgcacatgacatagtctatctaccaacctccttccctttttcaaatttaagactcaccctgaatgccactacagaggtgaatattccctgaaatctctaaacatgatgaatcacatatttctctatgttcccatgtattctatacgtatctttaggatggcactagatatattgtggggggttagctaatatttctttacatttacttttagatcattccaagtgtttaagcagtgtgctatgcatggtaggtgtccaatacatgcattgtttaagtatcatagaggttcaataaatgttcgataaagtgtatttattgaagcacctctatatttttcttagttttctcaattagaaaaaataacacagttggctacataaaaacacatgtattaatttaattataaaaatgaaaaattatcaaaaacctaccttgagatatgcataaaataaagtattaatttaataaacaattatggaatttttttcaccatgaagcagacgtcatggaacatgcttagaataaaagaaatataagataaagtctctgaggatttcacagtcagtgtagagaactaacaaataattacactatagttcaattatacatctatgtttaaaatatgatcagaatatagacactttttaatccctgggagaagtggggaggccttcacaaggcaggtgacaatttagttgggtcttgatcgatacattgaagatcaacatgaaaagaatgagaataaaattggtttcatgaacaacttccacatatgctatttatataaacaaaaataattacgtaaatataacacatgtatttagagatggatgagcatttgttctatgcagttagacaagagcaacaaagattaatattgcaaaggcaggttgaggccagataatgaaagagttttatgccatgctaagtaatttgggcattcccctgcaggtaacattgagccactgaaaatttttaattagaaaaatcacatttgaacttgtgcaaagaataaactacgctgtagagaaactggataaaggtaggcagatcattacaatagtccaggtgagatcgctaagatgaggaggaggagagaaatcaaaacagcatttaagtaatataattgcacatctccttccaaaaatatgtaaagaatagctaatgcaaaagaaaccatgacaatcttgattaaattctagcatcatgttttaaattaaggcattattttctgaagctactgatctgggatttgagcaatgcaggggacatgttatcactctgttttagtgtttatcatataccagctagtaattttcaaatacattatacatgatctttgaaagcactgtatctattaattcttttgtgaaagtagagatacttataggaaagaaaaaagtttaaaatctaatacttttaggtaagaacgatatatgcttcagtggagaaaatacattatttttttgaagttcaggatatgttttgtttgactttaccaactctgataattctattatgaaaaatgagtaaaattatgagcatagcttgtaaaaatcctcttggaatccttctggggttcaaatttgaagtcatcacgatatgctttttcttgtagccaaagtatttagttgaatgctttgcagtgttagttaaatactaagaacttcatatgctagtctccagactcaagcaggtttggtggggaggtattgtagatgaaacactaatgtagagtgtttctgtgcataaatgcacaaatgggcagtgtgtaagtatatcaaggaacccactgtagactcctatgtgtgcctccttagaaggaatcataatttgcaataaatggtcagtcttgagtacattggttatatgtataagacatggaatgtatcaacatgctacgttatatttaagcttagtgtcagcctatagccattcccagagattgatctcaaagaatgcaagatggaaggctgtaaatatatatatacatatatatatgtatatatatataatattcacaggagagactgggtaagaacactgcaaatatatatataaaaaaatatatatatacatatacatatatatgactcatgctagagatacttcttgctggcttcagtaagtggccatgttgggaagaccatatagcaaggaacccaaggcagcctctaaaactgtgtgtgtcctctggagctgagggcagcctcattatatgtcattaccatcaatacctagcaagcacctaggcctcttaatcctaccagataaagggagtaaattctgccaacaacctgagtgagcttggaagtagactcttgtccagtagagcctccagatgagaatacatcctcaccaacaccttgattgtgaaaccctaagtagagaacctaattaaactcttcccaggttcttggtacacagaagctatgaaataacaagcgtgcattgctttaagacactaaattcatggtaaatttgttttgcagcaatagaaaaccgatacatcctctaaactcagtaactcaaatttccttgcagacaaatgaagtctgaggtgcttctctcttcatttggcctagttgacttgaacagacacacaaaataatgatctgggtggagaaaaaatgagagaggagaaggaggaaaaagggagtgtatagcagagaaagggtaggaaggcagaggcatggggtaaaaaaatcagaaagatgcttaagtacataatatttgggcaacgattcacatttcaaaattatagtctaattaacctagaacgttttttcacttttttgaatccctttttctcctgtgctgagctctaaagctgtacataccaaatacgatcctgactagtttgggggcttcctcatcctcctagatgatttatcagatctagcttggtcccgggggacacatggacaaaaacctcctgcccattcagaaatcttggaagggcaaaggagaacagggatgagtgtggttgaagaaggagggtctctctgtgctgacagctgcatacttagagctttttcacttgctgtcaaacacttgtgacaattgaaatattcacacatatccaatttctttcctactatttttcttttttaaatttaccttttatttattgactgatacataatgttttatggatttatgaggtacatgtgatattttgttacatgcttagaatgtgtaatggtcaagtcagggtatttgagttatccaccactttgagtatttttcatttgtatgtgttggcaataattgaagccttctcttctaagtacgttgaaatatacaatacattgttgttaactatagtcactctattgtcgaacaatagaacttacgtcctttgtctaactttatggttatacccactaacctatctgtcttcatttccctacccccacccatcctttctagcctctagtatctatcattctactcttagttttatgaaatcaacttttttagatcccgcatatgagtgagaacatgtgatatttgtctttctgtgcctggtttatttcacttaacacagtgacctccagttccatccatattgctgctaataaaatgatttcattcttttttataactaaatagtattccatgcatatatatgccatattttctttattcattcatccattgatggacacttgggttgattctatatctttgctattgtaaatagtgctgtaataaacatgtgagtgcaggtatccccttgatgtactgatttcttttcctttggatagatacccagtagtgggattggtgaatcaatatagcagttctatttttagtttttggagaaatctccatattgtttttcatagtagctgtactaattaacatttccaccaacagtgtataagagttcccctttctctacacccttgccagcatcttttgtttttttttttttttttgtatttttaacaatagccactgtaattggtataaggtgatatctcattgtgttttttcttggcatttctctgatgattttgagcattttttcatatatctgtgggctatttgtatgtatttttctgagaattgtttattcatatgctttgcccattttgaataaaattattgattttttattgttgagttttttgtatgttctggacattagttccttgtcagatgaatagttcgcaaattttttctcccattcaacaggctgtctcttgactctattgattgtttccttttctgtgaagaagtttatagtttaatatagtcccatatatctattttttgttttagttgtcagtgcttttgaggtcttagccataaaatcttcacataagtcattgtcctgtagtgtttttcctatgctttcttctagtagttttttttttttttatactttaagttttagggtacatgtgcacattgtgcaggttagttagatatgtatacatgtgccatgctggtgcgctgcacccactaactcgtcatctagcattaggtatatctcccagtgctatccctcccccctccccccaccccaccaaagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcagtaaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaagagtgctcctatttctccacatcctctccagcacctgttgtttcctgactttttaatgattgccattctaactggtgtgagatgatatctcatagtggttttgatttgcatttctctgatggccagtgatgttgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgtctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgtggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcttcttttatttcgttgagcagtggtttgtagttctccttgaagaggtccttcacatcccttctaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacataatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggataaagcccacttgatcatggtggataagctttttgatgtgctgctggattcggtttgccagtattttattgaggatttttgcatcaatgttcatcaaggatattggtctaaaattctgttttttggttgtgtctctgcccggctttggtatcagaatgatgctggcctcataaaatgaattagggaggattccctctttttctattgattggaatagtttcagaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctggttgatttgcgtagaggtgtttgtagtattctctgatggtagtttgtatttctgtgggatcggtggtgatatcccctttatcattttttgttgtgtctatttgattcttctctctttttttctttattagtcttgctagcggtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtctaaagtctgttttatcagagactaggattgcaacccctgcctttttttgttttccatttgcttggtatagtttcaggtcttacatgtaaatctttaatcattttgagttgatttttgtatatcatgagagataggagtccaatttcattcctctgtatatggacatccaattttcccagcaccatttatcaaagagagtgttctttccccagtgtatgttcctaatgtctttgtcaaaaatcaattggctgtaaatatgtggatttgtttctagtttctctattctgttccatttgtctgtgtctatttttatatcaatatcatactgttttgtttattatagtcttacaatgaaaatgtattttgcattcagttagtgtaatacctccagcattgccctgtttgctcagaatttgactattcaggatcttttttggttccatacaaattttaggattttttttctatttctgtgaaaaatgacatttgttattttggtatagactgaattgaatatgtagattgctttgggaagtatgtttattttaatcatattaattcttccacttcatgagcatgggatgacattccatttgtgtccttttcaacttctttcatcagtgttttatggtttttaccttatagagattttttatctccttggtgaaattgatcccttttttttgtagctattgtaaatgggattgctctcttgtttcagctgtttcatttctatgatatagaaatgctattcatttttgtaggttgatttggtatcttgcaactttactgaagcaattcctggtcctaaggacaagaaatttttgttgttggacaaggaagaggaaaaacaagagaaacaaattgaacacaaactttttttctacctgttggcagcatttataacacaaatactccgtaattaaaataattttatttttactataaaaaatattaataatcttttctgagccatattcttagagaataaaggtaacattggggagtgttgaatataatgtttagttatgagcaaatattcattatttttctcaatactgatattgctatactttggcagagggggaaaatatgagtgaaactctggagtacagagacttaggcatgaatgctaattttagacattttcccaacttctgaggtaccttttgtgaatttaaagagccagagagtatagaggtaaacagaataggtatgcactgaaatttcaactgaatacttaggtttccatttggctttagaaataaagtatatactttggtggccgataggtatatacaaatgatccagtttatggaccaccatgtatgaacagtttgaaataataggcaaatttttactttgtttgttttctttaaaggcctaagcttccaaagtaaacattttcctaccttgactctgcttcttttctgccaaactttaaagtcactcctcaaaatcaaaggttaattctggataacagcagcaaaacattgtctatacaaaaaacgaagagaaatgaaaattttaatggaaaagactatcataatataaaatatcctattttagaatacaattagcaaaatatacatattaatagtacacaccttgggattggtgctttgcctattaaaaaatggcaaactcctctaattctactgctagtagactattcttcccatctgtgaataatggtattttccaaatgtcagtataaggaaacttacacagaaaaaactccgtattgtagatagcagttttccactagatgaaaaatatctattttcctgtctcttagaatacaccatctgtatttgtcaaactttctgaacattgcaggaatctgggctgtgtacctgttcagctttctcctagtgactgacaatcagtgacatgtggagagggaaggagctttctaacttctgtgagattgtgagttttccaagtggggcataggacacaactcagtagagttaaagtatcagtttttcaacacaaatgatccaatttatggactgtccacacctctttcttttcatttgcattgaccttctgcctttgtagtgctttttcaaaactatatcagatggtgagagaatcaataaaaataaataaataaaataagaaaaatgaatgcttaaggtttttacctatggtgcttctaagcaaatataattttaatttctgtgtacaaatggaaacagatatatagctctacgtatgattcaattaggtataataatttaaatttattgaacttgcaataacaaaagtgtagctttaattctgaaatggatgtgagggggaaacgaaagggatggcaaagctgaggaggtatggagggataatgtatttcattttttgagcaaaatttctgatggagtgttgctaaaattctccactaggcaaaaagcaggtgctgtgcactgtatcacagtggccccttgacttaagatgcaggcctacaggccaatcttatcagcattaggtatatcacagaagtatctgttcaaaggaaatggcccatattccaaggaatttatgagccctaatgtcacagaacaggcccagtgcccttggctaatatgagtaacagaacttttggaatggaagaaaattccattttccagtgagcgaacagaaacctagaaaaggcaaatttatggttcacagctctctaactgcttctgttagaactgagacctggttgcctctccagagctgtttgtggatgctctcacagcaaaattctagatgtcaaaatcatatttaataaccatgatatgatatttaaaatcaattaataatataaatattatatatttaatatacatatgatgatatgcatattttacctctggtctttctcttccaaacccataactccattctaatagtgagaaatatatcaaacaatatcagttaagggacattctaaaaaatacctgaccagtaatcttcaaaactgtcaaggtcaccaaaccaatcaaagtctgaaaaactgctatagccaagatgagtgtaagaagtcatgataactaaaagcattatggtatcctagatgggattctgaggcagacgtgggacattggataaacactaaataaatctgaataaagtatggatttcagttaagaataatatgtcaatattagttcattaattgagacaaatgcattataattatgtaatgtgctaataataagagaagctgagtatggggtatatgagagttctctatcaaacaccaaaagctggtgaggatatagagcaacaagaacttgcattcattgctagtggaaatgagaaaaagctcagccactttgtaagagagtttcatagtttcttacaaaattaaacatactctcacctcacaatccagcaattgtgctgcttagtatctacttaaaggagatactaagtagtatccacacaaaaccctgcacataaaacttacatccacacaaaaccctgcacacagatggttattattatgagtaatgagtagcttcatttgtaattgccagaacttagaagcaaacaagatattgcttagtaggcaaattgacaaataaactttggtacatccaaacaatggaatattattcagcactaaaaagaaattagctatcaagttatgaaaatgcaagaaggaaacttaagtacatattattaagtgaaacaagacaatctaaattggctatgtactgtatgattccaactatataacattcttgaaaagtcaaaactataaagattttaaaaatcaggggtttctaggagttaggggacagggagagatgaataggtgaaatggagaagaattttagggatctaaatatactctatattatattataatggtagataaattttattatgcaattgtctgagcccatagaatatacaacatcaaaagtaaaccccagtgtaaactacagactctgaataataattatatgtcaatgtaggtttatatattgtaacaaatgtactaatatggtgagggatttcaatagggtggaggctgtacatgtgtgggggcaggtggtgtatgaaatatctctataccttcctttcagttttgctgtaaacccaaaactgctctaaaaaatacattcttttttcttcaaatcactattaaaatcatcttcatttatgacaagtatgtacgacttagttaagcaggaatttgaatcattgcttatgagtacagttatgattgcctattggctttataggaaaattataaccaaagctaattttccatttctgaggttactacaatccaatgtttatgtgaaataatgatctattggaccaagattctggaaatttttacttttacctggttataaactcatgtattttagagacaattgcaatgtgaaatagcaagataaattttccagaaaagaaatatttccattttgagctgattcatcttcataattttgactttctaattaatgtattccaattacttgctaactcttttatatgaatcatttattgtctagttatggaaagattgcagattattgaaaggacaaaaaattataaaattatattgaatcacagaaaatatatcctacttactggtttatcctgaccaaaaaaaaaagttcatgattacacgttgctttaattgcacatttttaaattctaaattcacatgcagttgttaaaaaaaaaaaatacagagaaatttgtatacccttcagtttctcccaagggtagcatcttgcataactatagtacagaattacgaccaggaaaatgacaatgccatccattaaccttatttgatttcactagttctacatgcactaatttgcatgtgtttgtgtgcttcattccattttatttttgtcacaggtatagatttatttaacaaccatcaccgtcaagacacataacagttccatcagcacaagaatcctatgacagttacacactcttctatctgttcctttctccctttctcagtccctagcagtaataatatattttctatctctataattttatcatttcaagaatgttccacaaatgaaacctcatagtatgcataagcttttgagagtacctattttcagatagcataatccccttgagatccattcaagtggttgtatgtgccacttgtttgttcttttttgttgctgagtagtaatccataatgtgaatgtttttcaataattcacccactgaagtctatctacattgtttccagttgggggctactatgaataaagtttctacaaatgcgtgtacctgtttttgtgtgaacataaattttcatttatttgggataaatgtacagggtcaaattgctgggtcatgtgtaagtgcagatttaattttctaagaaattataaaactattttctagagtgtttacattactttacattctcatcagcaataaatgagtggtctagtttctttgcattctaaccagcatttgacattatcactattttttgaaccattttaataagtgtgtagggatgtctactaagtgtggttttaaacgttaatttccctcatggctaatcatcttttcatgtgcttgtttaccatttgtatttttttttcagagaaatacctatttatgtcttttgcctactttcaaactggagtacttggtggtggtggtgttgtttcatgttggattttgagagtttttatatattttagatacaaggcttttgtcgggtatgtgattttcaaatattttgaccccatatgtagcttgtgttttcatcctcctgacatgatctttcacagaggataagttgtttatttttatttctattttgaagaggtctattttgtctttatttccttttatgaatcttttttttcttgggtgtcaaaactgataccttttctcctagtcctaagtctcaaatattttcactcatttttttttctaaaagtttgaatttgaagttcatcttctatctttaaagggtgtacagtttggttgaggttcatatttttgcccatggatgtccaatttctccagcaatggatattgaaaagactacattttcttcactgaattgttttgtacctttgtcaaaattagttgagaatatttgtgtgggtctatatgttccattgatctatgtgtctgtccctctgtccctctgctaacaccatactgtcttgattcttggcatacatggcttttttttttttttttcaaatagtttttacctttaaaacaaagagaacaattcacgacaccctcttatctatctatgttggttggttagggacaaaaaggaagaaatgaatcatttaaaatgtagagggtatttagcagattttgtttccaattagaaacggattgagattcatggctttgggaatgatttctctattgctttctctctctttggtgttcttgtttatccacaatgtgttatattctccattttatagatgagaaaattaaagttctttgaggttcccacagaatatggtaggaccaacatcatgcttggaagccaattcagcttgtttccagagtttgaaattttatccactatgttatactgctcatgacatctcagagtccagtgcccctcagaccaacatctcttacatatatatgggagatttttgaaagtctacatcagtgtctactggtaatggtacaaaaggatcatcaggtggaaaatagtcttatttaattacaaaatactcattgagtacctatagaccatgcccttgacctaatggagcttacattttatgggaaaagcaaacaaacacacaagcaagcaagtctctctatatatttacatttatatttttatatgtattccccaaatctcctacccacagttctacaattcaagaagttctgaaaaccaaagattcttttataacttatttgttggcaaaaacttgtcttgaactgacataaagctatctatagtctttatttatcccacttaaaattaattactagtaatgaattttattgtaaatcagtggctgaggccaagtgtgttgggggaaggggttacataatatacagtaaatgtcctatattatctttctaaaatttgggaggaaaatgtcttattctggaagcacatttattctcaaagggttgggataaaggaatgtaaatttatattactaaatgcaggaagaataggtgctacattgaaaaatagagtaatgaaggagaatactgtttgagatagggcaacagagaaggcctgtctgaggatgtgtcaccttagagacatgcagaggagagctatggagaaggagcatcccaggtaaagaaaaaaaaataaaacagatgtaaagacacctagacaagaatatcatgctcggggagttagaaacagcaagaacactgagcctggagtggagtgaacatggtagagggcagtaggaggtagatttggactttcagtcagaccatatcaccttagtcaaagagcaaaattatccaggtgttttcccttttgttcactgtaaacaaaaaatatctgagacaagtctcaatcagtttagaagtttattttgccaaagttaaggacatccttctgacacatcctcaggaggtcctgagaccatgtgcccagggtgctggttttatatgttttagggagacataagacattcatcaatgcatataagatgtacattggttttgtccagaaaggtgggacaactcaaagcaaaggggatcggagttccaggtcataggtggattcaaagattttctcatttgcaattggtttaaagagtttatttaaagacttagaatcaatagaagggactgtctgggttaagataagggatggtagagaccaaggttcttattaggcagatgaagcctccaagtagcaggcttcagagagaatagattgtaaaactttattatcagacttatcaagtgccagactcttagttaattctctcctgaatcaggaaaaagacctggaaaggaaaaggaattctctacagattgtagattttcccctgtaagagacagctttgcagggccattttcaaaatatgttgaaaaaatatatatactttggggtaaaatgcttttctttccttcagggcctgctgtttgtcatgttggtatcatattgctacaaacagtctgctttgtcagtcataaggtctctgttttaatgttaaggctggtcaattgtgactaaattccaaagggaggagggtataatgaggcgtgtatgactcccccgtcccattatggcctggactagtgtttcaggttaaatttgtaatgcacttggccaagaggagggcaccatttaattggttggggagcttaggattttatgtttggtttacatcataattgcttttattctctttaagtcatttctctgtgtctcagttataatctctaatatggtttgaggcttgcaaacaccttgctattattttttagttatctggcactgactcagcttgtaaaacatcaagaagattctaaatcttccataaacaaggcagtgataatacttacatattggtacatgagctagaatatatgtaataacaccttaatacattatttgaaggccttaggaaaagaaggattatattcaaatgcaatattataatatttctaatttaagaaacattcttaagataaaatcaaagttattattcaaaattattgaattggccttttttcttttctctttattaaatcattttggaggctgccatcttaagaaagacagacttttgccagttcaattacacttgctgtgtactgttctgtatcagttaaccagctgcttttcatgggatgcccaagtccttactaaagatgaagatctatagtcacttattaagtgaattcacatctgagaaggataaaatgttatttaaaacaaaatacaggtagatttaatgtagaaggatcaaattcaattctggagacagaataatctgttgaccacaaagtctgatcctctctgatatgtctatagtttctttattctaatgccaatgtgaggattgtcttctgtcccaatgtcatgtgtatttgccccagcctagaggtaataatattgctttaatgtgaaaataaataaataaataaataagtaattacttctctggtgctgacaccatctaactatagtaaattataaatccacatccttctgtgaccatcctgcacccccagtgtttcctcaaattacttccagaacttttcagagaagcctcacatatggtcacaggcaagtcctttcagcctccactgtctactgagttctatagtgcctgcaaagctgggctttgttgcagttttatcctctgagtgctctaagttctgttcaaaggaatggcctcggtaagctatagctgaatccactgctggaggtggtgtctcctgctatgaataaccccagtgctgacactcctgtgctatggtgggcccattccttcttgctatatttacacatgacctgtgaaaatgcctctttgaacatccaacatctcacagagactttatgagttaacattttttaagtttaactttgtcacacagacatttctttctctttttgacagaactcataggattaaaaaaaaaattgagtgtattaatttgctagggttgtcatcgcaaagtatcacaaactgactacttcaaacaatagaaatttgtttgcagttctggagggtagaagtccgagaccaaggtgttagcaaagtcagttccttttaaagcctctgtcctcgacttgtagaagggctgtcttcatgtttacgtgaagtgctctctctgtgtgtctgtgtcttctcataaaaacaccagtcataccagattagggcccaccctaataacctcatttaaccttgaaagggttaacagcccaccaaagtgatatgaagattactttaactgaagaatatctaaacaatcagcagccacataaagaaacataatctaaacttagcagagactccccaaatacagctgccattgaccccctccaaagcagtttcctattagagggctaaaatggttaattctacatggcaatttaatggggccaagaggtgcccagattaaacattgtttcttggtgtgtctatgagggtgtttccaggtgacattagtatttgaatcagtggactcagtagacagacctccctaaggtgagaaagcatcatccaatttattgagggcctaaatagaataaaagtcagaggaaggaagattttggcccctttgcttcttgccacatacttgctctgggacatcagtcttctcctgcccttggaccaggatttacaccattggtttccctggtctcagagcttcagacttgcactgaaattacactgccaactttcctactatgtgagccaatatttcataataaatctcttcatatatgtatatattatacataaatattcatatgtatatataattggttatcagtaatatgtcaatatatattattggttctgtttgtctggagaaccctgatacaggagaatactagcccttggcagca

SEQ ID NO: 427 - DNA, 40001 bp, Homo sapiens
agctgaattctaccagaggtacaaggaggagctggtaccattccttctgaaactattccaatcaatagaaaaagaaggaatcctccctaactcattttatgaggccagcatcattctgataccaaagccgggcagagacacaaccaaaaaagagaattttagaccaatatccttgatgaatattgatgcaaaaatcctcaataaaatactggcaaatcgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcctgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcgtgggcaaggacttcatgtccaaaacaccaaaagcaatggtaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttcgtgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggatgggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaaaattaatctgtgtaatccaccatgctaaatgtatgaagaggaaaaatctctttagctttgactgatgcagatatcaatgcagaaaacacatttgacagaatccaattattgggtataatctttttaaatgctcaataaactacaaatagaagggaactcttcaacctgatcaaagataagatttacaccattataaaagagcaagtttgggctccttttgcctctttgcccttccaccttctgtgacatgatgatgtagcaggtgccttactggcaccttgatcttggacttcccagcctccagaactatgggaaaataaatttccattcactataaattacccagtctcaggtatgctgttatagcagcacaaaacagactaagatatattccttattgaacagaaatgcaaaatcctcaataagacattagtaaattaaatccaggaacatatataaaggagcatacaccatgaccaaatgggattatcccaggaatttaaagaaatttaataccccatgctaatagaacagaataaaggacaaaaaccatatgattgggctgggcatagtggttcaagcttgtaaactcagcattttgggaggttgaagtgggtggatcacctgaggtcaggagttcaagaccagcctgaccaacatggtgaaaccccatttctactaaaaatacaaaattagctgggcatggtggcacatgcctgtaatcccagctactcgggaggctgagggaggagaatctcttgaagccaggaggcagaggttgcagttagcccagatcacaccattgcactccagcctaggcaacaagagtgaaactccgtcttaaaaaaaaaaaaaaatcatcttactaggtacagaaaaagcatctgaccaaatctaatacccattcatgatttagcaaaaacaaaaatgaaacaaaaaaattctttcaacaggccagaaatagaagggaatttcctcaacctgataaaaggcatttatgaaaagcctatagttaacaccatatttgccggatgtttcagaacaatgcaaggaagtcatgtctcactacttttattcagcattatacagggggttctagccagtgcatgaagacaagaaaaagaaataaaagcctcatagattggaaaggaagatgtaaaactgttgcagacaacaggatcctgtatatagaaaatcctaaggcactcacacacgagaaaaaatttactacaaccataaacaagttcatcaagttttcagaatagtaaatcaatatataaaatcaattatatttttatatatgctagcaaatcaaaaatgaaattaagacagtgattccattcgtaatagtatcgaggagactacttaggaataatacaacaaaaagataccagatttatacactcaactacaaaatgttgatgagagaaattaaagaagacataaataagtggagagacatttcatgtttaaaaattgaaagtctcaatattattaagttggcaattcttcctaaattaacacaatccctgtgaaaatcccagtaggctttttatggaaatcaacaagctgatcacaaaattcctgtgaaagagatccaaaatagcgaaaacaatatttaaaaagaacgaagctggaggactcacactcatctatttaaaagcctactataaagctataataatcaaaacagtgtggcagtaacataaagatatatttatatggaacagaactgacagtaccaaaataaaccttcacatttatagtcagttcattttcaataaagatgctgaggcaattcaattgtattttcaacaaattgtgctgggacaattgaatatctacatataaaaagaatttatacacttacctcacatcatacacaaaaattaattccaaatgaataaaaaatgcaagagcaaatgctataagattataagatatttagaagaaaacatagaagaatatttttgtgaccttgggttaagcacagattttttagctgcagcaccaaaatcataattcatatgtgaacaattaacaaattggatttcaagatttaaaatgttttcttatcaaaacacaacatcaagaaaatgagaagtcaagccacagattgggagaaaatatttgcaaatcctataatggataaaggactcatataaaaaatgcctttctttctttctttctttctttctttcttctttcctttcttccttccttctttctttcttttttctttctttctttcccttccttccttctttctttctttctctttctctctctttctttctttctttctttctctctctctctctctctctccttccttccttccttccttccttccttccttccttccttccttccttccttctttcagatggagtctcactctgtcatccaggctggagtgcagtgacacaatcttggctcactgcaaccgccacctcctggattcaagcaattctcctgcctcagcctccggagtagctgggactacagtcgtatgccatcactccaggctaatttttgtatttttaatagagagggggtttcaccatgttggctaggctggtctcaaactcctgaccttagttgatctgcccacctcggcctcccaaagtgccgggattacaggcataagccactgcacccagcccacttacaattcaataataagaaaaataaacccatttttaaatgggcaaaaaatttgaatcatcattttaccaaagaagatatatgaatgaccaatgtttaagtaactcttaggaagtcaggaaaaagcaatgagaaatgagaaaacaaaagaaaacaaaaaataaactggcagactcaagccataatatatcaaccattacattaaatgcaaatgtttcaacattattagctgttaggcaaatgcaaactaaaactatgatgagataccactacacatctattagaatggttaaaataaaaaatattggcaaggccaaggctatggagcaactggagctctcacgcattacagatggaaatgcaaaatggcagtccctttttttttttttttttttttttttgagatacagtctcacttagccaggctgatcttggctcactgcagctgccacttcccaggctcaaaggatcctccagccttagtgtcctgagtagctgggaccacaggcatgaaccaccatgcctggctaatttttgtatttttttgtagaggcggagttttgccgtattgcccaggctggtcttgaactcttgagttcaaagtggtgatccacctgcctcggcctcccaaagtgctgggattacaggtgtgagccaccgcaccaggctggcagtcacgttagaaaacaatttggcagtttcttataaacatacacttactatgtgatccagcagtcctactccaggtatttattttagagaaataaaaatatatgataacacaaatacctgtaagaatgtgtatagcagctctattcctaattgtcaaatactggaagcaacccaaatatcattcaaccaatggataaacaaattgtaatacatccatgcattggaatactactcagcaaaaaaggagcaagcacacaatttgggagacttccaaagtcattatgatgagtaaaaaagtcagtctcattaatatgatattcctgagagaacaaaactatattcgtggaaaacagttcagtggttgtcgcggtactgggtagagggaagtaggactacaaagggatagcatgagagagttttttgggttaatgcaactgccctgtatcttgattgtggtggttacacaaatctatacatttgtagaactgttcaccaaaggatgttatttttactatatgttaaaaatataataaaccaaataaggaataaagttttgatatatgcaacaacatggatacgtctcaaaataattattccaagtcaatgaaggcaggctggccgggcacggtggctcacgcctgtaatcccagcactttgggaggccgaggcaggctaatcacctgaggtcaggggtttgagaccagtctagacaacatggcaaaaccctgtctctactaaaaatacaaaaattagccaggcatggtggcacgcgcctgtaatcctagatactcgggaggctgaggcaggacaattgcttgaacccgggagacagaggttgcagtgagccaacattgcgccactgcacaccagcctgggcaacagaacaagactcttaaaaaaaaaaaagaaaagaaaagaaaagaaagaaagaaagaaactagactatgattccatttttataaaattctagaaaatgccaactaatctatagtgacggaaacgaggtcagtgattgcctgggaagaagggattgctggaaggcatgaggacattttggaggtgattaatgtgttcagtatcttgattgttctgatagtttcacaggtgaatacacattctaaacttattgaattgtacactttagcatgcccggcttttcatatactttagtaaagctgaaagataaaatacaatggctgccctcaaggaatgcaggatccagtgacaaggaaactaaaccagagttacagaaactatggggacccaaagcagaaatctctctcccctaccccagcccaactcagaaatcctcctgtgactggttacagctgatgctttttaacttgcatccacagcctgagtgacagaaatcacaagatcagctcacgataaagccaagcactggagaaaatttcacttttttcagaatgttcttcatgcatttcatcttatgtcttcctgcggtaccgcagcctaccattcccagcatgtgaccttgggcaagttccttggcctctctaattcccactttcttcatatgaaacatggtgatatggtttggctctgtgcccccacccaaatctcatcttgaattgtaattcccataatcctcacctgtggagggtggaacctggtgggaggtgattggatcagagggaggtttcccccatgctgttctcgtgatagtaagtgagttctcacgagatctgatggttttataaggggctgttccagtttcgcccatttgcggtctctctggtctgctgccatgtaagacgtgcctttgcttctctcttggcttcttccatgattgtttcttgaggcctccccagccatgtgtaactgtgagtcaattaagcctctttcctttataaattgtccagtcttgggtatgtctttatagcagtgtgagaatgaactaatacacatgggtaatccacatacccaactgccagggttggtgtaaggagtgaaggaatcatctgtaacataacaacagatacccaactgacagataatacttctgggaggactcagttttatacctttatgagtgtgagtgtgtgtttaggataacaggcatgtaacactcctgatactgaaaaagaaaagacagaactgaaactctgggtcaggaaaccacagtcttaagtgagattgggcacttttccatcccacttacatcctgagatcaagagaaaaccccattccagtttacagatggggccatgagacacaaagggctaactgatgacaaacctggtactcctgactcctagtccagtgctctgacaacaagggcagatttgggggacaaaggccatggaggaaccaaaaatgggagctagaaattgagtagaggaggtaattgggtgagaaactctaaaaagccatagcaagccaggcacagtggctctcgcctgtaatcccaacactttggaaggccaaggtgggaggatggcttgaagccaggagtttgagaccagcctgggtaacatagtgagacccttctacaaaagctaaaaaattagccaggtatagtggcacacacttttgttcccagctgcttgggaggctgaggaaggaggatcacttgagtctgggaggtggaggatgcggtgagccatgcatctgttcacactgctgcactccagcctgggaacagaacaagacctcatcaaaaaaaaaaaagaagaagaagaagaagaaaagaaaagccatagtattctgccctcgaggggcagggtgagaaggcaggtggcagtgaaggagcagcattcattacattcattcctccctccatccattcattctgctgctgatatgcatggatgcctccataggacagcagcgtgctgggatctgagggttcagtaagacaggcccctttctctgcagagctcacactgatgcaggcctgaaaggtgaggacataaaagtggtgttttgacacaattccaattctgtcagtgagtttggccccagcttagccagtcaccctgtcttgttcttggtgcccactgggccaaatgcgagggtgaggagcaagaagctgcgaggtgtggagtggtctggagaaggagtagaggtggaggatgggtgctctccatctcctgtaggccttctgagcttagggtgtctcccacctgccctatctccttgttgggtgagctggggttgactcccagaagtcaaagggctcctgcgcagaaggcagaactggagcagagggcttggctcctccctgtaccctgtgcgcccagtgtgggggccttgggggacccagacggggaaggctagtgcacaggtacttcacctctgaggtggggacagaagggttttaggattaacatctgccgaccaccagaggccggtgttgggacatgcaggtgacccagaaaaccgcctctgcccggggacagtacacagagcgtagcctccctcaacccaggcttctgtgtcacacaggcttcctttccttttctgatatgtcaagccttaacctcttagaaccttgtgggcaggagcagcactggacagccgtgtggccagccaggatcctgctctaggactttttttttggaaatacctgcatcagccactagagggaggtaggaagctgagatcttgggtccataggtgagcaatgaattgttacaaaagggctacagaaattgctctgtgtattagaaataaactgcaattgggtgaagagagagggggaactggcaagatggcacaaagctgcagacagaatggaaagggggtgaagaagaagaagttctatcactgtagcgtgaccacaggacttcaagaataggagcactagcgctcactttgaagttgcttctgccacaggcagatccgggtgatggtcagcttggctgtgtgaatgggactcagtggaaaggactgccttctgtggggtgcagaacaggggcattactttttgaatgtcctgatgagccacacacagatctaaccatgctgtatcaggagagagtcagtgctagtcatgcacagtcatgcacaagggaacttgcaaacaccctggcaaaagctttccacttgcacgtgagcaaataggagcttgagcctgtcgtccaggtcttaggagcctgagagagcctgactgatgtctgtgttacacaagaggggtctagggccacgaggcagcaagttaggaggaagaacgtgggaatcccaggtccagggagcccccgccacctgcaaacaaaaaatagggaaggaaggctttcccagcagaaggtaaaatttgggtctggattctgaggagagagaagcagctgcatagaggtgggagaagagagagatcagatgcccactacaatgccctgcactgtaggattctgtcttctcctccagcccaccctgcaccattcaccctgtataaccatgtcactcaccatggagcaatagcatcctaacttgtttctctggtcgaacattacaacctaatctgtgcccacacaaaagctagagatcttttaaaaatgtaagttgccgggtgcagtggcacacacctgtaatcccagcactttgggaggccaacataggcagattgcttgagcccagaagtttgagaccagcctaggaaacatggagaaatcccatctctacaaaaaatacaaaaattagcctggcgtggtggcacatgcctatagtgccagctacccaggagactgagatgggaggatcacctgagcccaggaggttgacgctgcagtgagctgtgatggtgccactgcaatccagcctggatgacagagtgagaccctgtctcaaaaaaaaaagtaagtcatctgaccctcctctgctttaaaccctcagggacttcccattactagaatgaaatgcaaagtcctttctctggcctgcatgagtctgcatgagccctctcttccctccctagcctcatctcctacctccctgctaatgtgctccagccatctgtcttcctgctgttcttcaaccacaccaacttcattcctgctactatactttcacacttgctgtccctctgtttaactatcgccagcccccaggctttcacatagatggctccttttcatcatttagctctcaaatgtcaccttgtcagacatataaagtggccctctctccctggcacttcctgaatctccctggatcacgttagtccctagcccttatcacatccgacatggcctttgcttgtccagtgactcttcctctgctatcatgtatgttcctggagggcagaaccttgtctgtcaccttcactattaatccttagtgcctggcatggtgcctggcacatagtggtgctcaataaatatttttggaaagaataaatcttcaatcaatcctattcagtaggtttgatgatcacttccaatctatagaaaggaaaactgactcctagaaagattaattaacttgcccaatggcaggtagcagtagaagcagaacttaaaaccaggtagcctgactttagcatcttaacactgggttgttttgcttctactacttgcactgaaggcacttaccacaatttatagttgttttatttgtttgttgtctgaccctcctaaatgtgtatgatgctgctagagcagggctatgtcctgctccctgctgtgccaccaatacttagaacagtgcctggcacattgcagctgtgtgagtatttgctgagtgaatgaataaacaaccaaatgaacagacaagtgagggatgactgtggaggaatagggggtgccagtgtggcagtttcccaggccccagctggatcccagtgcccagtccagctgtacccacgtaaagggatctgccaagaggtggcttttcgctgttgcagaaggcatctcttggggctgatgacggtgagtctctcattcttaacagcaagagtcaccctgctccatgaatcttcaaatttggggtcatttcccacctaaaggcagagatttggcctatgttcccaaccacagctgagagtccaacctgcccctcgggtgacacacatggctctgggtagatccgtgtatactgcctcgattctactcattacattatgtcagcacctttttcagcttctgagaaacaggaagcatcatgatgtgtggtggggcttgaagaagatgataagagacataatcacatttctttggttggggcacagagggctggggttcctgtttgctctgactctaaagtgtcaccttttcccttaagccagaatgttggaggatgaggactatttagacaacctgctttcaaggggaaagaaaagagcagggatcagagcctttaaaattattattatgaaacatcatacatacaaaaaaattacaatctctatgtatagtttaaaacataacaaaaacccatgtgtccaccacccaactgaagggaacattccctctccccatgaaggtgtccctccaacagcttccatgtccctccccaccaaagggaaccattatccttatttttttggttaatcatttatttgttattcttgttttattatatatataaatatcctctaattatatatgatttcatttttcctatttttgccctctttataaatggaatcatgttggatgtatttatttaatatttgcttttactggtcaacaaaatgttttcagactcatccatgttgatacatataactgtagtttatttatttactgtatttactttactataatcttctaaatgagtaagccataatttatttatctattttattactgatggacattttgcagatttttttttttttttttatgatatggagttttgttcttgttgcccaggctggagtgcaatggtgccgcctcggctcactgcaacctctgcttcctgtgttcaagtgattctcctgcctcagcctcccgagtaactgggattacaggcatgtgccaccatgcctagctaatttttttttttttttgtatttttagtagagacgggctttcaccatgttggccaggctggtctcgaactcctgacctcaggtgatctgcccacctcggcctcccaaagttctggaattacaggcgtgagccactgctcttggcccattttgggggttttaaaagttttagttgttaagaacatgctgcaaaaagtaagtaaaactaaagaaatctgaataagatatggactttagttaacaataatgcatccatattgattcattaatgtgacatgtatagcatactaatgtaagatgttaaggactgggtgctgtggctcacacctgtaatcccagaactttgggaggccgaggtggtggatcatgagatcaggagttcgagaccagcctggccaagatggtgaaaccccatctctactaaaaaatgaaaatacaaaaattaacagggcacggtggcggatgcctgtaatcccagctaggttgaggcaagagaattgcttgaacccgggaggcagagattgcagtgagctgagattgtgccaccgcactctagcctgagtgacagagggacactccgtctaaaaaaaaaaaaaaaaaaaaagaaagatgttaagaatagggaaaattggatatggagtacgtgggaactttctgtactatcttccccatttttctgtaaacctgaaagttttcctaaaataagtttatttaagaaaacagtctactatgattgtggttgtttatctctcctgacgttcatgggcaagaatttccctagaatatgcactaggttgaaattcggggtcataaggtacgtgcacgttcaattttttactaagaactacatttcaaaagtaccattttactcttttgtggacaatgtgtaagaattccttttactttacatcctgggcaagaattgtaatgtctgactttttaatttctgccagtctggtgggtgtgaaatgttatctcactgtggtttaattttggattttcctgactactaataaggttgaacatctctttatatgtttattggccatttgtgtttcctgttctaagaaatacttattcatgtcatttacctttttttttttctagtgggtaatttatctttttcttactgattaagaggattttgttagacattcttgaaactaatccttagtcatttatatatgaaacaaatatttgtcctagcttgcggtttgtcttttcactctccttatggtaaatttgatgaatattgaatgtatcagtcttttccttggtgctctgctctttgggggttttatttatgaaatccttccattccatctggaaagctcctatttgcctctccagatctgctctccacccccttttagcctctgtgtcctgggaggctgaccagtatgaactacattaatagcttatttgcccacaggttcccattgggtttgaccatgggagcattgacaggtgatcaaaaggtaggaggtgcgtgaagcaaggtatgtatgcccttagctctctccttgcaaggttgctgcaagctggttgtgtcccttgacttaaggtcccagctcttgccaattggccgtctgcatgtagtgctctgtatcgctgtagtgctctgtatctctgtgtgctctgtatctctgagtttcagtaaatagtccctctcctgttgcagttcctgttaccagtcgccaagggctttgttttccctacactctattcttttataatggtccctttattaaataaactgccttaagttactcaatatgagtgtccctactgtttcctgctggataagcccactcccaggtcatattttctgtttttaaattagtttttcaccggtctatctgtctacccctaggatttctcaaccctgccactactgacattttggatgggagaattctgctgtggagggctgttgtgtgtactgtaggatgtttagcagcatccgtgacctctacccagtagatgccagtagcatcccctccttcccctccaattctgacaaccccaaattgccaaatgttcccttggggttggggaatcaccctctgttgggaactactgttataaccccttgtcaaaaccacacttaattattaaggcttgatatctagcaagacaagttctcccatttgggttttgttttgttttgttttgtttgtttgtttgcttttgagacagggtctcactctattgcccaggctggagtgcagtggtgcaacctcagctcactgcaacctctgcctccccggctcaagcgattctcatgcctcagcctcccaagtagctgggactaaaggtgtatgccaccacgcccagctaatttttttggatttttactagagatggggttttgcaatattgcgcattgtggtctcgaactcctgagctcagacaatctgcctaccttggcctcccaaagtgctaggattacaggtgtgagccaccacacccggccacgttctcccattttcagctccttctttagaattgtattggctattcttggactctcattttcccgtgtacattttagaatcagcatagtatgatcatgaaaaaaatgcttgggattttgataggagtcacattaaatgtataaatcagtttgcaaattacagtgtcaagtcttgatccgtggacatactaggtctctgcatttgctgttgttactatctttcataaagtttttaaatgttttccatgttttgttagatttattctttggcactttacatttcttttttttttcttttagagagagagagatggggtcttactcagttgcctaggctggagtgcagcctcaaacttctggcctcaaatgatcctcctgccttagcctttcccaagtagttgagattacaagcacgtgcccccataccctttggcactttatagtcttataagtattataataatgcttatacttatttgtaatgatgtcttctttaaaattacattatctgttttttggtaatgtataatttgtaattgattttgcatatttatccagcaacttgctgaactctcttattccttataatcatttgactgactctacgtgtttttgagttccatttttatcatagtgtatcatctgcaaatatatatatgatttttgtttcttcctttataatcctcatatttattagttctattaatatgaatgatctttttgcaaaggctgggacctttggtcagtttttaatggaaacaaagttagtctccagggacactagtacatcatataaagcctctgtgcaaattggaaaaagatacttctatctggtatgaaattgtcatacatactcaaatatataatgtctctgatgtaaatggtgcttcctgggattgtgcagtgcacagagtggtcctgcaggtattcttgcattattctttttttaaagagatgatttgaacatattaccattgagcacagtattttctgtaagtttatcaggttaaaaaagttcctttctattttgactttgttaaaaagtaattataataaatgaatgtaaaatttcagtaatgctttttctgcattgatatcatcatgtgattcttctctctctctctctctcttttttgttttgtattttgagactgagtttcgctcttgtcacccaggctggagtgcaatggcacgatctcaactcactgcaacctccgcctcccaggttcaagcgattcttctgcctcagcctccagagtagctgggattacaggtgcccgccaccatgcccagctaattatggaattttagtagagacagggtttcaccatgttgtccaggctggtctcaaactcctgacctcaggtgatccacctgcctcggcctcccaaagtgctgggattacagacgtgagccactgtgcccagcctgattcttctctttaaaaagtgattaatgtggtaaattacattaatagattttctgacatttaattttatattcctgaaataaaggaatatttcatattcctgacacttaattttatattcctgaaagaaagacattacattagttgttatgtaatgtctttttatacatgctggatttggatttataaaactttgataacaatgtttatgtccacattcatgagtgagtatgggatcataatttttctttcatatattttcctcctctgactttcgtatgctacatattagcttcacaaaatgagctgggaaatatctcattttgtttattttctataagagtttatatatgtttggaattatatgtgacctgacactttagaaggactcacctagaaaactatctggacttggtgtattctttcaagaaagattttaaatgactggtttaatttctttagtggttctagatctgtttagatttttctatgtcttcttgcatcagttgtggaaatttatgtttgtattggatacatatttgtgtgccttctcagattgccctcactgcctcctatctgtctctttgtcagcaccaacaccaacacagcacccttaatttccaggcatagaaggcaagcagagcctgacttcaggctctgctttctgaagagacctggctatgacaattagtatcagatgtaattttaggtaacaaacacttggaaatggaacattgacattggattattcactattttaaaataatatgaacctattgctgaatataagtaggttgataataacttctggcaggcagtggctttgcaatttcttaagcttttagctctggttaatttagatgaggggcaggtggacagcaagacaatgaaagataaaatgacagggttatatgagaacaatggtaattataaagattgcagagtacaatgactcttctgacagcactgaagaccttaccaaaagaaaatgataggctcatggcaatctaattctaacttaacatattctcggaatgctcgacaactcccatggcaactttagaggagactcttatttccagcaactgcagggcaaaccgatctgaaaattaggctcaggatctgattatttgcagcctttgaagagcttcaaaggagaagagtggattttgcacattctgtgtcaaagtcagggctcttatgaggaaaggctgggaccatgagacctgggatagaaacatttgggtggacaaacctaaaactcttgaacctccaaattctctgagccctccttaactggtagaagcagacctttcccccttgccagagtagactaacttctccttgcctggaaacagaataactatttcacttgaaacatatacttcacaagatgacatttgttctgcccacaaccctccctcaacaccccttattgcctcaaggccaataattaaagtcagatctaagaacatcttgtgttaactaggcaccaaccaggagacacaaactataccagttattttaataagcagaattaaatataaagaactgttagccaggtattggaaaactaggcaggcaaaaagggaacaataaggtatcaaggaggtggcaattgtgggaagcagctagcacttctatgtctgggaagcaaagggaacaggtgaaaattattaaaacttataaatttggaggacgggctttgtggacctgaaactcagacatctgtagaggggacactgctctgcatgcagtgcagttcctgagctcagaaaaggggtcctttgggaatgggatccagacctctgaggggatgctgattggctgttgctggggtctcagagggaaatgaggtgtgctaaggtcggttctatgaatggtggaaaaactgcaaactataatcaaatgttgctactagagtcaactactgctgccagggttcatgttaggattaggattaggaataggaatataagaggacaggaacaggaaacaaaaacaaagaataggaagcaacaggaagaaaaaagtccccttttcttcctccagcctcctagtctacaccctccattgacagatcctaacagggttgcagctggcaaaggagaaattggtttgcagaatcccagctgcagcagagtatagtatagtgggcttgaagctgagagacaatagcttcacagctgacatacagtcttggcagggaagtgtaaggtgtgcaggagtttactaatatgtactgtcagaatccagaatcgagtgcatcctgcagctgtttgtccagaagaatatagagttgaatgggattggatttattggtgtgggtatacttacgactcagaattaagttttcgcaagaacaactggagttagtcctaatagtttgctggagtggctccttgaagcctgatcctgatgatggtgtacagaatatgaagtggagacacctgaacttcctcccatagtattgaagaaaagagcagatagctcagagaagcaggaatactaaaatggattttttgtatctggcctgagaacctactatctgagtatgttcctggaggacacagaatatactccttttactaacacagcaacagatacactagtgaagagaagcaggcatcattgcaaacattggtggtggatgtcccctgtaagctgggttgaaggtgaaagatgctgccaatgacatggactccctaatatcaataggcaacatgagatccctagaatggcagagctcaggttggaagcacttaaacattagaggcaagggggacataattaccaccacaaacagcaaggccatggtgccaaccagggtgccttgactcttaaccttcagggatctattgtggtggctaagaaattaaagtgttcctagagacaagaaacgttgataatcaattagcatgtatatgtaatcaagtggtaaagggctgacatcagccaccacagtggaaatgcaagctcttcatccagttcccacatctaaggcattcataaacccagtgtccattgattgaacaggaggactctataatcccactacatatacatgcagtaaactttctttaatcctttaccaaagcgatctggagccattcatcaggataagtacacactagtataggagatacccaaacttttcaaacattgttaaatatgaggtctgagctaatactgacaccaggaaaacctaaatctgccatgattctttggtaagaatgggacttccatcggacaagtgaaacatggagactcctaggcttgagtcttttatactctggaactgtttttctagttctttgttgtataaatggaataaacattctaagcacctggtagaaccttcctgtggctttgaaacttttgtaacagctcgttacatttataggcctgtgcattttactctctctatgtcgtgatcctgatggtaaatgtacacaatgatatgagaccatgaaagcagtaggtcagctggccacaggcaggtacattgagattaaaaaaactgctggacatggtggcacttgcctatagttccaattactcaggagggtgagatgggaggatcacttgaacccaagagtttgcgtccagcctggacaacatagcaagactctatctcttaaaaaaataaaaacagtccaggcacggtggctcatgcctgtaatcccagcactttgggaggctgagatgggcagatcatgaggtcaggagctcgagaccatcctggctaacatggtgaaaccccatctctactaaaaatacaaaaaaattagccaggtgtggtggtgggcacctgtagtcccagctgctagggaggctgaagcaggagaatggcatgaacctgggaggcggagcttgcagtgagctgagaccatgccactgcactccagcatgggtgacagagtgacactctgtctcaaaaaataaataaataaatgaatgaataaataaataaaaagaccgggcacggtggctcacacctataatctcagcactttggaaggctgaggcaggtggattgcttgaggtgaagagctcaagaccagcctgaccaacatggtaaaacactgtctctactaaaaatataaaaattagctgggtgtggtggcatgcacctgtagtcccagttactcgggaggctgaggcaggagaatcactggaacccaggaggtggaggttatagtgagccgagatcatgccactgcactccaggctgggtgacaaagtgagactccatctcgaaaaaaataataaatgaataaataaataaataaataaaaataaaaagagggcagtgtggtggctcatacttgtaatcccagcactttgagaggccagagtgagaggatcacttgaggccagaagtttaagaccaacccaggtcacatagtgaaaccccatccctacaaaataattttaaaagatattaactaggcatggtagtaagtgcctgtagccccagctactggggaggctgaaacaggggaatcacttgagcccaggagttcagggctgcagtgagcaatgatcacgccactgcattccagcctgggtgacagagcaagaccctgtctctaaaaaaaaaaaaagaaggaggatatggtgaatgaaaacatctaaagggcaattacaagtttgttgggtgggaaagaaaaaagatactgagacagagggtatagtgtggaccaaggcacagaggtatgaaaattcatggatattctgtgaagaataagagctagcattctttacagatcatctctttgttttttttgttttttttttttttttaaacagcctcatactgttgcccaaagtggcacaatcagagctcattgcagcctcacctcctgggctcaggtgatcctcccacctcagccacctgagtagttggaactacagatgtgcaccaccacgcctggctacttttctttctttttgtagagacatcttgctatgttgcccaggctagtcttgaactcctggactcaagtgatcctcctgcttcagcttcccaaagtgctgggattacaggcataagccaccatgcctggcctgaacatctccacaataaatgttttccacatacagttcttcttcatagaacgtgtctctcaatacaatgctttcccaccaatatttatattgtaaaaatatttatgtcccctaaacataagaaattctttaaccaagtgatgaggggagtcaatggacaaagtctttaggtttattccacatatgattagtagcaaatcagcgttcacagaagacaatcggaaaggctctgaatgttaactaaggggacgtgcagcatgttatacagacaaagcaaccattatattaactgctgagtgatcaggaagtactgttttaaatatcttatatccttattttactacaattaaataaataaatacaaaatattttgtttaaatttttacaccctaatgtgttttttccttatatacaggcattttactatgttttatgttttaagaagttggttgaagattttgggttgagacataatgcattaaaatttttcgcacttaaaataatgggaatgaggcacctggttaatgttttcttgccaaggttgttacatggatgatgcctgtatttctgtatgtcaggggtcagagggggcagaggtcgaccttgaatgacctgtgaaggagcctggacttcagatggtagtgagtcagaggtttctatgcacagcagtgacacgtggacatgtgtgtgtgttgtcaacaggcttgacatgagttcgaatcaagttttatttcagttagttgcaaacagccctgattgtttttagcttctctgggacctggcagattggtgagggctcattattggggatttagatgtgatattccagtcttaagtccttattaactatattagaccctgataagaaagaggggaaaggagcttttttgagaggatataagtgtacaagggaaaggattttgtctgttttattcactgttgaatcctagcccctagaatagtcctggagtatactggaactcagtatctgcctaattgaatcaagttgagattcagtctttttgcaagttgagtttcctgtttcctgtctcctgtctgtctagagtggtcagcaccgtgctgtcctcatccatcttgctccctcactagctctgctcctgatcctggggcttggtgcatgcacaagttggggacctggtccacggtcctgaccaccatgcctgggtgtgtgctggaaggaaaacacgtcttcttcctcggaaggagttccattctcctgcctgggaatctgtgtccgactgctctgacccttctcccatgcccagaaagagcaggagcaattgcttcacacagcagtggagcccaacactgcagcaatccatgcagataaagcccaggataggagtactggcctctaaggacctccagcacaggcccacagctgcatcccacacccagcagagagcctgtgatcaatacagatttgttgaatgaaagaaagagagaatggagggtctctcctttgggtctatatcagttttaaaatattttaaagagcatattttctggatccttgagaagttttctcaaacagaagaatctctagtgatgctactgatagccataagcaggcagaatggagtgttgtgcggcctggtgctgccctgcccccgggaatacggaactcagtctttctaatgggactgccctaccagtgtctctctgttccttttgttatggtgcagggtcaggtggggtaagaacccctgcaggccttggcagagagggtttctggcttcctctctatactggcaatgagattgatctgccaaattcttctcacaggctgggcaggaacctagttacaggttcccacactgcccttcttccaggggacgccttacaactcattttagttctacaatcagtcttggaaagcacattcattcatttattccctaccatttaccctgcaccatcccaggttctggatatactgtagagagaaaaccaggttcacctcctgcctgtgtccctgctccccacatccccactaagtcctgctagatcacttccacctctggtgtgccttgcaaccttgagacttctccagagaaatggggatgctcagccacatgtgctcagacccttcctccaaactgggcatgtactcaatggactgtgctaacttcaattgctaagacagaggccagcagcaaattgaacagttgtctatttttgttttattagaacacaacataacattaaataaatactaatttaccaaattcttaaccatttcataaatactattaagttaacagacattttacagaatgttaagttaaataagaaaaaagtatatcaattttgcctggaggaaaatacttcaatgattctgatatctgaaatatattttaagaattttatgctttctggcaaagtgtcagtatgcctgaaatatttactttccctctgaagttaaattatactgaaaattaaggcctgactctttcttggccctcattctcactgcagtaaaatgtccttctcctccaaaatctttggctgcaacaaaccagtttagtctcaactttctattatccactcggtgttcattacaccaagaaactcttgcaggtagtctaggaattggtttactctccgtctttcttctccacactttttctgtgaaaaaagaaaaatgacaataggtattacaggaaactgtcaattccatagaaataggcacagccagacaaatatagcttccattgaatgtgtgtaacttactttttggccgtcaatgtatttctttattaaggacaagtttttgaatagtctttccacagtacccccttgcacagtttgactctccagtgtgcctattccctgaaagatttcttcagtgcacagttggtgctaaatgaggaaaatttttaaaatgcaaataatcaagacaaggtataaaaatttggtccattgtccattctgcaatgtatacatacttcaaaacatcatattgtacacaataaatatatatactttttaattcatcaattaaaaaataattattaaaacaattttggtccacaaagttaggctttgttttgtggtatttacatgagttcccttctccaaagagttttttgtttgttttctaggcaacaaaccaccacatattaagataaaattttcaaaaagtagatgaagcttatatgattactgaggagttttataaaggatataacttaattatgtaactggaaaaaaatgttttggaagtgtaatgcattatacattaaactcatatcaatgtgtttctacagttctagctggtagttttattctatttagactaataaaactatatattttacattttaatatgaccaggacatattcaaatgcatacaacaccatcatatagtcataattatttaagtatgcagaaattattaatatagggcatttgttatatattttaatgtctactgatcatggttctaaaaatataattctgagttgctaatactttcagaaacacgttagagtgagaaagagtcagaactgcacggagactagcacgcacctctcactcagtgtggaatccttctggaaagaatccctgacacgatgctctttgggaggcaaactaacaacatcaccaaagagcctaatccacttgtttaaaggattctacttgataaaaagtcattcctcatatttataagtacagacattcacagccacccatatgaaaacaaaatatagaaaattaaatagttccaatgataactaatgatttacagcttaaaacaggaaatttacttattcatgccatcattttactgaatcataatttaacttacatttttatgtacaggaacaggaatcctcagagtctggagaggaaaggaaatacaatcatttttacagcacaccagcattcataacttttaacagaatgtttgctggtgatgtagttatcacccatgtactaatgtgctcagaatcttattatttataacagatctctatatatagtaaaggaaccatcacaaatgattacctatgcactttacagactgtaggaatcataaagaaaattacctcattggctatcagcagagttcgatgagtagaaagcagtgccaaggtctctttcaccaatgcacttgtgggaatttctgtggggatggcatacacgtaggcagctccaagagctagcaaactcaaatgcagaagcatcctcatggctctgaaacgttctgcgtttgcctttggcaaagaaagtgcatagtacaagactgcgtccccagtcaatttattgtctgtctttgaggaaatgaataatttctaacaatcagatagagaatgcctaataatggcatatcgtgaaactaaatgtttccaatgccttatatcttaaaaaataaatttacttttatcttttaataataaaaatccctgtttcccccctttaaaaacattttctattacgaagaatctttgggttaatacatcattgccccacatttgcatttcttaaaatcagaaaattaacttcctcttaaaagatgtgtgcaaaacaaagtataaggtagaccactaaacagaattttatgctaaaatacataaatattgggaatgtttttttcagatcggctatgttctactatgactgtggctagattaatctgtcttaaaagaaattgaaaatactggtgggaagacagtgattgaaatggaaactgccaagccttggcagggtcgagttctgttcactggggtcttgattaggatcctttctgttgccagtgactaaaaacctaacctaaagttgttgaagataaagagggaaggtattggctcatagaaccaaacagtccaggaatggaggctcttttacattttgatggcttcagtgactcttccttgactccatccttgggcacctttcccattgaggtctcaagatgatgtccagactcctggatctatatgtattctgttcatgagcagcaggaaaaagcaagctgtgcttttctgattgtttaatcaaaagctttcaaattcagtctctttctgacaagggtcacatgttcatccttgaactgtgaccagggtgtagtatatactgattggctctccctggagctagaggtgaccctaatcctacctcaactgcatagcttagaaatgtggggtcccagtagtaagggggacacagattctaggaaggcaaccaataaatatctgtcacagatacacaatacatggatgtgtcctctcctttatgtcccataagggtggaggtgtcctttcacaccttgggcgggccatgaaattaggggaatcagcctttgttccttaggctcagacctgtaatcccagaaaggtacaaatgaggccccctcctagatcacacacttcctttttccctggcctgaacacatatgatggaggtgtatgtggctcattgtttttaatagagtgcttcagtgagcatcccagagtggctctatgttgcagcctagaagcctgacttcaggcctgtcttgagcgtcaagaacagatggtaccaaacacaaactgttgcccagaacagttttccaaagctaggtgcagttgtgtaggagaagtagaggcagctgggaggtagacacacctttcatacatactcaatcccagctctgcactggaaagataaagacagtcttggatttcagtggcggccttcttgtaccacgtttggttttgtttgtgctgaagttttggactcttggttagatgtgtctgatttgcgcacttgagaaatgttttccttgagaaatgtttccttgagactgcagaagtttggctcacttcagaaaatctatcgggagtgagattttcgggagtaggaatcacaataggcttggtcaaagtgctcttaaaatggtattctcagaaaagaagctgagttctggcaggagctttctcttcccagagaatatgagagcgttctctctgattccccctgacacctttatgttacactgaggaagttagggcttaggtgaaagtttcaggggaattgccaaataacttgttattttagtaccttaaatacacaaagttctgagtgcttaaattctatcataggaggctgggcaaggtggctcatgcttgtaatcccagcactttgggaggctgaagcagaaggattgcttgagcccaggagtttgagaccagcccaggcaacatagtgagactccatctctagaaaaaataaaaaattgggctaaacacagtggctcacgcctgtaatcccagcactttggtaagcccaggcagtggatcccttgagcccaggagttcaagaccagtgagtgaaatgggcagggtgtaatacatcaaagctggtgggggtcacatgaaactatagcatgcatgatctgtctaaaggtggcaggtgctgctcagctccagctgatggttgccaggtgacacacctgggctcacattacccgatcattctgtttttcaaagaagcctttataaaaattagccaggcgtggtggtgtgtgcctgtaatcccagttactcgggaggctgaggcaggagaattgcttgaactcaggaggcggaggttgcagtgagctgaggttgcaccactgcactccagcctgcgcaagagagtgagactgtctcaaaacaaacaaacaaacaaaaaaacaaaaagcacaacaacaacaacaacaacaaaaaaggaaggctgaaatcctgcttattatatataatctctggatttttcaaatgttggcaactgtataatgtaccattttgcagcctctgttttacagcaaaactgtgggttcttattggaaggctagttataaaaaatacttcttattcaaaattgtatttcttttagaaatgtttaattgtggcaaaatacacataaaatttactatcttaaccatttttttaagtgtacagctcagtagccttaagtacattcataatgttgtgtgacaaatctccaggactcttttcatcttgcaaaactgaaactctgtacccattaaacaacagctcccaacccccgcccccattctcccagcaccttgcaaccacgcttctactttctgtctttatgaatttgatgactttaggtacctgatatacagtacttggctttttgtgactggcttatatcatttagcataatgtctattctcaagattcatccatgttgtagcatgtgtcaattttcttcctttttaaggctgaataatatttcattggatgtctataccatgttttgtttatccatggtctgtcgatggacaccaatgttgcttccatcctttggctattgtgaataatgctgctatgaacatgggtgtacaaaattaaatttcttataaagttttcgtgtcattaacttttcctctataagtgtgatctccccaacctgactgtaaactgtctcggagttggacctgtaaaataatgtatttgaaagagctttattggccaggcatggtggctcacacctgtaatctcagcactttgggaggctgaggcgggcagatcacgaggtcaggagatcgagaccatcctggctaacacagtgaaaccccatctccactaaaaatacaaaaaaattagctgggcatggtggccggcacctgtagtcccagctactcaggaggctgaggcaggagaatggcgtgaacctgggaggtggatgttgcagtgagctgagatcacgccactgcacgccagcctgggcaacagagcgagactccatctcaaaaaaaagaaagagctttattaatgcaaaactccaaataaaagttaatgattttaatctcctgtgcccaagaattcaaaataatgtatgtagctactacaccctcaaggagatggaacacaaccccctttcattaagagtgggatatacagagtgactttttaaaaaagagaactgtatggaaaggggagaataagaggaataacttcacagtggagaaacctgatcaaacactacttcagctaggtgatcccagtcaatggtggcagtgaaacatcatgttaacagcatgtacctttgatttgatgtgataagaaaggaactttatccctgtcatcttcctccccaaaaccagtaacctctgcctaaccatgacacaaacactacacatacccaaatggaaagacaaaatgcctgaccagtactccttaaaactgttaaggtcatcaaaaacaagcacagtctgagaaactgacacagccagagaggcctctaagagacgtgatgactacatacaatgtggtatcatggatgacactcaggaacagaataaggacaacgggcacaactaagggaattggaaaaagcctggagtttagtaatgtaccaatattagttccttagttgtgacaattgtaccatagtaatgttaacaatgggaaactgggtgcagggcacactggaatgctctctaacagtcttgaaacttctctataaatctaaaactacttaaaataaaaagtgtattaaaaataatactgcggcgaggcatgatgggtcaggtctgtaaccccagcactttgggaggctgaggtgggtggattggttgaagtcagcagttcgagaccagcctggccaatatggtgaaaccctgtttctactaaaatacaaaaattagctaggcttggtggctggcgcctgtaatcccagctacttgggaggctgaggcaggagaattacttgaacccaggaggcagaggttgccgtgagctgagatagcgccactgcactctagcctgggtgacagagcgagattccatttcaaataaataaataaataaataataatactgcacattgaaaaagttaatgattgtttttaccattattatttaaaaggctttgctcaggaggctgaggccagaggatcaatcgggcccaagagtttaagactagcctgggcaacatagtgagaccctgtctcaaaaaaaaaaaaaaagcagaactttgaattccatgagtgtaatgcagttggcacctttttatttcaccagtagactatgagctccttgagaataaggtttttattgaatcgatctcttcatccttgaggactagcctattgtagacagtaaaataaagatttgttaaataactaactgaatgaacaagcaggcacttacaacaactttatcttttgttgtactcgttgagttaatgtgaatacagcaggtccttgaataactttgcttagttccacgttatttcattatactgttgataagaaaaacaatcgcttcccagccaaagccattgtctatgtggagtttgcacaatctctcacatcccaaagatgtgcacgcgaggtgaattggcatgtctacacagtcccagtctgtgagtgtgtgtgtgtgcgtctgtgtgtgcgtctgtgtgctctgcaatggaatgacgccctatccaggattggtgctcaccttgtaccttgagctaccgggataaactccagccatcttcaaccttcaactggaatagttgggtaagttatcttacttgtttttatgaatctttcttaaatgtacatatagctcataattgtttcaatgtttaatattagaagtgtttggtctttgtttagaagtgtgatgatatttttgtggccagaaatatgccataggaatgtaagctttgttcatatcaattcacctacggtaaaattggttttgttatacatcgtttcccttaaagtctgtttccaagaacctattgatgacattaagtgaggattactatactgtggaaactcaagaagtctttttcttttttttgagacagagtcttgctctgtcacccaggctagagggcagtggtgcaatctcggctcactgcaacctccgcctcccaggttcaagcgattctcctgcctcagcttcctgagtagctgggattacaggcacctgccaccacgcccggctaacttttgtatttttagtagagacggggtttcaccatcttggccaggctggtctcaaactcctgacctcgtgatccgcccgcctcggcctcccaaagtgctgggattacaggcatgagccaccgtgcccggcctcaaggagtcttttacctgcagctaggagcctaaagtaacaaacaacaggagttctttggcagaactcctgggcaaaagagagcaaagctttaaagttcagctacagagacggaggcaatgtgaactaccatttagattttttaaaatccacgttattttagggaaatagaaagaaataaacaattagtactttgatttttaaataattactggttggtaattttataatttaaaaaaagcactttgattaatattgaaaagttacattggtgggtaacatccatccttttgccctaaaacttttatctctattagtgggtaacacattggcaacatgtctttaaaactgataactgtggtttttactgtgtagtccttaaggtcaaatgacttttccatgaactgattctaatcaactgagcatgatgcctcgcaattttcatgatgactaaatgtaaattgataacatctctttttcttcttgactctattcgaaattctatcctttcaatctccctttaatatgattttttaattgaataaataacattataggaaaataaacacagaatttcttggtatagcaactatcagttttttgaaatcatcttctaaaccttaccaacacatagacagttttacagttttaatcagtgaatatatgcagtttgtatttatcttttttatgagtatttctttttcacatatctatacaatttcctacttattattttagtgataacctgctattagatgaaactgatgtaccatagtttccatcaccatttcccaacttttaggcactggggttgtttctagccttccacaattttaaacaatgctactataaacacctgtgtaaaattttaaaaattttccttatgctaatgaacttgtataatcatgtttatagctttgttacattttaccagattaccctctgaaaatatccaatgcagaaaaaagaaatctttttttttttttttttgagacagagtctcactctgtcgccaggctggagtgcagtggcacaatctcagctcactgcaagctccgcctcctgggttcaagcgattctcctgcctcagcctccagagaagctgggactaaaggcacgcgccatcatgcccagctaatttttgtatttttagtagagacggggtttcaacaagttggccaggatggtcttgatctgttgacgtcgtgatctgcccatctcggcctcccaaagtgctgggattacaggtgtgagccaatgcgcctggccagaaaaaataactcttatattttcacagggttttacaatttataaagcattttcacaaaaatagctttgtttaatcttgatattagcaccaggagatatatttctttctctgaaggtccattagcaccaggctttaaaggttttgctaatggagagcgaatgaacccagaaggaagaagtgacgcagaagcagtgggaatcaaagagtttgataaatatgctggtaaacctaaatgaataatgctggtttaaaaataactgatttcatttgttttgtttcttatttgaagacaatgaggaacaaaaatgctaaatagtgataatgtggaaggtggggggtgatcttctggcacattttacagtccttgtattgttcagaaggatcctaatgatattaactctggacttcaaaatagtaatgtgaaaaatttaagagtgcccagtaaaagaatagaaatagaatgtgtattttccaaatcagtagagtaaaacaaggaataaagaaagcttggatattctacaaagcaggaaaggagacaaagaaacaaagaaaaagcacaggaataagacatatgcctaaatttaccagcaatcacagtaattgaaaacagatgaaagtcatttattaaaaggcaaatactataaaattgcattagaaatcatctatcagctattttcaagagatacacaatgcaaaacaacataggaagtttggatgcaaagatacatagcaggtcctagaataactttgttataacattcacgagaaaacaataattaattcttggccaggctgtgtggagtttgcacatttcctaatgtctgtgtggggtttctctgggtactccagtttcctctcacatcccaaatatgtgcatgtgaggtgaattggcatgtctacatagtcccagtctgcgtgtgtgtgtgtgtgcgtgcatgcatgtgtgtgtgttctgtgatggaatggcatcctgttcagggttggtgcccacctcgcaccctgagctgatgggaaaagctccagccacctgcaaacttgaactggaatagttgggcaaatacttattttacttgcttttatgaatctttcttaaatgtatctattgctcacatttgtttcaatgtttaatattgaatagaagtgttttcatctttatttataagtttgatgatatttttatgaccaaaaatatgttctacgaacttgtctcttgtttatatcaactaggctatgataaaattggtttcacttcccttaaattgcaatttctaagaacgaatccatactagtcaaaagaaagctcatgtaccaatattaatatcagaaaaaagggagaattatgttagaaagtattgtaagaataaagaggttctcaggctgggcgcagcggctcaagcctgtaatcccagcactttgggagggtggttcatgaggtcaagagatcgagaccatcctggccaacatagtgaaaccccgtctctactaaaaatacaaaaattagctgggcttggtggtgcacgcctgtagtcccagctactcaggaggctgaggcaggagaatcgcttgaacccgggaggcagaggttgcagtgagccgagattgcgccactgcactccagcctggcaacagagcgagactctgtctcaaaaacaaaaacaacaacaacaacaacaaaaaacaaagaataaagaagttctctattaggtataaaacagtatctcatagtagttttattttttatttcattaattttagcaccagtgaaactaaatattttttggaagtagtagtttactaagaagtggagacttcactgatttgcctttttattttagggattaatcattttgattacaaatcttttccaccccaatcctagagcttttatcttagttttatagtttccattgttacaaagttgaaatttttttgtaatggaacctggttaccttggcatgtccatttttttccttcaactcactattttttttctgaagtattttaaattacagacaacatgacacactatcactaatacttccatatgcatctcaaaaaagatcattttcttacatagcaaaatattatcacaccaaatacaatgaaattaacaagaattattattatttttgagatagagtcctgctctgtcacccaggctggagtgcagtggcgtgatcttggctcactgcaacctctacctcccgggttcagcgattttcctgcctcagcctcctgagtagctaggactacaggtgcatgccaccaggcccggctaattttttgcatttttagtagagacggggtttcaccgtgttagccaggatggtctcaatctcctggcctcatgatccgcctgcctcagagaatttttttattatctaatttccagtctacattgaaatttccctacttatctcccaaatttccttcacacatctatggcaaaaccagtttccaaactaggaccatgcattccattggggtggtatgtatctcaaatctcttaatttgcaacaaaatgttttttaataagtcttttaaaatctacaatagtctttgctttaatgataatgatctcctgagagcctgtgccagtgtcttgtaacagtttctagcttctggatttgccttttccaaccctgtgttgctgttagcttaatccttgtaattcctgtgaactgaaagttacatctaaaggtatgattagattcaagttcaacttttttccgtttttaagaaagcaaaactgcataagagataatgttgggtacttcatgctaagaccagagacaagcaatatcttatctcagtgattgctaatttcttatgctactttgggtcataaaattcccctttaaaagtagaggtaattacatttcttgcttcttcttttattgcttcccgaaatatctttctgaaattttatccaccagaacttacagtggtaagtaaagtaaagtgtagatttgcttttttcttcctactgatatccaagtctccacagtattcatttaaatggtcttggtggtggccgggcacgctggctcacgcctgtaatcccagcactttgggagcccgaggcgggcggatcgcgaggtcaggggatagagaccatcctggctaacacggtgaaaccccgtctctactaaaaatacaaaaattagccgggcgcggtggcgggcgcctgtagtcccagctacagtcctcagaggctgaggcagtagaatggcgtgaacccgggaggcggagcttccagtgagctgagatcgcgccactgcactccaacctgggcaacagagagagactccgtcttaaaaaaaaaaaaaaaaaaaaaaaaaggtcttggtggtttacacaaatgtttatatttgccaaaacacatggaattgtaccctggaaaagggtgaattttactgtatgttaattatgcttcaataaatctgacttaaaaaatggtcttggccaggcgcagtggctcacacctgtaatcccagcactttgggaggccgaggcgggtggatcacaaggttaggagttcgagaccagcttgaccaacatggtgaaaccccgtctctactaaaaatacaaaaaattagccaggtgtggtgccacgtgcctgtaatcccagctactcaggaggctgaggcagaagaatcacttgaacgcgggaggtggaggttgcagtgagccaagatcgcaccattgcactccagtctgggtgacagagtgagactccatctcaaaaaaaaaaaaaaaaaaaaagtctccacttgaatagtcaattattcaaagatacacaaatggccaataaacacatgaaatgatgctactaataattattgaaatgcaaatcaaaattacaatgaggtatcacttcacactcatcaggatggctaccataaaaaaacataaaataacaagtgttggcaagcatatgtagaaattgaaacccttatgcactattggtgggaatgtcaaatggtacaaccactgtggaaaacagtatggcagttcctcaaataattaaaaattgaattactgtatgatctaataattccacttctgggtatatacccaaaagaattgaaagcagggtccagaagtgacatttgtacaccaatatatatagccacactattcacaatagctaaaacgtgaaagtaacccaaatgtccatcaatagatggataagcaaaatgtgatgtgtattgtaatgaatcttattcaaccttaaaaacgacctgaattctgatatatgctacagtggtccccaacctttttggcaccagggaccagtctcacggaagacagtttttccacagacaggagtggggtgatggttttgggatgaaactgttcgacctcacatcatcaggcattagattctcataaggaatgggcaagctagatcccttgcatggggcaacctacatctttctcatgggcagttcaaaatacggtttgtgctcctatgagaatctaatgcccccactgatctgaggcccagctcgggtggtaatgttcactcacctgctgctcacctcctactgtgccaccaggttcctaacaggccaggtatgcatactggtcagtgacccaggggttggggactgagctgcaacatggatgaaccttgaggacattataagtgaaatgagccagtcacaaaaagataaatactgtatgattccacttatatgaggtacttagtaaaaaattatagagacagtaagtagaatgttggttgtcagggtttggaggatgtggggaggaaagggttattgtttaatgggtagtttgttttgcaaagtgaaaagatttgtagaggttgaaaggtggtgacggttgtacgtgagtatacttaacaccactgaaatgtacacttggttaagatagtaaattctttttgagacggagtctcgctctgttgcccaggctggagtgcagtggtgcggtctcggctcactgcaagctccgcctcccgggttcatgccatactcctgcctcagcctcctgagtagctgggaccatcggcgcctgccaccatgcccggctaattttttgtgttttcagtagagacggggtttcaccgtgttagccaggatggtcttcatttcctgacctcgtgatccacccgtctcggcctcccaaagtgctgggattacaggcgtgagccaccgcgcctggccaagacagtaaattttatgtgtattttacaatttttaaaataaaaaaaggtctttcgtcttttcccattgttttattacatttgctttgccaagtaagacattcctatataattttaatgttttgttccattagttattttaactattttgtaataactgacactttccggttttttttaacctggtacagcaagagactatttctcactggtcttccccacttgcatcctttggcacatacatttatgtattaggttctgtaaattatttgcttgggattgtatgactggagaaacatttcctacatttttccaaggcaggcagaggcaaattataccactacagtaattccaaatttgtgtttcatttaaatgtcctccactattgtttcagtaatttttatgtatgtttctctaggcccttaaatgtgatatccctccattaagtttgtttccaagaaagcaatattctcagttacttctgagacaggtaacttctctttcccttatttttaaagatatctattgctgggagcactgatcggaatggattacctctacattcttcatatttgcagactgcttttagttttagttcccagacttttggtcttaaagacgcctttacactaaaaaattacgggggacctcaaagagcgtgtacgtgagttataattatcaacatttactcaattagaaattaaaattggtatttctaagcgcaagaatacacatgcgcacattccattaaccgccactgcaatggcgtcatcacatgttatgtgatcactggaaattactacacgaacgttagagagagaatgagaatgaaaaggaaaatagttttgacacgaactgaccccgcttcctgggtctccaatccaccccaccactacccccattccaggagtcccaggatcaagctttgggaagcgccatccgtcacaggtcttggtctccccttccaaaagtcagtgcctctccaggctgcccatccccagcaaagatccggaagtccgctgcccctggcaacagcacccagcacctagccctctgcttcgccgtaccgcacccggaagtcggagctgcgcacgcaccgcgggactctgatttcccggcgtgccccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggac

SEQ ID NO: 428 - DNA, 20001 bp, Homo sapiens
tataaaatcaatgtacaaaaatcactagtattcctatacaccaacaacagtcaagctgagagccaaatcaggaatgcaatcccatttatgattgccacaaaagaataaaatacctaggaatacagctaaccagacaggtgaaaaatctttacaatgagaattataaaacactactcaaagaaatcagagaggacacaaacaaatggaaaaacattccatgcttgtgtacaaggagaatcaatatcattaaaatggccatattgcccaaagcaatttatagattcaatgctattcctatcaaactaccagtgacattctacacagaactaaaaaaaaagaactatttaaaaattcatatgaagccaaaaaagaacccaaatagccaaggcaaccctaagcaaaaagaacaaagctggaggcatcatgctacccaacttcaaaatatacacaaggctacagtaacccaaacagcatggtattgatacaaaaacagacacattcaccaatggaacagaatagacagccccaaaatacggccgcacacctataaccatcagatcttcgacaaagctgacaaaaacaagcaatggggagaggactccctattcaataaattgtgctgggataactgtctagccatatgcagaagattgaaactggaccccttctttatttcatatacaaaaatcaactcaagatagattaaagatttaaatgtaaagcccagaactataaaaaccttggaagacaacctaagcaataccattctgggcatagaaacaggcaaagatttcatgacaaagatgccaaaatcagttgaaacaaaagcaaaaattcacaaatgggatctaattaaactaaagagcttctgaacagcaaaagaaactatcaacagagtaaacaacctacagaacaggagaaaaattttgcaagctatgtatctgacaaagatgtaatatccagcatctaaaaggaacttaaattttttttcatataaatttaacaaatttacaagaaaaaaacaatcccattaaaaagtgggcaaaggacatgaatacttttcaaaagaagacatacatggggccaacaaccatatgaaaaaaagcttatcgctaattattagagaaatacaaatcaaaatcataatgaaataccatctcataccagtcagaatggctattattaaaaagtcaaaaaataacaggtgctggcaaagttgcagagattaatgaccacttatacactgttgattagagtgtaagttagttcagcctttgtggaaagcagtgtggtggtgattcctcagagacctaaaaacagaatgacccttctacccagcaatctcattactgggtatatacctaaaggaatataaattgttctatcataaagacacatggatgcataagttctttgcagcactattcgcaatagcaaagacatggaatcaacctgaatgcctataaatggtagactggataaagaaaatgtggtacatatataccatggaatactatgcaaccataaaagaacgagatcatgttctttgcaggaacatgggtagagctggaggccattatccttagcaaactaatgcaggaacagaaaaccaaacaccgcatgctctcacccataagtgggagctaaatgatgagaacacacagacaaatagaggggaacaacacacactggggcctatcggagggtagagggtgggaggagggagaggatcagggaaaataactaatgggaataggcttaatacctgagtgatgaaataatctgtacaacaaacccccataacacaaatttacctatataacaaatctgctaatgtacccctgaacttaaaagaaaaaaaaaaaaaaagaaacacatgtggatcattcctgtggctaggtggggggaggggggatcctagggagatggatgactctagaggcagagtgaccagttaaacagctgtggtcaagatgacactgatcagtagtggccaagatgaagaggagagaatattttcagaggtgaaatcgattgcactattgaaagtaaaggagaaatgcaaatccaagttattcagaagttttagtttgtacaattagtgatgctgtccaggatgatgggattagtagtgcatgcattgacattgagtttgtagtctcttgggggaaaaattgcaaaacattctttagaaaaaaatatgggccctaatttggggatatgtatttcagagtatcacatcactttcattttcagagttaacataactctcacatgattatttggtgatgcttctttattattctttcatgaaggtttcttcccatggttcctaaaggtgctaaaaggcttagaaaaggatttgtttcaccccatagcttattctacccctcccacatgggcacacaaggtgtgagtacccaggcagggaaagtggaaagcatcacagtgatagttaacatttctgagagttcatggaccctcctgaaatcatctggcacaaatatttttgcatagggttctagaatgttcctcaaccttctgaagcatattcatgaacatatgaatatattcccaggctaggaatgccgatataaagaaaaatcccctggatggacagcccaatgtactagcttgccagtgatttgcaggcagccttaggaaggttggttcactcctctgactttccacattcttggcacagtgctaagattctgagagtctttgattaatggcattgattcacaaagcaaaccagttcatatgggcacctagaaaataattttgaataaaactgggccttgattgtgttcccagcactctaattaagtgagtccagccaggctatctcaccccatgcaaacacactttttaaactggaaactatactaaaataacaatcaaaaccttgtgctgaatccatatatctcccccttaccctcacaaaatataaagtagctggatacacagatagataatatataaatcagcatcacaccagctagctttttccacgaaaattggtttatatgaagccacagatttaaatacgtggacacatccagatgatcagttgaagagatacagtgttaatgatatatgatatatttatatctaaatacttgaactaatctttgaaacaaagcatgatgtctgtttggttctgttctagctggtaggtggaaattctttttaatttgcttgctgtcctaaacattgttttgctcatggtatcctcctcagaacattctattactcttggttgctctcaggataagatccaagccccttagtttgcagtgaaaggcagcactcttagttattcaacttcgtcatctgctcttcacctatgtgggccttctgacccactcaaccaaatggaccttgccatacacatgtgagtgttggctgtgactctgcttctgctgagcccactgcctgggacgtcctttgagccacatctcaacatcccaatccagcttcatttatctcatttcctcaaggggattttataagtttctcacctgcaatgataaaactttgtttgcctccaaggtaaatgcactaaatgtgttgcttatgaaagcatccaggaagaacctaggaagtaaggggatctgttctcatcagctcttggccaaggaaagaggtccaggcccacagatcatagcagaaaaggaaggaaagcctacaaatcagtaatgtttttttaaaattgcatatccctatcaatataaaacatttacccacaatatatgtatatttactcacttacaaattatatatgtatatactactgtaagagtacactgtgctcattgtaaaatatataaaatattaacatttaaggtggttagataaaagttcaatagaaatgttgcttattatttttcattctaattatagtattctaacaccacatggattatgttgagtgccccattttgaataccatgacccctataaccacatcaggcacctctgctatggcaataatagtaattacgacaattctggagcactttactatgctgagccaaattatagtgaataattcctttagaataattatgggctatgagtctaaaaagtattaaccagtgttgttctgttgcctgacttcaacaggacatttacattttctgtgaatagtgccccctaaacttgttcagtgcacaacctgtgcatccccgcatgagggccctataagtgttctatcagagataggctctgaagctgcagatactttccaagggacaggcttcacgtgagctgagtgtggacaggagtgttgttcttatgtcaacttttccaaccacagccaaatctagaaaccatagtcagtgttgagcagtatcttagagtggataataggtggtgccatatacacatgtacacactgaccaggagttggagccatacaccttggaatctaagactgtaagatctaggaaagattcctttcaaggatgaagaaatttgggtccagggacattttatgcaaaagtattgacaaagttgtgttagaattccctgaccactgctctttccacaatattgtattgctcatgtttgaaaaacccagtaggatatttactgaatgcttgctgcaaagcactatgcttaaaataaaacgtcatttcctgaatggttccaatttatcacaataagtaataatttaggctcctatatattgacatttaccatatgtcagatactatattaagcaacttataagcattatcttatttaatctttataataaccctatgaggaaggtatcataatgtccattttatcaatgaggaaattgaggctgagagaagctcaataatttaacagaaattaatctgctaaagtaggtttcaaatccatgcaaccagacttcaaaacctgctctaggggctgggcacagtggcttctgcttgtaatcctagcattttgggaggctgaggtgggagaatcacttgagcccaggagtttaagaacagccctggcaacggggcaagaccctgtctctacaaacaaacaaacaaacaaacaaaaaatttaattagatgggtatggtggtgcacacctgtggtcccagctattctagaggctgaggcgggagaatggcttgagcccaggagattgaggctgcaatgagctgtgtttgcaccattgccctccagcttgggcaacagagtgagaccctgtctcaagacaaaaacgaaaacaaaaacctgctctaagacatattccgcttccataataaatgacataaattatgtataggacaaatggtgtttatttgtaccattttcttttgcaataaccattatcagaatactttcttcctttgcattaaacaaaatactagaatgcttttttctctctccatctctctcaccacccatcccctctctttaacatacatacatacagacacattagcgaatatcagctttctcattcgcacattttctgagaaggggtccatagctcactataatctctagagtcaaccatggctctttatttttcttttcacccacatcaaattcttcagcaaaatgcttgggctttcccttcaaaacaatcccaatgctccactgctgtcacagtaacgcaccctcatctcttgcctgaagtttgtcagttgcctctaaactgtttttccctgttactgtgtctacccgtcccagctacagcctgttataaaaaggtggccatactgttccttccaaaatcgcccaatgcctcccgctgtcactcagagtgagtgaggttcccctagtggcccctaaggactgctgtgatcatggtctgtgcctctgcacctctccagcctcatctcctaccaccttgcctccctggctcacccactgcagccacactactgcctcgcgcctacttaccgtcactctccatccgccaaatatggccatgtccgaattcccagaagctgcagattactttatgtgacaaacggacttgcaaatgtgattcaactaagaattttaaaatgaggagattatcccggattatccttgtgggtccaatctaatcgcaaagttccttacaagagaaatgcaaggagagtcggaagaaggcaatgggatgatggaaacagggcgagaagaggtgatgtgatgtgggccatgcgcgaggaatgagatctgcttctagaagatggaaaagagaaagaaacaaattctccccagagcctccagaaggaaaacagctctgctgacaccttgagtttagccccataagactcatttcagacttctgacccccagaactgtaagagaatatttgtattcttttaatccactaagttttaggtaatttgttagagcagaaataagaaattaatacacccatatcctgttttatagcattttcaccattagccctattttatatttatttgtttatttgtttatcagttgtctctcccactacaatgcaaagtgcctgggagacatggctgggcgcggtggctcatgcctgtaatcccagaactttgggaggccgaggtgggtggatcactgaagtcaagaaatcgagaccatcctgaacaacatagtgaaaacccgtctctactaaaaatacaaaaattacctgggcatggtggcgcatgcctgtaatctaagctactcgggaggcagaggttgcagtgagctgccctccagcctgggtggcagagtgaaactccgtcccaaaaaaaaaaaagtgcatgggagacgagactttttttttcttcattggtgtaaacccagcacctgacataagatctgttgaatgaataaatgaatgacatatgttacttaattaaataattggtcaacactctgaaatgattaagcctcaataaaatgttggttaaacatatacttacaaacctgcatgacattctcaccaacatgtctagaacaggtgaaaacatacacaaatgaatacaagtatcaatgcagcccagtggtccacactaaaacagcccaggagaagaacatccagaactgaaaagccgtaagccctactaggaagacagtgagccacagagctccctccagtgtgggggaccaacatcccttccacagagcagggaagaggaaaaggcctgagaggtcacactcacaccctacagtttcactcaagcagagaaggccctgttttactcgattttatatattctacttccattcaacattgggtaaggaacttcagtgaagatagggccgagtgtggagctaggaagcagggattataactgccgctctttttattactgaatatccttaaaaaggagtttatgcatagaagctgaggtcagtgggacactctatggcctttcagttcacacaattatgctaaaaagaatgtaaacttaaagagttaaatctaatatttgctttaggaaattttaagtaatttaggaattacatgttatagtcaatcaattttccctgttgctggtactgccaggaagtaccaacacttctttttcctactacttctgtttttgctcaataccagccataggctaatttctagtgagataaacacttagccaaatttagaaataatgtcagatgggtccatgatgatgatcatggtgatgacccactttgcctgtcacaggttgcatggatgcttctgccatgagaaaaaaaaaatacatctagtcctcactttaaaaaagtctgtggccaggagctgtggctcacgtctgtaatcccagcactctgggaggttgaggcgggtggatcacttgaggttaggagtttgagaccagcctggccaacatggcaaaaccccatctctactaaaaattcaaaaattagccagaccaggtggcacatgcctgtaatcccagctactcgggaggctgaagcaggagaatcatttgaatctgggaggtgaaagttgcagtgagctgagatcatgccattgcactccagcctgggtgacacagtgagactctgtctcaaaaaagaaaaaaaaaaaagtttgtttgcacagtgtgacagtgatgatgtggatatggaggtcagaaaactgcgtgaatgcacctgttctaacatcacctcctccgtggagctgctccaaactcagtacacatctcagcactccttctctgaacacccacacactccacccactcctctgtttcatctcttactatattgtattagaatacattgagtgcaagtctgtctctgtcaccatattattcattacttaagagcaagggccttgtcttgcacagccctttccccccaaatgctcagcagagtacaaggcaatgtgtgtctggtatgtatgtgtgaaccaagcactatactagattatttttaaaaggaccttgtagtagaataagtgatccatgatttacacacaaaacaattagagaaaagaacaaattacaagacaacaaagggcaaaattagtaaagtgtgtttcatcagaaatgttactgggaactggggaagagagaaatgagtatgaactatggtttctgtaggtttataatcatttttattggcaggaaagagcagcatttacaaatatatttatataataaatgtgaaaacatttctaaaaatcacataaatatgaatattgtgggggagatgttggggaaaaagggcctgccatcttgattaataaagatgatttgtttaggtctgaaacactttacattttgataatatttataaccataactttattactttatcatctaatacaaagatcaccaaggttctgtttagatatcgtaagcattaaacattaacactggtagtgtcttactactactgaaatcatttgacttcatcaaatttttagttatattggtgccaaaggggcaagctagtgacagagatagcctttattgaccacctatctgacaaatctgtgaccttagaagcacaagaaggtctttctttcacaagctttggtttcacttttaaacatgttgacaaaggaaatttaaccagacagaaaaatgtacttaatgtcagccacaatggcaaggatttgggcagcagttatggctcacttatgtgaaccgttttgaaaaatactttgcccatggtatgtaaaagtcagtgattaaatacgtgctttaaatgcaccttccaattcctctaattttgtgaagagctgagtacactctaatgactgatttagtccctccgactcctgaatatgtattgagatccaaggaccatggcattatgaatctttccctggtcattcagagcaaaataaaacaccagccataatatctgcatgaacagggtatgcctgtcagaggcagaccttaccttcacaaagaggtaaatctcagggttcatgtgagctccctccttttcttccaaaccttcagcatcagaatagcaggaatacttggtggtagagaaggccttactgtgctgaatggtgaagcttgaaggagaaggcagatcttccttcatcacactcccattctcctggagttctgctgcgcagagttgctggtcctgggttgatgaatataacccttccattgagatgcccctgtcctcctggggctcacctggatgagcctcctggagttcagagtatatctcatcaggcaggaggtagcctctgtcttctgactggacagaggccaagctggtctcttcacccttaatggtatagactgacacaaaatcatactcatgggtattcagctgagtggcatataaatcattttctggccttaagtactcatggacatcatcataatggggactttcattttcttctggctggtctggaacctcatacgtcctctcattttggattgtgtcatagatggtgctgtagtcttcgtcattcatgcttattgatccgagagatctgtttacagggagacctgagtagatctgaaatgaatgaagggacagaggatgctgcaccaccttgcagaggaatcaacgagctcttaaaaggcagcaactagcaactgctatcaatgacaggtctctaacaattatttactggagagttttataagcaaaccacaagtccattggacagaagataaagcttacacactcagttaactccttcactcctaaagatatttttattagaccctggggatttcctcattggcagtaactccaagattctttgggtaagccagagattgaattgaattatcttcctggtatacactgaaattttgaatatgtagccatttttcatcaatagagctccctcctccaactgcctccaaatgttgacaacattcaagaacccctgcaattcagtggagagctacaattcttcacaatggcctctcatctatttactgctgaatttatcacatagaacaattatttgcctattgataccctgtgataaatgaattacatgccctggttaggtaatgaattccatttacatttcttatctggaaacaccactaggtgattaaacagcagaaggaaaagaagataaatgctctggcctatagacacatcagtatagaccacccaaattagggactcaaagacttatggctttaatttttatttttcccccttaaatctgcatgatcatcaccatcaacaaacattcactaaaatcctatcatatacagaatgctgaattgagcacaacaaaagcgttagaagacacattctctgtcttcaaaggggcttttaaatgtagctggagggcccagaagagaaaaataaaaccgaggaaaaactatttaaagttttcttagtgcaataagcccaggtctggataagcaataaaaaattgtatgcacaaggctgttcagtcaatgccatccacagatgctgtgaatatgtgtgccccccaaattctttttaatctggtactctatcctgctaattcctgcttccctttgccacaccacatacatctttctccttgaagtgacaacccagctaggttgtaaagggactttaatgtctagaaatcatgtgaaaactgtgaagcaatgcaactcctgttgacaagcttcagaacatttgatgggcatcttggcaaaacttcgttgtactcttagacttcaatattgtatccaggaatcttctactgggaattagagcagcatttctagaattctagcttaaagaatgggtaaggaaaaagaggtcagagacttcaaaggctattgacactggacatttatcttattgaaaagtgacattcaatgggtccaaataccttacacattttgataggttctataatcaggtgtttttaattgaatggattccagttcaaatcttcctcctagttttacagctggtgaaaacctaagagatcattcaaacattttattttacatttgaaaaaaatttaaacctagaaagtggaagtgaatggtccaagtttacacaaaaacttaatggcggagctgactttagctgtggtttttgaacctccagctcagtaatatttctgctactaaatctcttccttaactcagtattttccaatctttttttcatgatcacacactgtcccttccctgctcccaaaggagccttttcagatatttctctatgaaataaaaatgctgcagatatactacatatctgtttgcatattgtatatacatatgcattttgtacattaaaagagtaacttttttttctttttgcttcccaagaaccaattttcaccccttggggggtgacactactcctttccacaatgcaactcatgcttttactactaatgcagtgtgtagctcataatctaacactggattctgtttcattctgcattattacaaagaatagtatacagcatgtgcatatggatacagcatgttgtcaagtcctcaccacaatgacccagtgaggcagggctgaggttggctaagcttagggcccaagatcaaacagatatttcaaattaggtccctctcttatcccattttagaacacatctatcatgatctacagttacaggttgtaatatgaaacaagtccttccgttaaaatgtaagtcaggtcatattgctctgtgctcaaacccctacaatggctccccatttatcttagtgaaagccaaagtccttacaacggcccacatggccctgcataatccacaaccactctcctatacctgttttttcaccccttgccgacccagctccagacaattgagccttgtttctatacctggaacactcctggatattcccatattagaccttttacattggctattctctctaagagaacacacattccctggatatttgcatagtcaattcccccaactcctataaatttttgctttaatgtccccttctcaatgagactacactgactgtcctgtttaaaatgacaacccatcccaaatcctatcttaatccctgttccattactaaaaacccttaccctactttcccccccttttccataatatttatcaccctctaataagatatatacataacttattttttatgtctagaggttttattttctgtcttatcctactagaatgtaaaccctatatggcggcgaatctctgtctactttttcatcattatctcaagtacctagaacagtgtctggtacatattatatatatgttgaatgaatacgtatttgttgaatgaatttttaagattgctgacatatttatccttcattgggtacttacgtttcacgagaacaaggcccatgcctattttttcacgttgctatatagctaaagtctagcagatatctgatatgtaatagctgcctattaaatatttgttggataaataaattaaaggaagaagatgtatctagcattcatgtccttttactcctggctcagttttctgagccattaattttttgaagggttttttctgtctctatttccttcagttctgctctgattttagttatttcttgccttctgctaacttttgaatgtgtttgctcttgcttttctagttcttttaattgtgatgttagggtgccaattttggatctttcctgctttctcttgtgggcatttagtggtataaatttccctctacacactgctttgaatgtgtcccagagattctggtatgttgtgtctttgttcttgttggtttcaaagaacatctttatttctgccttcatttcattatgtacccagtagtcattcaggagcaggttgttcagtttccatgtagttgagcagttttgagtgagtttcttaatcctgagttctattttgattgcactgtggtctgagagacagtttgttataatttctgttcttttacttttgccgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtctaagtctctttgtaggtcactcagggcttgctttatgaatctgggtgctcctgtattgggtgcatatatatttaggttagttagctcttgttgttgaattgatccgtttgccattatgtaatggccttctttgtctcttttgatctttgttggtttaaagtctgttttatcagagactaggattgcaacccctgcctttttttgttttccatttgcttggtagatcttcctccatccttttattttgagcctatgtatgtctctgcatgtgagatgggtttcctgaatacagcaccctgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcatcagtggtctacattttggcatgattttgcagtggctggtagcagttgttcctttccatgtttagtgcttccttcaggagctcttttaaggcaggcctggtggtgacaaaatctctcagcatttgcttgtctgtaaagtattttatttctccttcacttgtgaagcttagtttggctggatatgaaattctgggttgaaaattctttcctttaagaatgttgaatattggcccccactctcttctggcttgtagagtttctgccgagagatccgctgttagtctgatgggcttccctttgtgggtaacccgacctttctctctagctgcccttaacattttttccttcatttcaactttggtgaatctgacaattatgtgtcttggagatgcttttctcgaggagaatctttgtgacgttctctgtatttcctgaatctgaatgttggcttgccttgctagattggggaagttctcctggataatatcctgcagagtgttttccaacttggttccattctccccgtcactttcaggtacaccaatcagatgcagatttggtcttttcacatagtccaatatttcttggaggctttgttcgtttctttttattcttttttctctaaacttcccttctcacttcatttcattcatttcatcttccatcactgatatcctttcttccagttgatcgcattggctcctgaggcttctgcattcttcacgtagttctggagccttggctttcagctccatcagctcctttaagcacttctctgtattggttattctagttatacattcttctaaatttttttcaaagtttttaacttctttgcctttggtttgaatttcctcctatagctcggagtagtttgatcgtctgaagccttcttctctcaactcgtcaaagtcattctccgtccagcttttttccattgctgctgaggaactgcgttcctttggaggaggagaggcgctctgctttttagagtttccagtttttctgctccgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactccagaccctgtttgcctgggtatcagcagtggtggctgcagaacagcagattttcgtgaaccacaaatgctgctgtctgatcgttcctctggaagttttgtctcagaggagtacctggccatgtgaggtgtcagtctgcccctactggggggtgcctcccagttaggctgcccacttgaggaggcagtctgcccgttctcagatctccagctgcgtgctgggagaaccactgctctcttcaaagggacatttaagtctgcagaggttactgcagtctttttgtttgtctgtgccctgcccccagaggtggagcctacagaggcaggcaggactccttgagctgtggtgggctccacccagttcaagtttcccggctgctttgtttacctaagcaagcctgggcaatggcgggtgcccctcccccagcctcgctgctgccttccagtttgatctcagactgctgtgctagcaatcagtgagactccgtgggcgtaggaccctccgagccatgtgtgggatataacctcctggtgcgccgttttttaagcccgttggaaaagcgcagtattagggtgggagtgacccgattttccaggtgccatctgttacccctttctttgactaggaaagggaactccctgaccctttgcgcttcctgagtgaggcaatgcctcgccctgcttcggctcgtgcacggtgcactgcacccagtgtcctgtgcccactgtctggcactccctagtgagatgaacccggtacctcagatggaaatgcagaaatcacccgtcttctgcgtcactcacgctgggagctgtagaccggagctgttgctattcggccatcttggctgcccttcgtgaatgtcttaagtgatagataagtggacaattagagtggaagagggaagttaagttgtgaagtatgatgcagagttgagaattcttaatgatggagagtaatcctgattggatggagtgtgtggattgtgggaaaagtagagaagaggacagtactgggctagactgtggatggccttgaatgctaagatcagaaatctgaattttatgctcataggatgatactgaaaatgagcagccacataacacagatagcagttcaatccacaaccatttaaattccagctggattccagacaaagacagatgctcacagaaaaccatttctagtagctggtattgcttattggagcaacttggtccactggcacatcgtagcatgatatcccccattttgatatgggcacagggagggaactgtgtgtaagccacctgataatgtcagatggtttggcagagtcatttcagtcactgtgcacatgccactctcccatctacctctcctggcattctctcttccttagagttccatcaaatgccattcacagccagtcattgagtggccttggttttcataaccctcatctcacaaccttctgaattttattcttcacaatgctgtctctgccatcctagctcaccatacacatctcttcataaatgcttacttgcatatgatccccaaatttcaccatactttcttgcttctcaaattgaacatggtcatccatattttgcctcatgattacattggttggcccacctcagtgctgtctattttagattatacaatctggaagaggtcctagaggagcttgggtaaaattcatctatgttgttttattacttagaggagatgaggaaggaaaacacaaaaggggacattaaatattgcaaaactgagacagatggaatcttcttcactgaaaccatcttgtttgataggtttatttaaataaacttaataaagaaattgagcacccaaacaccaccattacaccaaaacaatatgataggatgaactaaataccctcaagctttgaggcagggcttcccctgcttcatcctctccctgcccctactgctctgccctggcactgtcatcttacttaggttgggacccaaccccagcacctgactctcagaaatgaccttcacctggcccaagtccttccttattcacggtgggtctagtttcttcccttctcatcccctctctgcggactccatcatgaccaaatcctccttgtctgaccactttagtagctctctaacacttctctagaacctccagtatagaagagaaacatctcaaagcagatgaacctgctgatacctgatatccaaatactgaggagcccagatagccaacttcaaagagggaaagagagagtgggcatcctctgagtcagggtgttgcagataaagacaatgctacattttgatgagtttcgaaggaactggtgttaatgctaagtgtactaaataactaatgaagaataaacgagctgcatatttgtcatcactatcattctgcctaaaggaaatgtgctttctgctatggccaatttgagtccattgagctttctcaccccaggttctttttaattatgtttctctacctttgacagttttattttgtgatttgaagggttttgggattttatcatttagggattttcttctccaaagacatctgggaagtttggtcttatattataaaaccaaagcaaactctatcagcgtactctctcgctctctttctgtgtgtgtgtgtgtgtgtgtgtgtgtgtgtgtgacactgtataatatatacttctcaatatagtatatattataaaaattgttactctgaaccatccaggaaagataaagaaagtacttaaggctttggaaataccacttgactcctataatttcactggtatggggacacatgccccaaattatctgtcccttcatacttcagttttatagtactccacaagaaacacacatttagcttgaaatatatacacagctgtcattttgaatttcttggattcctgtgtagtgtcaaagatgtatgtattttatatcaagaagatttctttctgattatgaagatagtttatgtttactatagaaaaagataagaaaaataatctgcatttccactacccaaagataattatgttaacattctctaactccttttctacccataagtatctatatttttaaaattgaaatcatgtacatttttattcttttttaaaaagaaagaagacattatataatgtgtatacattaaatttaagcatttatacaagaccagcaaatattttcaaatggtaaatactcaaatactagctaatctcatttgttgatttagaagattcaaagatatctttctttatttttgagccaaatgactttttaaaaggcagaggattttgcttgaacaagtgatcgtcccaacaaatcaggtaataaataagaacatcttctctcattcttgtccctatgcacttcccaggctgtgatatggtgactttacaaagcacaaagggtaattaatgcttgcagcagggaagggctcacttaatgttttgcatggtgccttaagattttgtctaattttcctttaaatttacctattaatagatactgtactcaattgatctatgcatatttaaattctattttggtgttggtttacatttgggtaaggagtgggtagaagtaggggacaaagaaggcaaattacagaattgtggcactagaaaaagcaaccatcaaggttttagtgaagtatttattgtttaacagaagtcatgaagatgaagggagaatgaactgcatattgttttagcaaaatgcaacatggagtaagaaaaactttggtgccaaacagatctcagtgtaaatgctgcctctactgcttgcttatgcaggtgaccttgggcacaatcatctaaattttcccagtcttcattttcttatttgtaaaaatgaaggtaacatgcttcaggaggttaaggaacattctagaaccctatgcaataatgtttgtggccagacgatttcaggagggtccatgaactctcagaaatgttaactatcactgtgattcattccactttccctgcctggatactcacacctcgcatgcccatgtgggaggggtagaatttgctatcgggtgacacaaatccttttctttattgtgggtagaaagattaaatgacatacaatatgtaaaatcttgaagcctggcagattacacaggtgtgttcagtgactgtttcctccccttctcccacaactaagccacatcaactttcttatgagttcacaatgaagattctggaggggaaaaaataatgtacgggtaacatgagtaatttcaacatgtgagcatattaatggaacttagttctgctttgtattccatttattattatacattttgggacatattttcttttaacgacgctgatagttactctaaatcttgatgattacattttgcagtaattgccaccttcaaaagacattaacagacagtatttttcgtgatttgcacaggaatgcagtaagccaggctgctttctgctgtttgtaataagattagggtgcatgtcccccaacagctgacactaaacttctagcactaaaatttgcttccattacttaaaaacgacaacaaaaaacgaaatatatgctctataaaaaagtaggtctgtagagttagaaaaataccagatgtctataattgaagctgatggcagataatacaataaaaatgaacacgttttatatcaaaggtaaaaacttgaaatatccaagaagggatcaggtgtgaaatcaccttcaggatttgaaaactctgaatgtttttctgcatgtataatccaccaggtggcactgttgcctgctttcggctccgaccccaacgcctcctccagagctgagtttgtttaggtctaggtcagagctagttc

SEQ ID NO: 429 - DNA, 20001 bp, Homo sapiens
ggttagcagtttatgaggtaactcctggcccatatacatgagactgttcacttctacaagctctgctctttctatgttctaagacaatgagatgagcaattcagctgttgtctcaaagcctctgaaatggatcagagaaagaattcttagttaaccttagatagctctcttatgtatagtcaacagtttcttttcatggggacaggtgaaattatgagaagcttcctattagcacacatgcatgcatacacacacacaaccctctccagctcccaaattatctgtccctttcccttggtattaaaatttcttgaaaaagtagtctaaattcattgtctaattatgtcacctctcacctctcaactgactcctttctggcttcttaaattaaaacctctctatctaatcaccatcgacttccatatcactaaatccaaagggcagttttcaatcctcatctcacacaatccatcagaaacatttgaaattggagtcaactttttatcagaaacatcctctttacttgaaacaccttcataccatcaaaaccaagcattaagaggttaggggcccatattcctttggtttttctcttccctctctggcccctccttctcagccaccttgaaagaacattcatccttacccatctagacattaaatgttcaagttccatgagcctctgttctatgctcccttctttcactatataatttttccttattcagtatcattcatagccatggcttgatttctgacttatgaataatacaaccaaatgttgcaaatttatttctcaagcagaaacctctcatctgagctgctggctcatatattgtgattgcttggcatatctacttagacatctcaaaagttcctcaaactcagattgaatttatgatcctccctccaagcttcctacagtgttccctgtctcagtgaattacaccggcgctcatccatttaattacttaagtcagaaaccaagtagcaatcttggatactttccatagtctaatatctagtgtataatcaagtcctgtccactattacttctttataataaaatgtctaaaattcatcaatttatcttcatttaatgccctaattcaagattctttcatctctcatctgtactattccaatagttactttaaatttatgcttcagcttcttaacttcttgcaccttcagcctgttgtgtttttggagcaaacttttcagaagcaaatctgttcccatcacctcattgtttaaaattttccagtggctttgtaatgctcttaagataaaaactaaagtctataatatggcctctgaggtcctacatgactttatccatgcctctctctccagcttcatctcttaccatctcaaccttatgttttgcattccacctgcactggtttaattcatattcttagcatatcaggccctttctgtggcagtttttgtctcaaaagctcttcctctctttaaccctactaaaattctactcttcctgtagattgcagttcatagcattttcacaggagagccttccccgatgcaggttcttttggtaaaagctctcacattacaaatgtttcttccctttagaactcctgtttctattgaaaagcatacattcattgggtgattattcagctattgtcagtctccccaagcactgtgtttctgctcatcattattctccagaatttagaagaattcctggcaccttgaatgtgttcaataaatgcttgctgaatgtgtgaatgaatgaagaggagtcccattcagatgcctggttcctctggcatttacagtatgtattagataggtggcagtagaataatagatgccactccttcagcatctctagaggtgaactaattctactctgtcattgtccacttttgatttttcaaagttccaaagtagtaatggaacacatatagcagcaaacccatagctacacaatttaaagccaatgtgattcttgcagcaagagcattttccaaacaaaatcaagagcaaaaagaaaaaagtaatagaaaaaaaatctttcagccgtattgggatcaataagtcagttggttttagtcttctgggagttgatgacctgaaaattcaacttcatttgggagaagtgcccaccaataagttaagtgtgaccctattcatttcatatgcatgaagacaagcttccttgtgcttttggcatctttgatcaaaaagaggactttgagacaacctctcttcctacaaaatggtgatatcctccacattcaagtcccaaggcactctatttcctctgagtactaatttacatatttaaagccgctcaatttttattttcctttagtgttccaaaaaaatcaatgttgactcaagtagagtttctgtttagtgaccacaagtaccaattcctgtgaccatggtataccaggtaccaggtctctgggcattgtcaaagaaaggtctggcttctccacatacactgatatttcctctgtgttcttcatcctctgcagggtcttacacttcttttctctgtgctttagttggctgcttccacagccttatgctctggaatacctttgccccaagaatcctagtctctaagaaatgttccatagggtgcctcagtttttgcatatcagattctcacacttcctgaattggcttctcacaatttttgcctatcagattctcatacttcctgaatttggcttcctgaattgttcctagagatagcactattagtaattctgaacactgtgtccttaggtatccattgcggggtaatatgccctttgccatgttgtttttttccaaaattttgcttttcatccccttttaagttgttgggaaacttgttctctttcattgtcagcagaaacatcttgctttctttgctttgcagggttctatttccctccattcaggtgggccctgcagaggcttaagaaatttaaaccatttcttaagacagttctgtttcttcactaccacatatagggcaaaaggtatttatgtatcaggataccttccttttctttaggttccagccactggttttctcatatgcttctccagatttggtctgatgagatctgtggtgagaaataggaagttaaaaaggttgtctcaaatgcttcttttaaaatataaactagtctttatgtcatgaataaccttaccccagttcgagaatacacaatggagtggggcattgagtaccccaggagcctatggataacaggttgtgggataagagtcaccaaattccacctttatatgaaatacttgatagtgaccactcaaagttcccaaatctcaaacatgggtggcctgaacttcttgtggaattaagcatcccctagccccttcaagcattcaaattttcctaatctagtggcagcttgtaatatcagttgtgatgacaatacgaaccccttcagcccacaggagtcaaagccagcagttgaagccactgtataaagcttggtactgagtctgtggtgctacaggtgtttatattaaatgaaagagctttgatctctctattggatattctggccccaaaatgctagtgcctgcacctatacccaatgaactccctggcaagtcagtgggttgagatagaaggtgcaactaaccttctcatcctttctaggattttgacagatggaggatatacacagaaatcacaggaaaaaaggaaatgagtgcagatcttatcagtttttgtgtgactccagttactaccaaaaagactagaaaactgttttagccaagacatcaatcagatactcagattagctgccccttctccttggaaatgaggaaataaacaaacaccaaccaaataagaagagtttgccattgcaagggagtcagccaccaccacttcaacttttgcagagattcaaaggcatgcagaggagtgggaaagccttatagtggaaaaaggggaatatttaggtatgccttgtttggaggctgttggtatggggaagctgtaggcatggacagctagaaataaggcatcctctgtgatgggtgggggtgcatatttagctttcattaaagttttaaaattggaatcaggcacaaaatgagggaatatgtcaattattaatcaaatcatggccattttgggccaattattatagaggttattatttggcttcctgaagtgttcctagagatagcagtctgactccttcaagtctgactggtttcttggtttgtcattatagagaaaggggttggtttcctggacaggttgctgcaagttgtgaatcagagttctatttttacatatagactgggcattgctggtttgtatattcagactcccagaagtagggaaaggccaggaagaagggggtaaatgccctttctctactgctatctcatactcccagagaaggtgcaggttttaagggcagaagcataaatgtcaggaaacggtcataggtagccctcctttgcccatcacttgaaaattattaaaaattctcattgaggacttgtcccctaagtaatcaagaaaaataacatacaaaaatgaagaaccataaactgaattcaaattaaagtgtgcccatagcacagagatttctatgcaaaataactttccctataaacatactaatgacatgttattttgtatcaaccagtatcaccatgtatcaacctgtatccccatgtatcaacctggtgattggatggaaggtgcagtacgtacacaggtgtgcttgacaaagagtgggaaggagagaccaaaatctagagagagcctgagagatctgacttgctccatcagagctgtgcatgcttcagaaagatttgggaagtgctcctgttaattttgcctttgaaatagactactttggttgagatgcaaatataagggctgttccagtgatacagaagtgaaactccttagccttgctagttgatttgtgtttctgatcattctgttgatgggctggctttagcagagtgtgccctggttgatatttatcgtgattgattttacagtctgaccttggtctcagcagacacatggcagtgaaaatgaaaggtatttaggagaccagccaaaatatctacattgaggttatgaaaaatggaaccctaaatgcctgatatccactctaatttgcctggtttacctggtgttaattgcttcctggccttacttctcagaatggacctttacatttcatatccttttcacttggaagtctattgttttaattctttccacagtatggaagtggatgcattttcattttctttttttggcttcactaaagacagttcaattaacctctgaacagtaggtttgacaatcctgactttgcatctaacattttcttgaatttctgcttctactgggctcttggtggtaagatcaggaaattatcatgaacaatttatttgtttcctaaatcaaatcaagcaatgacagcatgagcaaaagtgtttgtttttgtctttaaactattttttaaaggaactgattgttaaagaaaatatttcctttcttcttttgttaaggtacctattatcttttttggtatagatttagcttgcatacattttccatttgtcttgtttctctatagaaaactcctctgtagattgaaaataaaaaaagtaagtaaacaaattagtccaaggcccttggaccacccttttatatagatggtttgttcccccagagcattttgaaactgcactgctgcccttccctgtatttaatgagacctatgggcaaacacatgattcagtggaaactaagaggcagagtttaaatatgctctgatgacagctggcttacttgtgtgagctgttgcaaaagaactttactaatggttcaagcagatggacagaaggaagaaagctgaatgttagaatgtgtgagagaccaaaggtcaaggtgaatgaggctggtgatttcctgaggtctgtgggtgttttgtgttgcagtctaaattgagggttgtttttaatttgatgcatttttctaaactttaaagagcttcattaaatctcctcccatcccaaatgtctcagctcttcaattagttctcaattaaattttagcttttaccttttaagataatatggtatttacttgtaaagtatagacatttataatgtttttaagggtcagtttaaagtggtctatttaatgaatattttttacaaaacatgatcccatgaggttttttaccaacaatgtacatatactatatcctcttgcccttttttaacttcaaaataatttttctgctggtgcacggtgattataaaacactttaaatatattgcataaagaataactgccattcgattctttctggaaaaccctactttccagatacttgctgcgatttaggttaaaaatccaatatcatttttgtatttcttctgattttgtaactcttatatctttcatctttaatcaagttctactgaagccaagacattaactaacttttagtttgacaatcaagccctttaaaagaggtcataaatttaaaaggaagattgtttttgttccagaagagagattattttgaaagctaaaatatatgtaccacttatggaaagaaacaaagtaaatctttgttgcataaggtacattctttatttctctggttcaaggaatggagcaggctgctggaggaagtggagaaaggtgctcctctagctgcctgggtaccatgcctttcttcccataggggatggcattgcattggcagttgccttggggtcaagtatttatttatttaaagatataattttaattatatgaaaccccaaatttaagagtgtgtaaaatattaacacagcaattagatgtattgtttatcaccttgatttccaagccctgtcagactgaaatccatttgggagtcataaaaaatcaccaggactggccatttaaaaaaattacctcaaatcacaattagcagctctttatttgcagttttcatacatatatggaggtgctgtttgtgttgccatttcagaaataattcactatgaccaactacactgaaaaataagtgcacaagtagaggttgaggtcatttaaaatcaaacacattcaaaatttgaagataagtagtgtacttgccatacgtggttaatttttctcatactttggtttctggtgatcttctgagtgaggactttgaagtttataatttattattaaagaaattctttaggtgatgggaagggtctcgaaagaaatctataaaagcaaaatataacacctgtggaaaggaagggaggaagggagagagggagcaagggagagaggaagggagggagggagagagagagaaataaataaagaatactaatagatatgtagatatttatttctcttcatgttttcagcaaaagacattggaaaaattttaaattgtatttaattatattaaaaatgatattcataaagagaaaaatatcagttccactgacttaataaatttctctgcacacctttaacctaaccaaccattttatgaacaaaaagtcattggagacttgattggggagctaagaaattaaagaaagaaaaaaatgtcaataaacccgacttgattatgtaaacttgacttatttttgaatataattaaaatatatattttaaatattaatacaaaatacatgttttaaactactgtgtagtcactgtcagtgatataacaatttttagtttttgctttttagcactttttaaacacatgtgcccagaaaatttcccttttaattgatgtgccactgagaagacagcctggtgtagagaaaggagcagcggacttggcaacaaacagatatggctccacccacagctctacatccaactgcttttgtgagcttgagtaaatttgttaacccctctgagttatttcataaaatggggatgaaacctaccttgcagggttgctgtgagttttaagtgggtcaagctctgctcagcaaatattagttcccttcctctttagttcacttgaagaaacatttattcagatgctgtgttaggctaaatgccttacgtgtaatagtctggttaatcttcaaaacaaaacagcaagtcatgaggttggttctccagtcattgttgttctgcactgaggaaactgaagcatagaaacagctaatagtgagtgccttaaacctgggtctgcttgattctaaaacctgtatccttaactgttgaatatgctggggaaagagatggtcatatgagcacagagaaaaaaaaaagattagtagtgatatagggatcaaggggtaagagaccaaaaggattgaacatttttgtaactctaatatctgtaaaatgaacctgaactttgtttagatatgacaaagagaataaaaaaccatattttaaatgcttggccataatacatggatacaaaacagaaaaagtcatgcaaaaaacagagcggataggtcccaaatggacagaatgtctgttggtgaatcctgtataaggaggttattgtgatgttggcatgttggcattattaagcatttttctctagtacatactgtatttgtcaggctaggctaggttatggtgtggtgcaataacaaacagtgcctaaacttcagtggcttgatacagcaagattttatttttcatctgtgcaaagtctactgtaagtctgattgccttccaggacaactgacctccatgaggtcacccaggaatctagctatttccatctcagggctctatggcttcaacatgaaatctgcgctatgattgctgccatagggggagagaatgctaaagaactttcctggaaaagtaaatttttttactcctaacccatcaaccagacctaagtacatactctgcctaactgcaaggggaagaggactgtgtattgtgtcacaaatctgcaccatgtatacttaagactgttggtaggctgtttattttcagactgtagcttttatgactatttaactgagataatttctacaaactaaaactccccccaatagaaaagtgtcacttttatctcagccatttctgattaagacatattaaaatacttaagatgatttaagtgggagttgttatctggaagtgattttgaaaactaaatagtcgttgctcttcaatcagcggggattatgtaatgtttgctctgccctgtttcaagcagtagaatatgatcttacagttacaaatctgtataacaaagaaaaaaaaaacaacaaaaacaaaagaactgctctttcattctgccatagtttgtggtgggacttggtttatattagagactgttcatttattcttaggccattgagcagcagaatgagtggtgaggcagggtgagggttatgacagcttcagggcatgcatgttctgagggttcttccatagtgagactggaaagagcaagtggtcaaagctctggtttctacctttcccctatttgaacaataatgacaatttacctgtggcttatgtggtagcataagcaaataattccagccaaagtaaacagcatttcagtaattcagaaagcaaaaccatctcatgatcatgagaaaagataaaaatatagatgcacattggtgaggatttttaaaataattgctatccatggtgttccttcggagattattccgttacttcttgagaaagcagaatttacttcttgtttatgaacatggtgaaaatacagggacagtagagggtaggagaaactttctagtggcttaaatcaattgttttccttggctttgaatttttatttttaacaggtaaagtgttgcatttattaaaagcagtaaagtggaccacaaaaaaaggttatttcaaaaactgtcagccaagcacatttattgagcactcaatagctatgatccaaaaatgtaaaagtaaataaacataataaaacaaatcaattaactgaaccaagcaaaccacactggaagcttttatcttgttctttccctcgttggcatcaaagtctggccactctttggagatttacacctgcggtggtttcattgccaaaatgccttcttcctaacacttatctctatgagagggtccagtaaaaaaacagttttatcatcataaaatttgggagccataatttcctgattcagttgcttggggtagggctctgaaatttatattttaaaaagttcttcaagtgattcacatacgtacctgtttccaaaacttgaatttagagtgctccacagtggtgggatttgggatccaagagagacataattctggcaacactttatggcaactgttttacacaaagactacttttaagcagcgccactgatatagtttgactatttgtctctgcccaaatctcatgttgaattataattcccagtgttgaaagtggggcctggtgggaagtgtttacattattggagtgatccctcatgaatggcttgggtcatcaccttggcgataagtgagctctccatctgagtttacacaagatctagtcatctaaaagtgtgtgacaccttcccttaccaccgcccccctctttcttgcttgctcctgctttctccatttgacgtgcctgctcccccttcaccttctgttatgattgtaagcttcctgaggcctccctagaagccaagcaaatgccaacaccatgcttcctgtaaagcctacagagccatgagccaattagacctcttttctttgtaaattacccagtctcaggtatttctttgtagcagtgcaaaaacagcctaatagacctacagctgggcaggttacactttatctagtgcttctgattctcacctgcctcacaggatgtttgggttaaagctctggccagcatggattggtgtgcatccttggatgtttcatttcatagctctatggtctttggcaagtttttaattctgagctctggttgcagttgccttgtctaataaaggagctaattttatctgcttggtagtattagaatatttgtaaaaaagcacttcatttgatgtctggaatatggtagatgttctgtttccatctcactcagagtaaaactcaaaaggccctcataacctgtgtccccactttcattacccctgacctcttctattagtttccctgttgcttgcttcaccttggcctcacttctgttcctgaaaccctccctggacaccttggcccagcccctgcacctgcacatgcttctacctggaatatgctgctctcagctacctgcaggtttcctcactcccttcctggcctgaaacaaatccactcttctcagtgaggctctctctctcaccttcctggtttaagttgaagcttctgctttcactctctattcccctttcctgcacttattaccatatactatactatatattttattaatttaccttgtttattctatcaccagaatgtaagctccagctgggcggagttatttgtttgtttttgtaattacttcttaactttctaacagcaataacaatgcctggcagacagtagctgtttgtttagtaaatgtttactaaaagaatgattgtgagtggtggtaggtcagtctggataggggagcatcatcattaggtcagagaaattctgggccaggaagttttggtttcagattgtcctggatgtcaaattttagtattatttggggtgaacaaaatcaccacattgttcctgtgaacatctcagccacctaaaatatatttagaagggtaatgactccgagttgttctagatcccacttccttccatgtctctccatctggaatcacctctcaaggccaagatgatacttggtctgcatttagggaaaggacaactgggcaaagtttgaaactgccagctcagagatatcttaggacatctgtttgatgacacctgatgatcaatgaatgatatttgattaataatcttgattcacacttctcaccaataaaatttctgttgtttttcctgagattcaccctggtgaacttttcaagcttccttggacccgtgaagagaaaaaattctcatgtctcctctcatgccttctctgtgctgctggaaaaggctcagcttccttagcctttattgtgtccagagaaaggatctccctcccttcctctatggatagggataatcagattgggagctaccactatcttctcattttcccactaaaaatagtttttcccccaaaatgtagttaaaagaaacctggaaattatcatttatgacagaaatgtcagtttgttgaaaaaatgtcggttttaccagatgcttctggtcttggctgcctcatccagttgctctctcaacagctgcaagccctttgtcggaccccacacctcctcccacgtgctgtctctatcagttggagccgaattggtgcccgctgcaggcactaaacttcaggcaaataaaatagcaggggtgaatcatgaacaagaccagtaaaaataaccttcctctgtgcctctaaattacctattaaaattacactcctgactgctcttagaaagctgagtcaatgatttggaggataatttttcagttggggaatccaaggatattgctgaaaaaggaaaagaactcatatttatgaaaggtgtattgctacagattttgccacgcaaaattagattatattttaccgaattctcacacacactgtgacgatgatacccttgtcttacagatgaagaaactaaggctcagataaatcaactaagttacccaaagtcacatgtctaataagtggaagattttaggttggattgattaggaagtctgttcctttgctggcatatcgtgctgttctgcacttgcctggcacaaatcctgagggacataacaagtactcttgcccttgccctgatcccccattcttttgagtatttcaaatcatcctaaatttgtaatatctcaataaatgctgccatggaaagttgccatgatggaattttgtgtacctacaagagactctgacatttgcagacactgtatgttgagaatgttcgaatcctcaaattcagagggcattgtggtataaacttctccacaattgcctcaaagctgtactgcaatgggctggctaggtggtgagtaaggctcagtcactggttatgcgataggcttctgcaagctagccaaaaagattaaaatccaagccttagaataattgcaaattattacattgtgaagattgagagttgatagtgaataaaatgttaaatctaacagtctatggcactacatcaaaacttgactaggacttctctttaaaaccagtcttagagttaatataggattacggttaaaagcaaggactttggagactgacttcccaggcttaaatccttggttttgccactcactagctgtattttccctcctctttgcctcagtttttttaacttcaaaatagtgatgatgcaacctgcatcatcgtgttgtattagcattgcatgaaattgtggttgtcaaatgctcagaacagtggcacttagtaggattttgtgttagctatttttattatgtataacaatgcaaattttattaacaaagttcatttgtttatggttccattgaattttgcccaacattctacccttcaatttacttactctggtcaccagaattggggctgtacaacttcattcatttaaaaatttcagatttatcctcaaaagaagaggttttcttttacatttatttatttaaaaatttctatttttattttagatataaggggtacatgtgcaggtttgttaacatgggaatactgtacaataccatggtttagggtatggatcccatcacctatgtagtgaacatagtacccaataggtagtttttcaaaccatgctcccctccctccttccccgtttgattagtctgcagtgtctattgttcctatgtttatgtccatgtgtgcccaatgtttggctcccacttataaagacagttctgtcacccaggctggaatgcagtggcataatgatagctcactgcctgaattccagggctcaagggatcctcccaactcaacctcccaagtagctagctgtgagtcattgcgtccggccaagaaaaggtgtttccatctccaaagaaagaccttgcttcagtttctgacagcaacaattagatgagtgtagtgtcttcaacatcattgtttttaaagggacaacattcaatttgcatgtataaattcttcaatgttgattaaaaattaattctattactttatagttatacctcatagaggatgatctctttagcttatttcctaagatttccaactccatttgtgatttcatgaacatattgagatctgtccaatataccgtacattgctcgaattaaacacaaactccaaagcatctcatctgtaattgctatcaaagaatcaaggagttgaatctagtcttacacttgataccagctgatggagatcaataatttttgacgaattacccttttctaagtggcttagactcaacaggatttaaagttctgagaaactattttaactttcttcaaccttagtttactttagcaaagaagtaaaataattaggcagagacaagatggtaacttttttttaatatggaagtatgtctcggttttatgttttcatagcaattttattaataactaaagtttcataaaatgttatgaaaaagtttgcaactctatagaatatttaataatagttctttcctcatatagacaaatggttgggttataatgtcagatatttttgcagttaaaagttattcactggcatgactgattttgcttattccacagagctctttcctctgaaaaaggaaagctagagaaatgttgatatgacaaattgctgctaagttttgggtcattggttatgctactaaaaactgcaaagaacttcgcttttgccatcttctggttttctgttttgattcccttctctatatcttggcaactcctctttagttccttttattataaccctcctttctctctcttcttgtctttaatgagatctactggtctcttccatttcctagtaggtaggagatttagtgctcctgatgttctccccagcacctaaaacagtgacccccaaaactcatggatgtgcaaataattatttcttaaattatttctcaatatattgttcatagccaatataagttaagggcgttagcttgtaaggatgatagtgggaaagtggggatagttcacaaactgttgttaggattgttttcttttgaactgtgaactattagagataaaatacctaataaggaggaatgaattctgttagtagaccctaagacctagtggtggactagtgaggagaaaccatggaggtccagatggagaagtccttttctgaattccatacgtatgtgatgtaacacacacacacacaaacacacacacacacaaacacacatgcacacatgcacacacacacatgcacacacacatgcacacacacgcacacacacacggagagagagagacagagtgagagtgagagagagagagagaaagaggatgtataatcgcatcctttgctaacaaataaaacgattttcattgcttggattttaagaaagcttatgtacttctgagagccagattttgtttgcttgaacaaatcagtgagtccaaaaattggcttcctacgtagtttagataataaaaaaatattgaaataacattatttttgtgtggaagctacagaatttgagactccatgaagagaactagtataggctttctatttgttttattttgttttcagacaactaaaactatgaaaaatattaattctatagattttttcttaatgtcattttacatgaggaatatgactgtacctttcagatattgtagaaaggcaatgcaaatgttttctaacactgggataaaatctggttgttaaataaagtgtacatcttttagcctgaacggtaagaaagatcagttccagaagaaataaaaacttattttgcaatggtattttagcctttaagtacacagaaggttttccaaaaatggaagagaatgattccattctgcttccctttaaataatgaaactacaaaatagtgtccacatcatggtgtataatatccttccattagagccttattttcttgtcaatatttttacttcaagcctaatcttttgatgtgatggagacttcaaattaaatcacagacagtggttttcattttcttcctttaacatgacattatttccagctctaaagtgattgcgaagaaaatacttaactccctaaattggctgtttaaagcgccacagtagatttgactctcaaatcgcatccgtggttaaagttcaccttgcaacgcatttgaaataggtgctttgtgttgaaaaacaaaacctgtaaaacttttggggtttcaagttttctgactccaagttagtcattttcctttaatactagaagaattaaagatattaaaaatcagctgttagtgcatgtaattgtggcctctcatttttcctttttctggaaatgaaaggaatgctgaaagtgttcctgttttataatgtaggaggtggccaagcatttacaactctatatactcctccagtcgaattcttctaaacctcagacctggccagcaggtttctcccagacgattttcattttcataacattcacatccaataagctgcacaaaacatagtgtgagagaaaaagggggacaggaaatggctctgttgcatggttattacatcctattgcctgtgggttgcttgttatgagttttaactatgtaaatatgacgtatatgacatcagaatttaatcttaaagcttctatgtgggagatagagtgtgactttattgttagggttaaaatcaactgggtgttgacaggtctcaaaagtcactgagtaaaagcttaaaaagaaaaagctcagactgataagctgttctttgattgacaacttcaggcctgactgccactattgaaaacagttgggtgaaagtttggttggggggaaaaagtgttatttcataagaaactatactgggaaatatagggtgatttataagctgatatagcacaaaacccaaagaaaaacaggtgtaaggtttagaaaatctggaaactgggaggaagacactgtctatgaatgatttaattaatattgtaaaaggactttaccaaaaagaatgctgactcaaccagaaaaatacatttctgtccactagctttgggtttcagcaaatcatttgtcaacagcttgtggtgaaacaatctagtagggggtgggaggaaagaataaaatgcacaagcaaaatattccaatggaaaatacatgtagttctttttttcatctttctagtagagtagaaccaattggcactgtaaaattcattatggaaacaataaaataaatgcattctaaagtagccatcattggttgattgaaatgttatgattgttatacatgccatatcttatcaaatattatccataaggaagtattcagttcctgttgtgccaattatcctactatgtgcatcataaacttttatggcttgttatggaatgtcacttggctaactatttttcccttcaaatattgcatcatcagattcagatggaaaacatattctaatgtgacaaagtgttaaagaaatttaatactctagggctaaatgaaactgctatggttcatctcctggataagaacaacaatttatgaatgcagtattcatttcctgaggtgaacacaagcaaaaaccttgtctgaaacttaaaacctagatgtttggcctctggtagtttcctcatttaactcattgatgtcgtatattaaggccattggtaagattacatctggggagtgctcactttttcagcttccctaattacttttacaggggactcctggcataattgcatcagccaggaccaggccacagagtttatgagatcaatctttcacttttaatatattgctaaaatgtcaaaataattgatttgttttctcttgattgtgaaaactgatgaagagtttggcattttaattcacagaggcatccattcagatctaggttctagaatagtgcatacattctatggagaaatcatgaaattataaacttaacatgttatgtctttaagaccagagaacccagagaagattccacagtcatttgtatttgtagaaaaagacaaataacaattgccaagaatcgtcatttttctccttccaaaaactaaacatctgcattataaattttagtatattaaacataataaagtaaacttacaggaaaatttatttgagtcttacctgttattatcagggagaagtagaggacacatctagacagcaatattttgagctttaaatgcaaacttctttcattgacaagaaaccacttttatttaaatattctagaattcacagaaattctaggtgacagggtaaaatgttcagataaatatatgagaagttgattatttgtccatctgagatttctacagaatcaggagcaaattttgctcaaagtactattttgcatcattgtcggccatcgcgggcacctataactggggaaaaatgagacaacaacagagagaaacacattgcaagttttcatacaaaaagcctctttgcctttcataaactcacctcttctgaccactaaactaaaccacgtacagagttgaaagatgctttgacactgttaagatccagcatttagagacttcagcttttgtggaaaaagtgctcattgtaagataatcaactgatttgagaggcataagaacagtaataataataataataataataagaaaccattttaggtgatgactggaggaaaaaaaaacccagcaaggtgtggggcaggctctatgcataaaattagaactcaaacctgtcatatgctttcagtaagtgagggccatgtggaggcaacttggagggagaagaataaaacacaaagagaaaagaagaaagaagcctagacccttctggaagcagctgcatctaccattcttggcatgcagtgttctttagttattctgtcttctgacactgcaatgctctgcttgaaattccttgcaattcctcacaggtctttttgaattcacctttaaaaaattctcaattttttttcattggtcggaccctcaaaggagaaaaacgcaactttctctatcagacagtcatggcatattgttttggcttagctagaatttgctagaatgaacccattattacgcttcctctgagtgctgacaatgtcatcatctctgcattctgcaagtaaatttgaactgtgagtcaagaatgcctattccagggagatgctaggcatacataactgccttctcacctgctatcctctacctcagagaagagaggtagagcaggcagaaaggagggtatggataaagaattgggtccttactaatgactcacatattgcaacaggtattacattcttgaattatctcactccatccacatcacaattctacactgtaggtaggcagatatgcttacctttttttaacagacaaagaaacagattgaagagctcacatagcttataagagctcagtttgactccaagtttgtgcttctttcactactttctgccataaactcctttactatatttcttttcaaatattttaaagacattgtctttgaaatgctgaatggacaatgaatgaaggtatgtttttaagtgttttgtgaattttaattttttatgcccaagtagacttattttattttatctttttttttttaattatactttaagttttagggtacatgtgcacaatgtgcaggttagttacatatgtatacatgtgacatgctggtgcgctgcacccactaactcgtcatctagcattacgtatatctcctaatgctatccctcccccctccccccaccccacaacagtccccaga

SEQ ID NO: 430 - DNA, 42512 bp, Homo sapiens
tagagaacaggagcctagataaaggagtaaagagacagggcagaaaatgaggacggaaaggtccttcccttagcttacatttgcaagagtttggatttcatcttgtggggaaatttgagggattttgagcaggaagtaaccagggcagatttgcattttagaaagattgccccagtttctaagtggaggctaaaagcagaagacctcacctttgacaagatcataaagtaaaggcatagaaatgaaaacgagggctaagtaggagaattatttacagcaatgctgtccaatagaacttcctgcagtgctggtaatgtcctgtgtctgcactctctaatagggtagccactagccatatgaaactattgagcatttgaggtgtgtctagtacaatgaaggaatttaatttctaattttattttattttaattaagttaaataaccatgggagttcattagacagtgtagctttagaaggtgtgtgtgtgtgcatttttaaaattttaaaaatatcttcactgaggtagagttggcataaattgcccacacttaaaacacatattttgatgttttgatgtatgtatataccatgaagtgatgaccacagtcaagatagtgagtatatccatcactccaaaaggtgtatataaaattaatgcacctgaaaagcagatactggataaatatggaaggactctgaattttatcagctatttctttgtctgctttaaggataaaaatgcagcaataaaactccataaaaccttatgccatttttgtttattttttgcaatttcaacactatataaagaaccacacagctaaagcaaaagttttagaatgggaatgggaagtaagaaattcagaaaatgattcagggcacagaaaagaataaagcagtttctgtactatggttcttcttttgcctcaagggaagcgctgtcaactcttcctggagcattttttgcataaaatttgggttacttccaataaattaccattaggttccactgtccttgaaaatttcaccctgagattaaaaattttctgcacgtactgcttttttgtgttttgttttcagtttacacattttaccacttaaaattggtgtgtcagcagatttctgtctgaaacacatatgtgctaacacgggtaagttaactattttcaatatttctgagaaatagacaacaatttggcagaaatttaatggagaagaattttctctctcgcacactgcccctcccccgccccccaacacacaactttttttttaagaaacagggtctcctttagtggcccaagctggagggcagtggcaccatcacatctcactgcagccttgaactcctgggacccagcaatcctcccacctcagcctctgaagtagctgggactacaggcgcatgccaccacatctggctaatttgtttttattttttgcagaaatggggtcttcatatgttgcccaggccggtcttgaaattctgggctcaagtgttcctcccacctcagccttccagagcactgcaattacaggtgggcaccaccatgcctggtctattttcacctctcttttctttcttttttttttttttaagatggagtcttgctcttgtcacccagactggagtgcagtgccacgatctcagatcactgcaacctccacctccagggttcaagcaattctcctgtctcagcctcccaagcagctgggattacaggcatgcgctgtaatccacccggctaactttgtatttcagtaaagacggggttttaccatgtgggccagactggtctcgaactcctgacctcaagtgattcacccgccttggccttccaaagtgctgggattacaggcctgagccactgtgcccggccccattttcacctttctaaatgaagaatttaaaaacaaatttaaacacatgtagactttaagccgagcttctcttttcatctgaggctgtgaggctccctggacctgggtgcagtttcctgggcacaggctccacatggcatctgccacaagctgggtgtgctcctgggcattctgccctctcccgaagagtttttagagcaaattcttataattctaggaaaaattactcatgttgacaaaggaaatctctgtacctcttcacttagtgataaagctgagaaaattccttttattcaaaaacatatttgtgatacatccaagcactctacttaacacgggtcattttccctcatctcataaactctgccctgtgtaaaacaacagcactccatccatccatccatccatccatccatccatccacccatccgtccgtccatccatccaatccattcatctatccatccatccatccaaccatccatccatccatccatttattgcattcactaaagtattctatgtgccaggcacttttctcagaactggagatacaacagtgaacaataagaacaaaagtcctactctcatcctacacacagccttgctagcggacatgggtaagacagaacattaaaacaacaatagtaaatatatagcaggtcatataaagataagtgctacagcgaaaataaaatcaaataagggtgataagaattgccagaggaatgagagaagttattttatcaagaaagtcactgataaggtgacatttgattatatttttgcagctaatggaatcagccatgtgaatatttaaggaaaacgccctgaggcaagatttttttggaggggtggggtgtatttgggaccggctggggctgagcaagctggaagtcagggatgggagcagggagtcagaccataaaaggcatgggaagtattattacaaggactttggtttttaccctaacagacatcaaaagttattggaaggtttcaaatagagttgtgatgttatccagcatatgttatttgttgtttttttagagacttggtttctctctgtcgcccaggctggcatgcagtggtgtgatcatagctcactgcagcctccaactcctcagcttaagccatcctctcaccttggtttctgaaagtgttgggattacaggtgtgagccaccacacccagctaacatatgttttttaatggatcagcctgagactactgtggtaggaattgacatgatgctgtaggcagaataatgtctatgtcttcatccctggcacctctgaatgtgttatatctcatggcaaaggagagttaagattgcagatggaattaaggttgctaatcagatttggagagatagggagattatcctgtattatcctgctgggcccagtgtaaccaccagcactcttataaatgaaagagggagacagaagagaaaagaaaaattaggaaaatataaataatccattaacacaagaaacacgaccacaagaaagaagtgttgagtgaatgtctgaatgaacaaagatttaattacttaattctgggacagtttttattattcttatgtgtccagggaagaaggaaactgtttaatcataaaattgctcagattttgctgtaaagtaagtttcagttctctatatcttcatacagttgcactttgtaaaatgatacagctttatctgaaaaaaaaaaataagttgccctaatataatacagaaatcttttccagatcaaatcttactttcacactcacggagtaaaaatttttcactgagttgaaacacattaaaacatgctcattattttacatgcctaggaaaatttcgaattcttcatattacttttcccaggcatccagatgggttctaagaaaagttctagtgagattatatttcgtctgtatggttaaaagaaggagtattggcagtctcctaatttagtggtggtttttagcccaaattccagattaaggaggtttaagtttctgcaattacagcttttaaaaacacagcaatgaatcttcacaggtttaccttcattacaaattgtatcactaagaagatgagagaaaataatatcttttgaaattttgtagatccattctctggatgttatggagatctctcatcttaactctaacacctttaaggtatccaaggagaaaatcaggtgcatggatggcaggtcaacttcgggtatgcctctcttactaatcactattttcatggggccatagaacttcctgtggttaatggttgacaccttctggtggcctgcaggacaggtggcaaactcagacacattgggactcaaagggggtcttgagaggtcgttgaaatctatttctctgccttcaggcagaaccactggggaaatatgagataccatcatagttttaaaagactgtcaagaaagtaaattccaggacataagaacaataactccaggaaaaaaaaaaacaaaccctcagtgtctagtaaccctcagtgtcaacccttattttcattgtggagctattttaaattaataagcctggaaaatagatacatggcacaactgatctctggatgtcaacacatcagttaattgcatatgactccctagaaagtatatgtaactcacaacttgcaccttacaaaagaagagttcaaagtccctatcattactaaagggattctaagccagagtcacttccattcttttcagaataaaatagtgatttcaggaaggtgaaaccacctgtcacatttctatttaccagaaccagtcaagatttgggctttttaaactgctttgccatttcgtttcttctcctcattgaaatttacttttcataggaaacatgaatgtgaacatgtactttaaggacttaaaaggaaatacaccctttaaatgttaacgatgtctataattatttagcacctgcttaaataaagacaggaattgctccagagtgttacttattttcattgatcataggatcctagagaaggcagaattttgttggggggaaaaataacaccccaagagaatgacaaggggaaactactgaaaagctatgatagttacaaatcaaaatgttcccaggcaactgccatatctctggttttccttgatcacatcaaatctcaattcatatagcaaattacatcacgctgtggagtttgatgctctaacatctgtaccgtagagccaggtggtgtttatgattagaaatactttctcacacaacttttactttctgaagctattataataatagcctcatgtgtttgcttgcttgcttaattttttaatttcgctattactaatccttacccaaacttttcatcagaagcatgaagtccctctcaataggatcaaacacatcaggccatctatccatctcatcattttacttgaaaggttctctctgggggccttccttccttttgctccatgtgaccaggctgcttggcctgctccacgggtgacaccctgaaacttgctgtctccatccacctggaaactcccttttcttctctcccaagtttgagccgttgttttggggactccatgtcttcctctttcttggtttattctttatttacataagaaaagcctcagagctgggggtggtggttcacagctataatcccaacagcttggaaggccagaggcaggaggaacacttgatgccgggagtttgaaacccacctaggcaacaaaatgagatcctatctctacaaaaatcttaaaaattagccacgttggtggcacacacctgtagtcccagctacctgggagactgagctgggaggatcacttgagcccaggagctggtggtttcggtgagctatgatgacaccactgcacaccaacctaggcaacagcacaaagccctgtctcaataaaagaaagaaagagaaaagagaaggaaagaaggaagggaagaaggaaggaaggaaggaaggaaggaaggaaggaagggagggagggagggagggagggagggagggagggagggagggagggaggggcctccaaagatttcccaagagagaatacatgggaagttgggtttttttggtttctttacttgttacatgtctggatgggtctttattctgtcttcatggttcatgaataaggacacaattctaggttagaaataatttccactgatatttaaaactgtgcttcactgtttttgagcttcttgagttgatgctgagaagcctaatacttattataatccccatttctttatttgccattctctttctgtctgtctctctctctctctctcaaaactttttggcctgtctctttattcccagtgttattaaatttcacaatgtgccctggtgtgagtcttttaaattcaatgtactgagttttgttaggcgtttacaatctgaaaatgtatgtctgccagttctcagaagtttccttacattatttctataatatttttccgacttcctctgctctctctctcttactctttctctcattctctctctctctctctctctctctctgcatcctctccccttgctctctggaaagccattagacattaaaattcctatgctaattgatatgatttggttctgtccccacccaaatatcatcttgaattgcagctctccaatccccacatgttgtggaagggacccggtgagaggtcatcgaatcacaggggcaggcttttcccatgctgttcttaggatagtgaataagtctcatgagaactgatggttttataaaagggcagtttccctgcacacactctcttgtctgctgccatgtaagatgtgactttgctcctcattcaccttctgccataattgtgatgccttcccagccatgtggaactgtgagtccattaagctgctttcctttgtaaattatccagtctcaggtatgtctttattagcagtgtgagaacagactaatacactcatcttttaaagtttcagtactgcactcactcttcctctgctgtgcctgagggctaaatggccctggttctttatctccaagaataaattcttgtctctgactgaggtcatggaagttctctgtagagtgagtttaactcctacttaaaagaacttctaaccagacatacaacttgccaataaacatgaaaaaatgctgaacatcactaagcatcagagaaatgcaaattaaaaccacagtgagataccacctcacaccagtcagaatgcctagtattataatgtcaaaaaaacaatagatgttggcaaggatgcagagaaaagggaactcttacacactgttggtgggaatgtaaattcgttcaacccctatggaaaacagtacagagatttctcaaagaactaaaaatagaactacctttcaacccagcaatcccactactgggtatctacccaaaggaaaaggaatcattatatcaaaaagacacctgtactcctatgtttattgtaacactattcacaagagcaaagtcacaaaatcacataagtgtccatcagcagttgattgggtaaaggaaatgcagcatttatacatcatggaatactatgcaaccatagaaaaagaataaataatgtccttttcagcaactcagatggagctggaggccattatcataagtgaaataactcagtaacagataatcaaataccacatgttctcacttataagtagaagctaaacaatggcacacatagacataaagatggaaaaaatagacactggaggctccaaaagaggggaggataagagggttgaaaaattacctattggttgcttgaaattgcttatagggggagggtgtgcaacacagaaatcaacaaacactacaaatcaaagattttcttgttttgctagagagtttcttaaccagcacaccactgcgggaagtccttacttctgagccttcccaaagctctgtagcacacatcaactgtttctttcatattctctttctgcagattgttcgatttcagttgtccatattctgctgtcagtcaccaattaatctcctttcttgatcctagaaagacttgttgacatctatcaccaattgtcatctcctctcccaccaatcagcctatattactgatatggtttagctctgtgtcccaacccaaatctcaccatgaattgcaataatccccacgtcaagggcaggacaaagtggagataattgagccatggggtggtttctcccatgctgttctcgtgatagtgagttctcatgagatctgatggttttataggtggcttcccccttcactcagctctcattcttcttcccactgccatgtgaagaaggacatgtttgcttccccttctaccatgattgtaagtttcctgaggcctccccagccacgctaaactgtgagtcacttaaaccccttgcctttataaattacccagtctcaagtgtgtctttattagcagcatgagaacagattaatacaattacttttatatagaaaagaaaatggttatatttcaatttcaacaattctttgaaaataaaataacatgagaatgatttatcatataatttacatgacataaatatacatgcgatagtgttaatatacacaactacacttaaatcttggctttgccatttactagctgtgtgaattagagaaagatacttaacttttctggtgttcaatttttttcatttgataaatagcaagaacactacctatcttgcatggatacagtttgaaatggaaatgtgtataaaatgaaaataatatacatcatgtgtattaatggctcataccagatagtcagtatacagttgatattattaacataaacatcagttataatttaaaattattttgtataaatatatcctctaaaaattttttaaactatcatgcctcaagtcaaatgatgcaaaaggaggttaacgaactattaaaacatcgttttgctgctatttcctggagaaaatatgacttaattagtcagactgaaatggattattttaaagtgtaagtaatttgcaggtattaatagctagcattgcccctagtatggtccagatggtcttatcaggtcttattgggtttcttgtgcattaaaaaacagagtttaatgaggcaatcgtaccctaaagcaggtttgcaataaattcaacaaatatactggcacctctccaagtgtgtaataaacaacctcctctgctccttgcggcaaaagaaaatactcttgactccagagcatcacttgccttcagtgaacagggctgttgtaaaaatgctttagagagcaaatgcctttaaagaactcaaagacttggacattatcatttccatttggtgacagaaggtccaaagaagcatctttcctcacctatacgtatcactgagttgtgagaggaaatgaagaacagacatcggtggggagacagaaggaaatgttagcaagtggaggggttttatgaagtcaggaggtaaagagagaaagagagagagaggaaaaaggaggaggacaaggaggagaaaaaatgaagaagaagaaagaagggagagagggagggtggatagagaaatgccctctcttggttctcaatgtctcatccacctccctcatccaaaccacagactaaagcaggcaaggaagtggctccaccttctccattccttcagaggtctgaaatatatcaattatgtccagcagggtgattattttttaaacctaacataagtaagcctttctgttctactagactgtgctccttaagggtgtagaacatggctcattcttctttgcatcaacaatatttaacacttctcagatacatactaggcatcaataaaaaaattttctcattaaaacattttagggcttatatgctctattttttttccctgaggtccactgcttatactgaacatgaaaaatttagcctacatgttaataaaatcttatatttggtcctggatcataaaaaaaataagttaaaagcccattttctataagaaatttgggtcttctgctgatggacagagacgttcttcactgagacacactttgtgaattcgggagtggtaatctctaccctcagagggcagtgggggtcagtcattgaactcttattctaaaaaataaaaacattaaataaagttaaaattaaggatgctttatggaatttcagggtttcgatgatgtgtaaagctaatggcaacagagcaaaatttactcctttaaggagaggagagcctgaacatattttttaaataagtaaatatcaagttagaaaggtttggaaaatagttgttaaaattataacaaagctctctacttttcttttatctttttctgtttttggatattggtcgactaaattaattatgtaacaaaaattcaagtagggatttaatttgcctctgctggtaactccagatctctagggtctcatttgcaggagtgctcctgaggcactaggagtggatgctaaagaagactttttcagaccagaaggggagaaaagggctgcccagcatccatgggtaagataaggttgtcccaggtggggaagattttgaaaacatcctaaggtgtttttaccttaacatcttttgataagagaatcaagagcatttgattctcttttgataagaaaatcaaaagatgtaagctattggggatattcaagtggggtcagggagagtcacatgcctttccttcatcttctagtacagtcttgggtaaggtgctctgaggtcttcaaggcagtgttgtcatattgaaggagcagactgcatgttagacactgaaaaagacctctgattactctgaggatgacactgtcacccactcagggtcgagctgagaaaaccttgtccatgagttgtgatgtaactatgcttcatcttcagaagccgtcgtggtggctacagccaaacagcaagcccagaggagcaacaggtagggacaaagacacaaacagaggtagctataaaagcaacatccactgaatgaggccaacaaacaccaaggcagcaggaaaatgattaccaagaagaatgaggtgccatttcatcagaaggaaggagaaaggattggggtgtcagcaccctagtaactgtactgggtgggtattaagatgcaaaggccagagcatgatcaatagtctcattagctgtttacaatgctaaagtcaccaggagaaataaaagttgaatgtctatttatttaatggcatttgttaagctcctcatcaaatgatgtgcccagtattgtgctagattctgaatatgaaacggtgagaggaaaaaaatgtgcttcctgtcctccttgagctaacagtgttgggtctaaatattgcttataaacagtactgttggttttgtggtagtggagaacccaaacacttctgtagttttaagacttgtccaattatgtaatgggccacagatcacacacaagagaatactcagagacctgtatggcagatttcacatccaacctaaagattcactggcttaactttgagtacagtcacttgaattacttactgttacttgaattagttacttgaatagctactaaataggaactggtttaaatagtcatgaccttgtgtaaactgaaaacagaaattcattaatactcccaatctaattgcatttggaaaatacttgcagaatcatggagttggaaagtcattatctactcaaagagacaatccagtctcctgcttctctgtttatttattcattcatgttgcaaatcctgagtgagtgcctactgcataccggcaatgtaagtacaaatccctcgctctaatgatacttaaattctagtgttaaagacagacataagaaaacaagaaaaagtgaataaataattttccagtcgcgttaagtgcaatgaagaaaaaaaaataagaaagcagggtagtggttagggaaaggaaggaagggaaagaaggaaaaaaatgcgggatggaggaagagaaagatggggcgggcactctcttacccagagagggtcaggaaggccttctcttcgagcagatacctgtgcataatgagggtctgagccacgcaaagatcagggagaagagctttccaggcagagagaacaggagtgcaggcctgaagctagaccagggcagccaaggcagagtgaggagaaaattgtgggaaatgttgcagtcaggggctagatctgcacagaccaccctcagacatttgcatttctctctgtgtgtgtgtgtgtgtgtgtgtgtgtgtgtgtgtgtgttctttttaaatgatgagaagctgttggagtgacaggacttcttttcagctgccaagctttttgtgtttgcacttttccttaacgcttcttccagattaggttctccttaaattctgtttgcggctggaagtgatcctagacacctctggctcagcttcccaactcatgcaggtaagaatctcgttcagaagtggtcattagaccttccaatgagagcacaaaaaattggaacttccaatgggagcacaaatgtttataatgatggtgcgtctaggatgagaatgagagagcccattctatgcgcgtcactgtgagcatggaaaatcaggggtgactgccagagagtagttttcatgtatatccatattagcaggacttcctccatgaccctccatctcaatgaagagagaacttattttcatgtccacattgtggatatactagttctttctcatcctacacgtagacatgtagctgggagtgttgcaacaggccaggtcaatggaatggaataacaatagtgtcttagtcagctcaggctgctataataaagtgccataggctgggtggactatgaacaacagaaacatttcttacagttctggaggctggaagtccaagatcaagctgctagcatggtcaggttctggtgagggtcctcttctgagtggcagactattgacttcttgctgtgtcttcacatggtggaaagaaagctagctagctctctggccttttcttataagggcactaatcccattcatgagggctccaccctcatgacctaatcaccttccaatggctcgatcttcaaatactatcacattgggattagggtttcaacataaaattttgaggagacacaaacgttcagtccattgcaaacagctgctatcataaagttcctatcaagtgccagttgctgtgtacttaaatacgtcatctctaattttcaaaaccatctcctaaaataccatctttttttttttataggagaggaacctgaagcttagatagattatggaactcgctcgagatcatacaagaagtggcaatgctgggatttgagcccacgattgacaaagcttttattctttgcattctaccatgctgcctccaaataggtcaaatgactagaaaaagagatttaggttcataattgtcactatgcatttttcctactatgggaacaattatgaacaattccatatgtgtccaattttataacaataaagcgcaaaagaacatctgtatctttctgttgtagggtagcagccttgaaatttgtatcttggtttattgtattagatatttcttgaaataagcagaccttaattgaaaagtggaaaatgtttatcatatctaatatgaatatttttaaataaataattttacttaaggaatttcctagaacctgaaattgctttactctgtataaatcttatttatacatcagtgtactgtgggaagttaaaaaaatcttatttaaatacagacatatagctaaactgcagagaacaaagcattatttcagcgttatttataagtactggtacttttctgttgctatttttctaacagaatctggctcaggactgtctcattttcattttcacctctctgtccttggttttgttaattccatgtattttaactttgcacttcttgaagcatagctggctctctctctctctctctctctctctctctgtgtgtctttctctgtctctctctctccctcacacacatacacctgtgtgcacatcttccacagaaaaattaactccatggcagatagttgtgcagaatagaatacattttgccagaccaacaaatcagagacaagccaactctcaggctccagatccggtgtcccactaactcctttatttagctcaatgctggagtaacacacttcagataaagattttgccctggtggctatagactatgaatctgctacactagtcttcacaaaccaataagcactaggtagccggactagagcattaaatgttcaagatattgtcattcaatctccataataaatagataacaaagccaaggtcttactaaggggttacttgatagttaggaggtgaaatgagactagatcccaggtcttcttacctctaggaaaattgtcttccttcaaaacaccatgctttcccctgaatttgagatcacaaaaaacaaaaacaaaaacaaaaaaactatgtcttctagaaataccagaattagaacacatctatatgaaaatccttgtcctctgatagcagtcacctgtgatttcccgggatagagctcattcctcttccccatcttcccaggccagtgatagtaacttctttcctttgaaatgctgcaatgcctgtgagcactcacctgtagggacttcagaattcagaacaaatccttgctgaaatggaagggcggcagaaagaacattgcctcttcctgtgtagaacttttatgggatttctcccaagtgtgtaatatgtgtgtggtggtattttacgaaactttcatgagagtacttcacttcagttctcctctgccttttatggtaatcccgctcctattatttttctgttaactgagattttatttttaaatattaaattgtgattacgaaaagaagttctttattcccagagccacactcatgtatatgtaacttcttctgacttatgtggaagcaactcccacgttggagtttcagccctggtcccataatttgcaagcattaaatggaagcctcatattgcaatgcaaattatagtacccagggactggcagtataatcacccagttacaaaaaaaggtaaagaggagatgaaattaccataatgggccacagaaaatacacaagagaatgttcagaggcctgcatggcaggtttcatcactattctaaagatatgcttgctttcctctgaaaatgtaaggaaagatgttgttggctccaccttgatggaacttgatcttcagctgcttttacgatagtgatggactgggctgaattattcatatcttctcatccaaagtgtgaaatggctaaccaggatttgggatcgttttagaagctgaactgcaatggacaagtaggttgaaatatggaaacatggggagtgagagagaacagcatctagcaggaggaagaggatcatgccaaggtcttgagacaggaagccctgtttgaagagaagcacagtccagccaggctagagctggggtgagacatttctggcacatagtgatttcaactgaagtccagcttagagcctgggccctggaccccagtgaatcagctcatctgaagggagagctccctctgatacttaaacatccctgggccagggttctagaaagcctgctctaaggggaatgaagggagacctgaactcttcaatatcgattcttaggatctcttcaattagcggcaaattactattttcctagcctgatacataaaagaatgctgaacataggaggttcttactgaaatcatttggaaactgacaagaaaaaaagtaggactttaagaaatattttccctaagattatgacctcaccaatgcaagtactggatggtgttataaacaaatgtttgaaagatgactttaaaatgaagatataagtaattacatagtgaggcttacagtttacagctgaaaaaacagctgttctatgggttcttgtgacttttgaaaatatttccagagacacaatcacatctggactccaaaaatacagtgtcttaaacaccacagaactgaccacgatttgctctagaaaacagtattaattctacaggaggttccagagatgacaaagcccctgccgtcaaaattacacataaggaatttaaatggaactgtttgatgaaatgtgagtgatgatattaaattctaaattagtatcttatattttaagcatgcatgtatagctaaattaataatttaaatatagctaggtagacatttgactatctatcaattaaattagctcccctcaaaaaatgttgagatttatggagaggatcttctaactggaaaaaaaaaaaaacaccacggggctctactctgaatgccaggttcccttatatttcgacatacgcagtattttgagagtaaaccctgcaggacttgataggtaggtaggatgttgagtgagggaggaggataagtcaggtaagtaggtggtggtgttaccaactgaactagccaatggtagagacacagtttcacaggtggtagggtgggcaaagggatattaaaagctcactgctggcaagtagttgaaagagagttagtgttggtttggctgctctggttggctctgccatcccaacccttccccatggctgaccctgaggagttgcaagtttctttaccacccctgctgccttccttttctcccttaacttcagacttctcttcggcatcttccctgagcgctcccgtgaatttgagctggccagttccaagcagggacagcagccaaatggtggatccactggaggaacagcagctgcagattggagatgcattctcattaaccacacttttttgttttcaactttccttttaggttcaaggggtccatgttcaggtttgtttgataaattgcatgttgtgggcatttgagtcactcagataattttgtcacccaggtaatcagcctaatacctgataggtggtttttcagtcctcactctcctctcacccaccttcacccttaaataggccccagatctattgttcccttctttatgtccatgtgtactcaatattttgttcccacttctaagtaagaacatgtggtatgtggttttctgtttctgctttaattcacttaggattatagacttaggataatggcagccagctgcatccatgtttctgcaaaggccatgatttcattcctttttatggctgtgtggtattccatggtatatatgtaccacattttttttatcgagtccaccattgataggcatctaagttgattacgtgtctttcctattgagaagagcactatgaacgaaacttcttgaagccccatttgcagtatcagctcaagtggaagagtttgccttcggcttgtctacagaaaatgcacgtttcctgaaaacgtggtgggaactcttgaaagagggctatgattcttcctcaaaacctgacagctgatttggcatgcttcattgtttaataacgacggtgcaataattcatacttcctcatatatgatatttgcacacgtgcaaaatgtataggatgatctctttccagcatttttatgtataatcagaatgaattttttcttggttttcttgacttttgagaaagcagaattctgatgctgtttttgaagctgactagtacttgtttatccttaaatacattctgccctctaagcttttatagaatcctttatgagagttaatttaatcagtagatagttaatattaatagtgccatggtgctataagcaacaaactaggtacactattatttgttttgtaacaagatgccaagcatgccagagtttgaagtagagtttaatcttatggaccaagggagataactttaagattgccaatggtagatccacctctattaggctaagttctctagaaccaatgactgtgtcttatttacttctctgtcctcagcatctgaaacagtgtcacacaacactcactaaatgtatgttgaataaaaaagttgacaaacataattaaatgctattttttttcctatacttagcatgaagactataattgtttctctaaaaaaatgtataaatcagaacttcattgacttgaaggaaaatattctcttttttatggaaacttgaactttgatggtagctttaaaaaatatatgataaatattttttgcccttatataatttttttaaagtctttacttcagaaaataaaagactgtctagaaggaaatctttttttttttttttttttgagacagagcctcactctgtctcaccaggctggagtggtgcaatggcatgatctcggctcactgcaacctccgcctcttgggttcaagcgattctcctgcctcagcctcccaagtagctgggactacaggtgcgtgccaccatgcccagctaattgttgtatttgtagtagagacgaggtttcaccattttggccaggatgatcctgatctcttgacctggtgatccacctgcctcggcctcccaaagtgctgggattacaggcataagccaccgcgccaggccaggaatgcatatttgatatggtttggatctgtgtcccacccaaatagcatggtcaattgtaacccccaatgttggaagtggggcctagtaggaggtgactggatcatgggggtggagttttcatgaatggcttagcaccatccccccatggtactctatagtgagtgggttctcacaagatctggttgtttaaaagtttgtggcacctctcctatctctctcttccttctactctggtcatgtgaagacgcttgcttcccctttgctttccaccatgattgaaactttcctgaggcccccccaccgaagccaagcagcctcatgcttcctgtactgcctgcagaaccatgagccaatgaaacctcttttctttataagttacccagtctcagatatttctttatagcaatatgagaacaggttaatacaatatttttccctgtttagttctatggttaccgcttttaatattttttatatttggtatttttatatgtttgattgctgtctttaaagtgccttattaaaatcattgctctgtgctattacttttggagttttgcaagttgtttatgtaattattctgaagaagtgactttgttttcaatgcatctaatttaaaggatgtgattgtctttccattatctgaccttagtgacaatgttctattttgcttgtcctatatctcatgttgctttttagtggtctgtgttatgcatcagcaattaagccaattaattctctaccaaatataacttctggatatctttgatatagcatcttaattctttgtagatatggagatgtgtacagaagtatatcctaaagccccacaatggggctatgaaaaaggacagatggacgggcaaatagtcttgttcagcatatgaggtcatagttcttgattaatttttttagttagagatcacacatatagtatgatttctatatcaaaggtatgcttatttcaaaaaatatttttcttacatgccctgaaaattataattttttaaatgtgcaaaaataaattcttatgaaaaggaaattttaaattccctgttggccatgttgagtttgagatgcctttggggacacacagaagatttttggatataaaactgcctaaggaaataaggaagtttattttcattggaactatagaaggcaagcaacagcagaagactggaataagggagaagtatagaaactgtgggcatggtcatccaagagaggttagatgactgtagggttttatgtttaaggatgttgactaaagtacccggaatatgtggcacagtagaatcacatggcttcaggatttctaatagtgccaatcttaagggcttcactgatgaatgagctgactctactatagtcaagacctcgtgcagcaagtgcagggcacaaggtaagcactgtggtctgtagattcagacagggtgaggcctgagggggtcagaggccctctctgtagggaatgaggcctgctcaggcaccaggtttctcagctctccaacctgaagtctgaaaaaagaagtggatggcatgggcatgcacacatacacacacacaaattacagaaaaagtttaattattgtgcactgcacatttgcatccccataaaattcatatgtcaaagccctaatccccagtatgatgatactaggaggtggggcctgtgggagtgattaggttaggatgtgtcaagagggtggagcccccatgatgatattagtgctcctgtaagaggaagggacacctgagcctcctctttctgctatataagaacacagcagaagatgctgaaggtgatcatctgcaagacaggaaaggggtcctcaccgcatctgctggcaccttgaccttggactcctcagcctccagaactgtgataaatcaatttctgctccttaaaccacctagtctgtggtattttgtaatggcagcttgagcagactaagataatcacgcttcaaaggatttgtttggctagagggattttccctctgccctttcagtgtgttgggcatctcagttgctgaagaatgaggcaaggtacttgatactgatgggaataaatgatggttcacaccccacagtcagctttctacttcaccatctgtgagaggacaatgagatcagccccactctaccccttccctgccacccagagtggagggaaagcccgcttctcatccttactggctggtctgagccatacatgtgccatgacccagttacggaacttgctttccctgacactgtttctgaagtcactggccctccagacagacataagcatctcttctttctacaaacatctgttctgttgggcctccaagtgggagggtgggcacttggtggctgcctggctcagaaactgcccattatgagcaacagatcatctcgccttccattaagtatgtgattacagccagatgctgtggtgatgggcacacagctccctataataaccataattatgatcctggtgtttcttcagctcaacatactctgaacttctgaagtcagaagaaatttggaagaattgcttattagaggctgcaatcaaatggaggaggagaactttttttaagaagggtggaaattcccgcctgacatcttggcttctgtacaacctaacctgacatcctatggtgtggttctggaggccgaaagaacacacactggctccgcattcctgctcttatttctcttcttccttgatctttgctctgtcccacccccatctcttctggctttttctcagttgcttctcctgactgggagggaaaaacaagcacctgctggcccaccagctcatgttccccctgctatgggggcttgcagagaggtgcacctcccctgcccactcgggtgaagttcctggaatacccagggagagggggtcgttggaagttaaaactggcggcttgctgcgatgactaacagccacctgcgcttgccattcttgtgagtccatctatttgtggaatatggagctgtttggggtatatttgtgcatgtgctaagtctttacttataggagcacatttaaaagagtcggaaatccagtctttgaagaaacatgtaatattagtttgctagggctgccataacaaagttccatacattggatggcttaaacaatacaaatttgtttcacagttctagaggtaagcagtccaagatcaaggtgtcagcagggatagtttcttctgagggctgtgagggaagggtctatttcaggactctctctttggcttgtagatggctattgatatactttagatatctgtccccacccaaatctcacattgaaatgtaatccccagtattggaggtgggcctagtgggagctgtttgggccacaggggtagatccctcatggcttagtgctgttctcaccatagtaaggtctcacaagatctggttgtttaaaagtgtgtggcacttctcacccccttgctcctgcttttgccacgtgagatttctgctcctacgtcaccttctgccatgattggaagcttcctgaagcctcctcagaagctgagctgatgctagtgctatgcttcctgtacagcctgcaaaacataagctaattaaacctcttttctttataaattacccagcctcaggtattccttcattgcagtgcaagaacagcctaacagctatcttctcccagtatatcttcacatcaccttccatgtatgtgtgtgtctttatattttcatatggtgttttgttctgttttgttttgtttttttaggcagagtcttgctctgttaccaggctggggtgcggtggtgcaatctcggctcactgcaacctccgcctcctggattcaagtgattctcctgcctcagcctcccgagtatctgggactacaggctcatgccaccatgcctggctaatttttgtgtttttattagagacagggtttcaccatgttggccaggacggtcttgatctcttgacctcatgatccacctgcctcggcctcccaaagtgctgagataacaggtgtgagccaccacgcctggccatggtgttcttataaacaccagtcatattcaatcaggggcctaccctattccagtatgacctcatcttaactaactctatctgcaacacccctatttccaaatcaggccacattgtggggtactggggattgagacttcaacatataaatttgctggggggacacaattcaacccataacatatgtactataagtctactgcatgccaggcactgtgccaagctccggggatacacttttgaacaagaaagacagttgctactctccttcatgttatttgagagtaaagagaaaaatgacacaataaaaaagtaaccaatatgctgtgatagggccctgagagggaccgtgggagaacagaggagaagcaaagaacctcacagtggagaccaggggaggtcgccctgagcaagtcaggtcaaaagcctgaagtctgaaggaagataggagtttaccagggaaaaggtggggtggagcagacggatcttccaggtggaggcaactcaaagtaccaaggccagtggggacagagacaacagcaattctgtggggttgaagtaatagcatgtgcaagtgtgtcccagacattaaggagaggaggaaaagagtaatgaagagacactggaagaagaatgatgcagacccagtaagcccactgaggagtatggcagaaacccgagggcactcgggagccactgaagaatgtcgtttaggaaatgacatgatcagattacattttagagaagccctgctggctgagcctggagaggaggagaaggaaggaagaccacttagaggggcacctctgtgctccagatgagagatggcagtggcctgagctaggagactagcaggagatggagctcacgggactttgctgcctactggtcctgcagatcccagcccaggcatctcagagctcccagggcttctccatgtctgtgtgccagtttgacactcatgtcctcctcctattttttattcttcaaatacttgcatggtatttaccatatgccaggcactgagtgcattagaaatgctaattcattatgtgccagaaagtaactatgaaggaggtaccgggaggcactgttattaatccattgtacaatgggaggacaaggtcacagagttaacagatgacagtgccaggatgtgaatctggctgtctggcttcacagttaatactctttttttttttttctttttttttttttttttttggagacagagtctcactctgttgcctatgctggagtgctggagtgcagtggcatgatcttggctcactgcagcctccacctcctgggcccaagtggtcctcccacctcagcttctctagtagctgggacataggcccatgccatcatgcccagccaatttttaagaaaatttttgtagagacagagtctccctatgttgcccagggtgatcttgagctcctgggctcaagccatcccccaacctctgcctcccgaagttttggggttataggcatgagccactgctctgggccacagttcgtactcttaaccatgaccctacactgcctcttatgaggaggtggtccttttatcatcacactcacaagaggacctggcacataatagggccttgataaatacttgttgaataaatgttggtggtgattggatatatatgatgaaaatggtggggggatgcagactgggggatggggcccagtgtcaaagatgacttccaagactttcagcttgggttggaggtgagggtattcgctgagtagaggaccacaaaagagaaagctgtctctagggaatgaggaaagaataaactttaaatctctataccagagacctccatgtggaggggcaaactggaacggcctgatggagcacagctcttcctactcctcaagcatctagagcctcagccacccctcgaaggtgcatgtcactcgctgccctggtgagaacatccatctgaaacattttaggccttaccctgtaacagctgaataacagctattagctttggactctaggcatttttatgagatcttagttccagggcttgaggtttggcaaaatgagcatattattcacacgcaaaacaactgcattaaaatagcattaagcatctggcttacactgacaaaacctaggaaattcagaattatggtaataagtctgtcctgagttcacccccaacactatgcctggtgctgctccattaagtgtggagagaaaggtccccactgggcagaaagagccagaccagggaggtggaaggcaggacaggtgagggaaaagaagaggaggaggagttgggaaaagaacactggggcaggggctatggtcccctgacccaggcctgccacatggcgtatggtgatgtagccatgaagtgctggcccccaaggccactcctctgatcctagagccaggcgacacttgcccaccccaggcaccggctccgctggtctgagactccctcctagaagctgatgaagatgagacacatttgccccatggagtcgaagcgtctttcaagtttgcatccccgcagacctcagacacagggagaactaatacgcaggtacatttctccccactgaatttccattttcttgaaaagaattaaagagaaagaagcttgataacagatgaacaaaaagcattgtactgtgttcgaacatggcaacatggctgattatagcattagggcatcactctgttaaggatatttgagaatgtaaacaattttgatctggagttccattgagagtagaagaaaaaagtgagaaaaagaaattccttcctcttggtcaaaaaagagacctttctccatttgagatgacgtgtaaccatttgttccaatgatttgtagtaaaatcagtaattggttcttgggatgcattttgggaaaaaatgtctataattccagaattcaccaaggtagtttctgtaagaacttcctctaatcttttaaaatagttaagtataatccaagagctcaaaaatgggccacgttctttttaaatacaataaatgtgatctcagtctaaccaactttgagacgacaaaaatacggtccttggggaagctgtatgaatgtagcataagtgtcagggtggcagagaaggtgagacacacctacgtttacaagaaccccaaataacctttgtaaaataaaaatgaaatgtcaattccacaaattgattgccctcttccaatagttttcagatttctttaaccttttcacctcccgatctctcagtgattaacaaatctcttctctttgccctacaattactatacaccagaataataacccaagtaaataagctcctttaacccttccaataatcctatgaggtagccactcttgatcatggaatgatgtcatttatcattatgatacataatgacattaggttacttgaccaaggtcacaccaccagtaaatggaggagctgggactggaaccccacgtgttccgttccagaggttgttctaagcacactttgagttcccacgccacctgccaccaccacatgtaatttaagcggagattagtagtccatcccacccagacctgggttgcctgtaaaacccagctgaggacatccagagctgtaggggtcctgatccctctggaagtccccatcttagaatgagaaaccctgttctctgtcaaaccagccaagagacagaaaaaggagttgtgttcatttctaaattgttaaaaatggttctgaaggcccatttcttttattcctcctcttaagtgggaaaaccaaaaaaattctatgctaccaggtgaaagctgagccaggcataaaacacaagaaaactcaggctttagaaaacgacctggcaatcacttttccaatgtgctataaaatcttaataattctgagtaaactggcccaaaatgcatgaaagtgcagaacagctggaagttcagggaaagtcatttgtgtgctcttcttgtcacttagcaaagcaggaacaaccttggctctgttgtgtagctatttagatgtcacagccatgaatccctgactctccatcagaggccactggcaacacctcccctttttttgttgtttggaagaaagagatataggagaagttgttcaaataaaatgactgtttggggtggggaacggagaggcagtgtaaacatggctaataacaagcgcagagagaaactcaggacacagtgacatcagcagagccaggcatctcaaagccggtgacagtctgcaccagcagatttcttgtggagctctagatatttctgttctgactggagtctttatttaacagtcttgatgagtgcattaactgtgacttaactctgagtttgaacgaaaagtacaagtatttgacgtgtttcttggcgacaccttttgacaaaaggatgcatatatccctagttttgtgctagaattctttagtggggactctctggaactaaaacatcctctttggaggttaaattttaagccttttcacagcttctctatcccacagcctcctctctgcacatacactcatgcacacacgtacatagaagcaccaaccccgggggcggactcgcttagcctagatgcaagctgctggcctgtgcacagtgtattttcccacaggacagaggcagagggaacccagtgggaccaacacaggaggcctaagttgggtctgaggtctcccaacctcccagaaaatgtttctcctggatcatgctctttggtttctttccttgtttgttttctacttgagcggcagggacgcaagagaaattgacagaagaaagaaaccgcctgagcatcagacacaggggtgatgggaaatgaaaatgatttatagagtttcgttggcctccactctcgccttttctgctttttgtagctcaacatcccacaggtgtgaacacagcaaactatgtagccctgttttattgtgtaattaaataacaccctacactgagtcaagctgagttgtgaaacctcaaggttcggaacatcaggtagaggatgtggggaaatgcctgccgcctgaggtcactgggttcattttcctggcaccagtagaggtgaggcagctgccttgtaatcagctcctcctggaaattactacacccacacaaacatttgggtcccatggaaacggcaggaatgcggtctggtctaggagcctggaactggggcctgaacatctagattggtttggccccaccaccgacttcctgtgttgtcagtttacacctcgacaccacagttttgcctttggaaacaccaaagagagggtcctgcaaagagcaaatctgcgggaatggtgtgaaagctctctatttgcttaggatgctttagctttgttcccgcccaaggcaggaaaaaagatgaaatgactaaccctattattctactctgtaattctgctactgtgctgaaaggcttcgcagcgtcttgcctgtggtgggagtttggcagagaagacctccacagcccttccaactctgagattcacaatagtcagtgacttcactgaaaaccatggaattgcatgctgtcatcactggagagggcaggccattctgaatggaaacactcttattgggcatttttaaacgtaggcagtagacaaacattcctttgttgcttttctcaggaaagaaattactttctgaagacaatggcaggcacatttaatagaagacacacaggtagcttcagctaagaaataaaaaaaaggccaggaacagtggctcacgcctgtaatcccaacacttcggggggccaaggtgggtggatcacctgaagtcaggagttcaagaccagcctggtcaatatggtgaaaccccatctctactcaaaatacaaaaattagccaagcgtgttggcatgcacctgtactcccagctacttgagaggctgaggcaggagaatcacctgaatcagggaggcagaggttgcagtgagtcaagactgcaccactacatctagcctgggcgacagagcaagacactgtcaaaaaaaaaaaaaaaaaaagtattcttgcctatccccctcctccctaccaatgcaccaaaagaaaaagtagcttccctagaaaagaatgtcagccaaatataagtcaggatgctatcagagtgtagaagacatgcaggggagaggtgtgaagggaggcaggagaggaggcttctgggaagggcttcctcaggcaggcggctcctgagtcaggctttaggagataccagtagcattcaccatccggagggagagagtgggtcacaacaggacaaggatgggagcaagcaagcggatgtggaaaattccatggggtaatagagttttactttttcatctctccaagagccagtgctgtgaatcccctaggaagcacagatttataacttggtagggaccactgttcggtataacttttttgtagtttagtttgttgttgttattctgactctcacgacataacgctggctttgcagaaagcacatgtgcagccactgagttcacaaatgtggactcagccaccaccctgggccaggtacctggaaaacactggcaatgtccctactgccatggagcttgcattcctgcctgggaaacagacaaataggaaatcagtgaaacaaagatcagttctgagagtgatgagtgcttagagaaaaataaaacatgtatgtgatgaagtggtggggagggagtaacattcaacagaggagttcgaaaagacctttccgaagttgtgacacgtgagcagagacctaaatcgcaaaagcagccaactttgccaagtaagatgtgcattccaggcagaaggaatggcgacagcagaggtcctgaggaaatgacatcagtgtgttctaagaacagagggaaggccagtgtggctgagaaggagagtgataggaagggagaggtataggggtggacactggagggataggcagggaccagatcataggggcccttgtaactgatagcaaggaattggactttatctttatctgtaataggaaagcaaggtaggaatgtaggttgaataggcttattataattcaacatggagacacagtgatgaattagaccctagtgaataatcctagaatctctcagaataccggtgatattagtgaatggatgacaactgactagaaaccagataggtgcctgagatttataaggcagacagttccatacaggaatttagaatcttaccagactctaaaaccttccacatatatattttcccaagtatacatactgtgccatgaatatctaaataacatttcccaagcatgtgtgtggtcgtgaatgacatccaaatttaaaatacaatgcattctgcatattgcatacggttttctcagtggctcttctaagacaccgttactggtgagcatgtgcgaatacagtctgaaagggagagaggaaaatctcagctcttcttccaaaccagccgccatcctcaggaggcccccacaccctcaggaagaaccaatctgcctggtcttatcactgtgacagatcgaatgatgggtatcaagtcatcatttcatggccaagattttgtcccagactgtagctcactcatttctgacaatatgttgaaagtgaaatgtgcttcctcgcccctcctaacttccttttacaatttatgaattttgcagttttgctaaacacaaaagctgctagaaattttcagaataagccctttacactcagcatgcagacggcaaagtctcaagggacagaaaattattaaacgtgggacacacagaaagagatttaatgtttttaggaccaaaaagaggattataaaattcaggcagcacaacaaataccagccgaagcctaactggccaggagtgtgtcataattattcctagtcatcaattctgatggattctgggccccagcagagaagtcacttcatcctccattgtctaatggatgctgatgaaaaggttacagtgccaggaaggtggtgctcatctctaatcttgcctgccttgttctgtcaagtcagagttgatgagagagacccaggtaactcattctcttgctcttgtcctgatatctgatctcaggatggcattcgagctggtatttaccatttggccatgtgccaggagtcctgtattttaaagatctttaagtagaaacacacataactcaaaatgttaagctagaagtatcctattttctcttctaaatctttcaacttacaatttaggaaacagatctagagtaaatgggtaatttttttgaggcagcaacaaaaccaggacaggaagtcacacttccgtctaccgagttctcccaatccaaagctatctgaagtggctgttttagatttccccacccacaagacttggccacagttctcctaatgcccaaccccttggcatcacagcagtaaagggaactctcccttattgtgaacataatataacacaagctctgaataaagaatacaatgttgcttttaccatacttttttcttcttctttgaaattatggtgattcctagtttatcttaaattacactagcccaaacctttatccacataaaacaaagccagaaatcaggaagtaagcaagaaaggcacctatagtgaaaaaatagcttcttgtggtccacgctaaagattgcaggatgtcccatttggcctttgctgatgtctctgattcatgtttaaaaccttaacaagcttgtttgcaggggttgcaatcttccaggagcctgagagctgccaagacataaaaagaagagaagtttctatgggccaagaaccataggacagaccctcagagcaccaacaaagcactgcacacagccaggaaagaaacaacacaaacaaagcatgaaaagcaggcagagttttaaaaggagcatttccaggctggcttacaaacctccacaggcccaggagcaaactccatcaatagcgcgtggcagccgtggaggtttttaaagctatccctgacttaaatatccagaaaaggttttcttttggtcatcatgctttgaagaaacagagaactgtgatatatcttagcaagactggcatgactaccacttaacatggcgattactgttgagattgtattgtctcaagggtgtaaacacacaaatgaacaagtaaaactcctcagctatgtaaaacccccaggggcttcaaacgattctggtgtttctgaggctcttctcttcagccttccctgtacaaccagccccaggcagcccagtgtgctagctccccaatttttaagccaagaaatgttaatagttttggaaaacatcttagcttcaattacacctgaatgcaaattcccaaccacgtgggccttacacatttttgaggtgttgctcactgcagtcctagccctatctacaacactcagcaaaaccctaaagggggtggctgattcttttacttttccacctaaaacagccaccttctgtacccattactctcagcttgttccccttgaagagtgatttgtttggtacttggattttttttttaattttatggtgtcctacaacatgctggttagactaagccattgtcatgttgactctaaaatatttgaagagatttattctgctccaaatttaagtgactaacagcctatgacacagccccaggaggtcctgagaacatgtgttcaaggtggccaggctatagtttggttttataccactttagggagacataagacatcaatcaatacatgtaagatgttcactggcatggtccgaaaaggcaggacaacgggaaagtggggggaagaggggacttcctgctcataggcagattcaaacattttctgattgacaactggttgaaagtgttattatctaaagacctggaatcaacagaaaggaatgtctgggttataataaggagttgtggagaacaaggttttataatgcagatgaaacctccaagtagcaggtttcagagagaatagattgtaaatatttctttctttctttctctctctctctctctttctttctttctttctttctttttttttttttttttgagatggtgttttgctcttgctgctcactcaggctggagtgcagtggcatgatcttgggtcactgcaacctccacctcccaggttcaaatgattatgctaccttagcctcctgagtagctggcaatacagctgcccaccactatgcacggctaatttttgtatttttagtagagactggttttcaccatgttgaccaggctggtctcgaatgtctgacctcagatgatccacccgcctcagcctcccaaagcgctgggaatacaggcatgagccaccacgcctggccagcttgtaaatatttcttatcagacttagagttgttctgctggtcttagggctctgtgttgatgttaatgctggtcagctgtgcccgaattcaaaaagggagaagtgtataatgaggcatgtccaaatcccacttcccatcatggcctgaactagtttttcaggttaactttggaaagtccttggctgagatgaggcatccattcagatggttgaggggcttagaattttatttttgattttcagtcaactcagctatattaaagcatgcattacttttttgctgtctttacccctctcctcccaatatatttttgtggctcctcctcataaaaatttacttggaacccggagaatattattaaaaaaaagaaaaagaaaataaaagactctctcctgaggaaaaagttattccacccaccaaagttacaaaacaggaaataatggctcagtatgatcctggggacactcgggtgctcttttgaagctgttttcaaatagggcggttgttcaaatccagaaacctgggtcacaaaatctaagtatgcaggagaagctgcctcctacaagagaaggagcctccatcctggcctgttggagcggtcttacaggagagtcatgaacatagaaatcaagtcttttctaatgtcaaaatcatagaccttagggaagaaggagctgaagagctctcctcactagtggctgcccacgaacgaaaccagctgcccagggtggcaatctgtaagagaacagaattaataaggaaaaaaatggcaccaattaatgtggattccatattccacttttacctatgaggccaaatataagctggtctttttcttgctggagtgaacaacccaataaaacagaaagtaaaaagaaccagaaaaaaaaaaagatgctcaacagaattggcctttccttatcaaatagctgttgtttctttcttctcctgtaaggtagacacacaaatagccatagcctaactcaaaccactccaccaagcctgcaacagactgatagtttagctaaaattgtcatcacagtccactggaattttgaaactaagtaacgtggggttcgtgtactgaaaataagtgaaatgtgccataatcaaaatgtagaacccttttgtatacctccccagacagcagcattcttgggaaaactgcaaaagaatactgaagacagtataggaaccaaagatgatgaggtgatatttgactggcacgaaagtcaagaaaaaatagtgtttttgaacaacactatgtaactagaaatctaagtacgttttctctgcaataaatgcatgtgactgacagaagccagttatgagtatgcaggcatccaaaaaaaatgtaaaatgaaagacaatttcaaataagttacaatgttatgtttctgaaattaagcttctggctaaacatgtttgaggaaacagggattttactctactcctgtctcttaaaactcatggaagaaaactctgtctttaatgaaacaaagaaatggccatgccccgaacaaaactactgaacatttctaccaaaaatgctaacgcctggtctcaggtgggcaaggaggctgaagcccacattacagctcaggcaacgtgtcaatttcccattggctctgcaagacaaactagcatcctttcagggcccccaggtaaggttgcacaggtggtgccccgctaaagcatgcctggcccagagggtgaataaaagaggctgggatagagccccttccatggtttctaaacaaagctaagacaaaccacccagagacacccatctgctcataagcactagccagaggggtgctttcacccaaagaggaggccttgtaattcacactaggccccaagtgggctaatggcagccctgggtcttcacttagggagagaagatccaggagctgggcaggccatggatgaagaagtgaactatccatgtggcgacccagttctgcacccccagaatggcatagagtcagcctctgctggaggcctctcaccacagctgctcattccttttcttgaagacacatctcccatttatttttgggcctgaagaatgagggcgtctctcaggaaattcccttaaataaaaaacaacctggttatatgtgcttccttctctcaaattaagcaagcaggaataaactgagcataagtgaaagcaggtgaaggacgtgcatcacaaggaaagacacttcagccagtaagacttcaagcaaaaaaaaaaaaaaaaaaaagaaggaaaagaaagaagaaaaaattagacaaaaggaaaagcaattatagaatgacagaaaacaactaaaagtgaactaacaaatatgcacatttcaaattttgatcaacactgataattgggtatctaaagatgtccgtcaatattcttttccgtcaaaatatatgagagttttcttacatccatgctgacttggggatagtatccatcttttgaatctggagtagtctgttggattttaaaaaatggcttctcttatttttaattagcatttctctgatgattagtgaggtcaagcagatttacatatattgactgatcatttgcgtttggctgcattcagaagcagccccttgtgctgggaataatccttaaagggaatgtgaataacattttcaaatggggagaagcacactccgtacttctgaggtcagacttagctggcattttggcatgtagagtaagctcggtcatgagggacagacttacttttcagaaaatctagagagccaaattatgttatgaggttttctaaatttggggtcagccaaaggcacggaaaagagaagaaacaaaatcagagaagtcagagaaaccttcctcaggttcagacaaggcagtcttctttctaccctgcatgacagggataatccaccaaaatatccctgccagcgcctgaaactttgaaaacaattatatgggggtcaggctttgaattttcgaaagtccatgattaagctacaaataaccaaagattcttgagcacttactatgcactagccagtaaatcaaacgtaccataattcaccacagcgtctgggtcagggagaggtgagaaaattcctgactcacaaatgactctgtgaaaaatgaggataagaatgcccagttcatagagagctatgataattacatgaaacacggtatttaaagcacttttgccttggacaaagttggtgctctgtaactatgaattccctctccctttcctccagttccctctaatagttaatgtgtctttatcaatcctcattaactaaatggtgtccatgacctggaacacagaatgggaacctcagctgctctgggcagtggggcaggatgagatggtgcatggggatgagcaaagggtgaggtggtacctgcacaatcttctcaccaggtgggatgaaccaggggttatcatacactacctgtttatgaacagatgcagtgctggattctgtataagtgccagactaaacatacaaagcccttgagcatgacatgtaccttttatatgcttttgaagaatttggaggggtgcaaaggggcatccaatcctgctttctttgtggggcagtgggggttggaaggaggaagaagtgaaatgtgtgtaggggatgttggggggttaggaacaatacagccctctatggcagggagcaggatgggagtgaggtgagagccacagccgacagccaggccacaagttctaactctccactcaagactgggatgttttcttacagcaaaaaccaaacctgataccaccccaaatttttattttatcattagcattttatttcctcaaatgtgtttactttgcagtaacagtaatgtcaaaatatcctggacaagggtatcatgcccaggactatttaaagaaaggaaccctttgccgtttccacaaaccccgaaatggcctaaaatgtgagaatttgcatcagatctcactgccatgcaaatcagagagtggcttgcatggtggccttatttattttggtaaatgcgtgggcaggggaggtaaaggagctgtttgaaatgcttttaaaatttttagtttcaaattattgaacactccaagaaaaaaacttagatttttctagggataaaataaagcaaaccttacttcagatatgtgtaaagcataaatacacttaacactcttgaaagctatattgttgactatttgaaaagagggctgggaatattttcttcttaatgaataagtaaattcacttcacctgaggacttagtacaaatgggctcctacatcatctttactggccctttcccaccatggtgtaaggctatggttccttcctctcttcagggcacggccaccacttctcaccttcttatcttgatgttctagccaactgtgactccagttacggtacttacctggggtttgcctcctacctctataattttcttcaccccaatctgcgctactggtgctttgtcctcaatcttcttctggggcccaggtctctgcatgacctcccattggctgaattattaattgttaatgggaatgtatctctgggtccctgaattgcttcctcaatttggtatcacataaaattaactatcaaggacgagttgttattaacatgaatatggaaaggtaaacatgcaagaatagccaggaaagcaattaaaataacaactgtgaagagaaatgctctggtagacactgaaacatactagaaagcctctattaacacagtctgggcctgaccacaggaatagaaaaataggccagtgggatagaataaaaagtccccaaggagacccaagacatggaaatgtaggtgtatcctaaacaggtattgctagggcagaggtggggaaaatttccaatgcggtagccattggaaaaagataaaatctgtactgcataccatatacaagaataaactccaaatggatcagggatctaaatgtaaacatttaaactgtacaaatacaagaagcaaatatgggtgaatttttctttaaccttgatatagggacttaaaatccagaaaaattaaatattgataaatgtgtctacataaaataattaaaacatttttattgcaggagaaccataaacaaagtcaaaagggaaaaatatgtataatttataacatggataaggggttaatatcctcaatattcaaataattcttagcgagggaaatgattaaagctacctgaaaaatagaaaaaaagacatgaacagacaactcatttaaaagcatatatatggcatttgaacttatgagaagatattcaaacaacccataattaaagacatgcaagttaaaactattgcatttctcacctatcagataaggaaaaatttaaaagtatgacaacacattctgttggcaagaatagagggaaacaggtactctcatgcattgctggtgggaatacagattggcacaacccttttagagggggatttggtgatgactaacaaaatgattcatccacttacttttcaactaagcagtcctacttctaggaatccaccctaaatatacatctctaaaagtacaaaaatacatatacacaggttatttattatgatattggttggaaagagcttgaatacttaagagagtaggtgaataaactatagtacactcagtggagtactatgcagccataaaaaatgagtgataagggatgcctatgaactgatatgctgtgcttactagggtatactgttaattgaaagaagcaaaatgtgaaaaaatagaaaagcctatcttttgtgtaagaaaaaaaggaaataagaaattatacacatatctgctcaatagtgcaaaaataaatagagaaaaaataaaccagaaactaatgactagttacacataaggagaagggaatgactcctagtcacatacaaggagaagggaatgactcctagtcacatacaagaaataggtagaattgggttggaaaggatgggaaaatgagagcaggatagaatggatagtggggggcagaggagtgactcttttctgagtaacccttcttataaaattctgacttttggcaaccatagtagtgatttatgtgctcaagatatatagatagacaaaatcaacagggatgatgaaagaaatccaaaatggaatttgtatcagtcaagaatccaagccaggaggcacaagtcatgcagtaatttgaatagagaagttcattatgaacagggaaataactatgaaggtgtaaagacagccctaaagaatattctagagctgagagtacaaaaagaataaacaaatttggaagtggcccctctccaaggatgcgactgagatctcatgggaggtgatggagatactcaataaatactaaaaattaatgggttttctgggcccagagctgtaccacagccatcaggcaagtaagaaatacaccctttggtaggcatgccaaagctggcaggaagaaattgcagccagggccagcaagccaaaagcaaccctctggagtgcaagcagtcaagactggcagaagggcattgagaatgactcagcatattaggagcccactcatcagcagggcagcatgagacctgaggtgtgcagtgtttactttaggagggtcacatcgaggtggtcaccaggccaaggccagagctgtgagctcactaaggcaccatgtggtctgaacaagcagctgggacaaagcagcactaaattttttcccgcacactgctggccaccgtgtggtaggagtgaagagataaaacggcagcacatcagggccgggtgcagtggctcacgcctgtaatcccagcactttgggaggccgaggcgtgcggatcacgaggtcaggagattgagaccatcctggctaacacggtgaaaccccgtctctactaaaaatacaaaaaattaattagccggacatggtggcgcctgtagtcccacctaccccagaggctgaggcaggggaatggcgtgaaccagggaggcggagcttgcagtgagcctagaccgagccactgtgctccagcctgggcaatagagtgagactccgtctcaaaaaaaaaaaaaaaaaatagcaatgcatggtgaatctgcgggctttggaaccatccagatgtggattcgactctgaccttgtaacttaactaattgtgtgatgccaggctagttacctaatttccctaagcctcagtttcctcacctgaaaaatgggtcatcataataatatctactttacgttatttattgcaattatctctatatttatattatgattatttatattcaatggatgatatttgtaaagaacttactacaaactcaaccagcagaattcataatagtttgatatggtttggctgtgtccccacccaaatctcatcttgaattgaaatccccataatccccacgtgttgagggagggacctggtgggagatgactgaatcatgggggtggtttccccatgctgttctcatgatagtgcatgacttctcatgagatctgatggttttataactgtttgatagttcgtccttcacaagcactcactctctcctgctaccttgtgaagagggtgcctgcttccccttccaccatgattgtaagtttcctgaggcctccccagccatgcagaaccatgagtcaattaaacctcctttgtttataaattatccagtctccggtgtttcattatagcagtgtgaaaacagactaatgaatagttgttattgtgattgttgtaatgagccacatcaatgactagttcacttctccttgaacaaactatatactatgcattgaaggccctatttaacgacaggcagataccccataggttatgtttctaaaggtttgatatagctcattgtaagtaaatccaggacatgaaattttaaacttacaaaatagataaatagtgagtgattatttttattaaaacgtgattcatggcctcttttggagcaagtagcatttggtttccttttaatgtttgcagaaacagaactatgacataaaacaaaacaattgtttgtgtattgccttaggcagactgagaaagggccactgctgggtgacttaggcatgggaaaaatctggcttaataataagccttaacaatgttgactctttcaaaggggcaaagagaagccaaagtctcgcatttatcttttccaaacagattctgaactacttaaatgtgatgacatagatcaaatatttgaggttaaggattgcttgtaggttcatgctttttcctttaatccattttttgaggtaactccaggaaaaataatgggcaagcatagaaaaagggtgagtatagctaaacaggatcctatttcagtaaaacactgcaatgtctggtgtttctagtaatgcatttattttatgaaaaggatataaaatcaagacacttctgtggcaacgtctccatttatataagggacacaaaatatcacaaataaaatatgccaccctgctgtcttccaaatatttccaataatcctttaagtctaggaacaaaggctaaattcctgaataaattatcttatctttataatctgctccaaagttttggaaaccctagcttttgaatattaaccaaaaagtgtttccatccagtcatttggaaaagcaactgaaattcatgctaattttaacttagacagagatgttgttttgccatctttttttttttttttttgaaatggagtttcactctgttgcccaggctggagtgcagtggcagatctcagctcactgcaacctctgcctcctgggttcaagcgattcttgtgtttcagcctcccaagtgcgtgcaaccatgcccagctaatttttgcatttttagtagagacagggttttatctctcctaaaaattggccaggcatgttggccaggcttgtcttgaacccctgacctcaagtcatctggccgccttgacctccctaagtgctgagattacaggtgtgagccaccacgcctggcctgttttgtcatcttttactgactccctgttgatccctatgtactctgaccacagtagagatcccaaagcaccttcacctctgagtcctcatccaacactgtactccttcccttggcagtgacttctaccttatattggtaagatctggtatatctagaataagtgtcatccaaatcattgtactgatatctcaacattcatccaccctatgctccagcctctgaacaagcagggactctatccttcctcaagattcaccccctcacttgggttctcaatctcatgtctagaaggttcttccagcatatcctttattttggattttctttcaaaagtacatatgtctcctttaagcttttcccaaatatttgctatttagttatctctatacttgctgtttctctgccagaattatctgtccctttaaacttagcattatccttactttcctattgacacaattccaaggaataatcatcttcttctccattttgccacttctgactctggtggggacatctgactctatcttaactacaagccttttctcctcatttaacaccacctgaaatgttccctcctcctcatttatttcattcttactcatccttaaaggtctagcttaagcccctttaaagtctcaccagaacgtcccttctctgtaaagtctcaccaga

SEQ ID NO: 431 - DNA, 20001 bp, Homo sapiens
gcaaaaaaactgcccagcaattttaagttaatgggcaagattaatggattgtcatataatgtgaagggaaagtattagaaagaaatgaaagtggctagacaaaattggtttggaattggagtctacctgaaggcccctcagcaagaacattactgtctgctgtattttcagctaagcagtgtattaatttgaaagccatgcctcgtacggatacccagcacttagtggttggttttatgtttaaaatgcttagtatgaaacctgtgctgaaaatttgcccaaacatctcacagttgattgcaaacccgagtgcctgggggctctgagtccacacctcaagaatgctggagtggggggactttctggctccacacctgggtttgtcaaggcctcttcgggctgctgggaatgtgccctgcctggggcccgctgctctcctcatcagccctctgacagattaaaacacaacagggtctgttgcctgactgacacattcctctcctgtctgcctctgaaaggactttatttaacagtcctggagtcgggctttgactgacagattgtgaagggtaaaagtcattcagttccattaagctctgtaactgccctggaacaaaacaccttccaaaaaaagtgtcggagggaggggaaaatagagctgtggagagtgggggcatgagctttcgggagaaaaaaagggggtttcttttcaggttcaaaaacaatcctcctctttgccttctgtctatcaattagggcggcattcccagagggaatacaggcccggcctcattggtgtcattcagctgccaatctcctgacagagacaccaaagggcctcatgtagcgctgcggaaactgtctgtcaggccatcagcagctgctatgacgacatcgcctctgtttttctaggactcttatggaggggggagttcaccccaacagagtctcagagtctcgactccaaacctctgttcatattttccttttacaacccatccccagtgtgaatttcttcacaaaaacaacccccggctcccttgcctggctcggctacgaggtaaataatagcttgccagccaaggacatggtcttgggtgtgagaaaggggttctgcttctgggaaaaaccgagtcgtgactgaacacattcaacgactctggctcagatgagtccaaagaaacccgatttgcagtgaaaggtctccatccaccgaaaggcctgcacaggccgcgtgtgaagagcagtgtggccccacagacggcctcctgctcagccttaaccttgtttgggttgctgtgggtttcattcccctggagttttgcttggagcctgaaggctcaagcacagctcaacactttaagccaaactcagcaccaagcaaccacttcccactgctctgtttttctgccttgctccccgctttccccaaggcctgacttacacggctgccttgagtttgccccaaagattcctcagcctcagctgatcacacagaagacccaagagtacaaaggaagggcccgtttacccgagctttctggctggactggggaaaatatctttaccccctccctgccctcaactccctcctgtccactccagattctgcctaagacttggggaggcagatccgggccaccaatggccacctgcaaagatagtggttgtctctgcattctgtaaaggctgtgtttgtgattcctggcatttccctggaagtgttttcacattacagggagctgcttccaaatggtaatgatagcactttgtaccaaactgagagctggagcaagttgctgccaagcccccatggtcgggccatcgtgttgcaacgcttctgcttctattacagttcttcacatgttccacccgaaccgtacaaaatgtttagccaaaccctgtaagaacatgtacataaagctgtctccatgctgccaaggtggtaaagtcgatcttttttcttccttaagtctgaaagctctgctaaggtccaacacttcctgagcataaactccatctggggtggctaaaatctgtctacagggcaatatactgattttagacacccagatgctgggccttggatatgcactacctaaatgaagacactgcctggggaaattcagaattaactagatttttggcactgggagtatatgcagagaggagcaaatggacaggatgatgcgagggagagagaggttgatgtgattgtcaccttcctgctctgcagcctcaggaagacacactcagaagccagccctttgccatctgcatggatagaaatggcaacagtcatgggaggcactgatagttcactaatgagtgaatatttccacattgctttgcaggtctttggttattgcagcacattttcattactgaagcagagaagaaaccaacctaaggaattgggcaggccaccagggatatacacaaagtgctctcacctcctggggcatcaccaaaaagagactttagtcgctggatcaaaggctattgggaacatttcactcaggatgaattatcttgaaaacaccacctggagtagccccaaataagcagatgctttggagctcctggatgctgagtggtggcacagattcccatcctggggctccgtgtcaccatccaatgtctggtaaccccatccattccctttgtatcttccacaaagacttcagatcctcacacttcaggccttccaaaagcttctcaattgaaggcccaatagtctaagatctgaatattgaattgcctttgctggaaagacaactgtctttgtttactgctttctcaagcaattcctggctgtttatgccacctgagattctacatagttctctctggccttgtgttccaacatctattatattaggtactgtgcctctcctgtttttctttccattgtgctagggaagaattaaagggtcctttgagccctcaagacagtgatgtgtatagtattcattgtgtaacatcttatttgatttttttttttctttgaggtggagtcttgctctgttgcccaggctggagagcagtggcgccatctgggcccattgcaagctccacctcctgggttcacgccattctcctgcctcagcctcccaagtagctgagactacaggcgcctgccaccacgcccagctaattttttgtatttttagtagagacggggtttcaccgtgttagccaggatggtctcgatatcctgacctcgtgatccacccgcctcagcctcccaaagtgctgggattacagccgtgagccactgcacctggcccttggttgaatttttatccttacagtatttccccttgactggttacgttgtgggtaatcttcaaccaaacctgttacagtttaattttagctaaataaatagttcctactatttagtaaatatatgtaagtttagacaatttgttcttatttctgtgagtagattcccccccactgtaaattagcttaatcctaattaatcttaattaacattactcaggttcgtattatagcaataaaatacatcataagcaccaccattccatcttttcatttcattcatgcaaactatgaggccaagaaagacatgcttgccatgcacctccccaactcaggaaaattctaattcacaaatataaatacataacatgccacttggtgttggtgttacaacttttagtccatctccagaatgagatagaaagtaaggacttgaatgatcacctagcatccccatggacacaaatcctatgaggatggcgccaatatgttcctcagaatgttatgaatttctaaaatgtcacatatgcccatgtgcaaagatctataaaacttcattattgttacaattatgcaccattttctgttagccacacaaagaaatctcttgataaaacaaaaataactttgaaggacatggtatacagaaagtgtcagaataaccaaaatgattgactgaaaaaaatccaatatatcatccttaaataacaaaactacacagatgagaagtgtgttcttggcacatcaaggaagcatttggaagagctcatttgaatagatgaatggaattgatctattaaaagcacagagacagctgtcagacctcaaaacagtaatgaggctaaattttcccaagttaagactttgatcctcagcaatgatcttagacttgtgatcaaagatacccaggcactttaatcttcactttactttcctaaatcccatggattataatatcatgactttacaagaataatcactatacaggagaagactggctttttaaaaaggaactcagctaagagaagccaagctaaaggtgaagttacctctggttaggaatgtggagtacccagtgccctcttaataacagtggagactataaatctaatccaaatatttatgaagtaccttgtttcttttatatgactggctggtttacaaaatgttgtgccctttaacctccaaactcttgtgttgttcttaaatatagaaggagaaggaatggaaggaaaaaacagagagaataaaggaaaagatgagaaataaagatggttatgcctgtctctcaggttactaaggatcatctttgaaaggtccattcatccactgggttgagaaagccactgagcccaaaggtgggtcagagcagcacccagagagtgctgagccagccacagatgacttttctcaagatgttgacatctgattaatgcttaaacaaagcaatgagaaaaagttttaactttttcacaaatgaaattggtatcatggtgcctccatagcctgaaggaatgaattgtcaaacgaattctgtttcataatctttttttctaacttttaagctttattgccttttatgcatttagaaactgacatcatttatactaaaatgtggttagccttttgtgaagaagcaaattctcactcgacacaatgacttcagccatcctaggaaaacatgcctctaatcaggactgaaagcctagcaccatttgtgtgttgaaaatgaacgtatttcactgaatttcatggtattttttattataactttaacaggagtgggcgttaagaatctttgacagaagatctttgttttagaaggttgctccaaggtccaaacctcagttttcttgcctcacaggcattcatttctttatctactgatgctaagttcacaattcttattcctttccagaccctcctcctctttcctgggaaagatgctttttgaaatatccaagtttcttcaaagactctggaaataaagaactaagagagaagctagctcattctggtttctatttgttccacacaacttgagaatattttaaatgcccaattttctataagaattgattaatacctgacctgtttcctagtcttggtagttaaatatgtgaatgtggaattcttactgtgaatgttgagcggtgataatggtgtaagctacaaactcatgacactgaaagatgccactcctttcttcctaacagtcttgtacaccttggccaagtcactgtcatctccaattcctatccatataacatgaataatatttcatctcagttgtgccatgataaaatgtacttgtagcctattgttgagttcctgggaatgatcttccatgaagccttagtctttcttcttgtttcttctatgatttaggccacagggaaaatcaaaatccaaggtgggagccaaccaagaacctaaaaccaacttctccattctgacatgtttgtaaacatcaagtaaattaaattttttcttcagttcttttagatgtacatttcaccaaaactgagatttttctgctttaaatgcttatctaattggctatttttctgtaacggttcaccactcatgtactcttaaatgggttcaaaaaacatagtgtgcccttaatattggcttgacatttccagttctggtggctaatgtgcagaagtggcttctgtgctaggttgatgcattgccttttctagacaaatgtacttcgtgacatctgacaacagtaacatgattaaaccattgtaacctgagtgtcagttcctcaggggtgctttaaaaatacttgagagtaggatcttacatgtaacagaagaatgcaagcccacactcgcccgactgtaactatcaactaccacacacagaaaagaccagaaacaaataaagctttccttttaggtttggtttagaacatatcccagtaccaaaatttgttttgtattacagtcctctttattactggttttctatacctattagggtataatttcaaattaatttcaatttaaattcaaattaaaaaaataaaaataaaaaactcatttgaaacaaatacaaagcaatagcaaggcgtcactttgaaatcattatgacaccgaggcacaaaaatgtccacttactaattaaccttacgttcgtgtttatagtacacttctgggcaaatctaaaaggttttatttataattatggcatttcccctattgtgaaaagtgtattatctttactataactttattttcatctccattagttaaaaagcaaaggaatgtggcacagaaggcaaaatattttaagacatggaatcaactgtttaaaaatacatacccactaactccagtagcatttataacaacataatggcaagattctagtaacttgtctttggctgttttcagaggtccaatgtgaaatggaaacattgagttcaattatgcagctattttaggtttggttgcttggcttgaatgattaggataattgtcccaattattctctgtactttgtgtgtgcagacccagacctaaaatgtgattgggtgtagagtatctgatgggaagacagaaaacctggattctgtgtttcaatggatccatgattaagcctgtaattttgaacagttgcatcctctatgtgcctcagtttatccatcttacagagaaatagaaatgctattttatcagagcaaatcaagatgattgaacttaaaaattttttcagcagcttttagagaaaatgtcatatgaaaacaaaataatcctatgttagcccagttctcctagaaaacagagctgaagcaggaattccatcccagtgctttctatgggaggtgcaatcccagagcaattaaagtgaaagaaagagaagtgaagcagggaaggataaaaagcaatgcaaagtgatgcatgaatatgctggccattacttcacaatgggcctaaagagacgcaggagtccactgaggaaggaaggagagggaattggtcctccaggttccctcccatctcctgtttgccattgatcaaaacacataccacagggaattatgtccctacacttccaggttgcaccatctggcccctctgacagagccgatgccctgccgagtgtcatttcatcaagtttgggagaatgtgggagaacccgggagctcaggtgtgttaaccaaatggcatcaggctgtagaaagacatgggtccccacagagtttcaacacagcaggagctgagtagggtgagcagctgagagcctggggacagagctgagagaggctgaggaggctcatcagaggcatgcaatgcacacgtggttagccagttggctccctgttataattacagatttggtatatcaataagttacccaagagttaccaaagtgccaatcaatttgcctaagtccactggcccaaaccaaaaactttgcaatttctgactttgaacagctaagttggaatattttctctaaataaatgatttaaatggaaaggataaaatgctaaaaacatagatgattcccaacctttctagaacaaccatgtcactaataggggacagcatggaagagacagcaccgcactaagaattcagcccacattttccttaacaaactaacacaggaacagaaaaccaaataccgcatgttctcacttataagtgggagctaaatgatgagaacacatggacataagaggggaacaacacacacaggggcctacttgagaagatcatgagccagccgggcgtggtggctcacgcctgtaatcgcagcactttgggaggccaaggcaggcggatcacgaggtcaggagatcgagaccatcctgtctgacacggtgaaaccccaactctactaaaaatacaaaatattagccgggcattgtggcgggcacctgtagtcccagctactcgggaggctgaggcaggagaatggtgtgaacctggaaggcggagcttgcagtgagccgagatggtgccactgcactccagcctgggcgacagagcgagactacatctcaaaaacaaaaacaaaaaacatccaaacagcatagaaagtaaagaaaataagctgttaagatgaaggcaggttttcatcacatgaagtagtccaatgtgtttggtaggtatgagtctagggaagtcctaggaggagctgggcaagtagaaagagccaaggagtaaaagaccttgatagagaacacctggtgcttgtctgtctaccatccatactgtctttagagagctgctccttcactgtatgcagtcccagagaggatatcatcactgtccagacacccacagtcatgggggtgagcatgtggctcagatgaagatcattagaacagacattaacgactggtccgggggtgaacacaagatcagagcagggtcaatcaggactttctggattaatgtaaggatatccacttctgggcatgagcaccaggcagttgtattttttttttttttttttttttgagacaaagtctcactccatcgcccaggctggagtgcggtggcacgatcttggctcactgcaacctctgcctcccgggtgcaggtgattctcctgcctcagcttcccgagtagctgggattacaggcacgcaccaccatgcctgtctaatttttttttaatttttagtagagacggggtttcaccatcttggccaggcttgtctcaaacacctgacctcgtgatccgcccacctcggcctcccaaagtgctgggattacaggagtgagacaccacgcccagcctcagacgttgttcttctacaggaaaactcaagttctaggcagagagggcaatggttttttttctgcattacccagcatccattcttccttcttctaataatggttccccaaatatcatttgcggacctatcctcctcctagtctcagtcattacagtttagataggacagactccatgcacagcttcataggcatctaccctaggcccagccaatcagagccacaagattggttcaggagtgcttctgagcccatctcaaccagtctggcagagagaaggtcctctttttcccctctggatttggagctgtaacaatctatgtctaggctagtggcagccacttgtcctcaccagttaaagcatgccagaacaatggagccagtgtggaggaaggtgggactgagaaatggagagactggagccaactaaacatttggttactgagtcaatagcgtccttttttttgtttgtttgtttgttttgatgaaaataatttgagctgagttttcagtacttgcagcagaaagactctgacctgatacagagggatagatacacaggtaatcacaatgcaatgtgataaatcttaatgtgaaaagaaaaataaagtgctttgggagttgtggacagtcagtgttgcttctttggttcttcgttggtaaaatggctcacctgcctagataacaattaaagtgccccccaacctgaccctatgcccacataatctatcattcagggaagatttggctcgttagggcgtctctcctggtatccagaactgctgcacagggaatatgcatgttcacagccatctgtttactagtaaagcagtgctgattcctctgcctccttaaagattccatcgcattattaacatggtaggtcactggttggaaatgcaaacgcatagccaattagtggaagacaaggtgagcttgccaatcgataatcaccacaccacctgttgcgctttgaaaaattacctcacaacattcttgggtccttaggtaaatccttaaacttcatcctgaagaaaatgaatcacatatgtgtcttcctcgccatgggatatgcattggtccgcgtgaagcattgtagctgttctatacaaacatgaaaagcatttgaatacaggggataatgggcatcataaaaggggtaataaaaagcagagttcctggagttgtctcacctagcagtggactctattctgggattcctttcctgtagcgtctacaattatgctattataaataggcacagagtttattcataaaatggcttggtttccttccctcaaccggtagacccttcaaccagggacaggggatcctccacacactgggtgtcatgtggtcaaagggggcttctgcccctcgctctgcaggctgactgcacatttcagatgcagtggaaataaaaactgctgctgccagtgttgctctcaactgagataactgacctctaaccacccacatattccaccctctcagtgcatccatcattctggtcattagacagtaacactgttatccaggtagctacagtcacaactgagagtgtcctttaatgcattcccagtatagactcacacaatgtgactgacatgactaccctgaaaaacaaaaaacaggtaccttacttgtaccttggctctgaggctgggggagccaagcttctacatgagcccctgttagaagccaggtactgtgtcaagtattccacatgcattatcttgttttattctcacgatagtcctataacataaatactctagtatcactgctttacaaagaagagactgaggcacacagacgttagtcaacttgtccaagatcacatagctaacaagtagcagaacctgaattctaacctggaggctgcattcttgccattatgctcaacttccttcccctagctcttcctctttctccacggaggatgcatgtcagtcctgcattcattcctacagcacacccaggttttttcacttgatagattttctcccacaaccccattcacaactcatcatcctccctaacccagagattaaaaagtcaccaataagacaatgtgcttgtaactaagctaacagtgttattcccagtgtattactgggaatatacaaaagtcctatgtgtgtatcattaagcagatattatatatatggagcctgagtgtgtgtgtgtgtgtgtgtgtgtgtgtgtgcgcgcgtgcatttgggtagatttaatacattgaatcctctcaaaaaaagaccttggaagaatgcttctccaaccaacaaatgtttattgcctatctcctatgagattactagatgcttagagcaatcttgacattgtagacatgtaaacaagtaactccaaatagaggggaggataaacaaactctctaaaagttttatcagccaaatcctttggtggcaaagtggaagaacttgaagtataggtaagggttttgaaggaagcagcattttgattaagcctcgaagactgagaaaaattttggtaagtatagaaggggaagaaaaaaaaatccaaggccggcacgatttctcatgcctgtaatcccagcactttgggaggccgaggcgggcagatcacaaggtcaggagatcaagaccatcctgtctaacatggtgaaaccccatttctactaaaaatacaaaatattagccgggcatggtggcgggcgcctgtagtcccagctactcgggaggctgaggcaggagaagggagtgaacccgggaggtggagcttgcagcgagccgatatcgccccatcacactccagcctgggcgatagagtgagactccgtctcaaaaaaaaaagaaagaaagaaagaaaaaaaaatccaaacagcatagaaagtaaagaaaataagctgttaagatgaaggcaggttttcatcgcatgaagtcgtccaatgtgtttggtaggtatgagtctagggaagtcctaggaggagctgggcaagtagaaagagccaaggagtaaaagaccttgatagagaacacctggtgtttgtctgtctaccatccatactgtctttagagagctgctacttcactgtgtgcagtcccagagaggatatcatcactgcccagacacccacagtcatgggggtgagcacgtggctcagacgaagatcattagaacaggcgttaatgacaaagatcatcagaacagacattaacgactggtccgggggtgaacacaagatcagagcagggtcactcagggctttctggattaatgtaaggatatcagaagaaagaaatggctgttttatctgaggttgaaaggatataaatttgaggatgttagcagttatctttcccattttctagaaagatgttgtctgtaaaatgaagctatgacaatgaagaaccgggaaccaagatatagcaaaagacagagagagccctgagagcattatgtgatcccctggacccacctacacctgaagctctagatccttccttggacttttcagttacatgagtcattcaatgcccttttgccttgagctagtttgagctaaaaaagtcctggctagtacagctgtgagtgttatgctgaagagtttggactgattgatataggactggaaagcctctgaaagtcccccattcttaagtggttagagaacagagacacagagtggacagaaagactatgaagagattaaaacctcttatcttcagcctcctaaattcacatgtcacaagatgaacccttaccaaataggagctactcagggctgggaaaaacttcaagtgggcacctggtcttccagcataagaggacatataagcccaacaacatgcctccgtggagctggaagggtctgcttgtggggtaacttcttaccatgccaacaggaccttccaatccatcatgtaagttaagccaataatactacagccacaatagaatgacatactttgctagccaaagcaagatccacacaaaacaatgacgagtttgagctagaaattattcccaatattgttagcaaaatctggatagtagatgtctcaccccagagggtgaaaatacctcaagaggagcaggtgatttctaaggtcaaggaacaaggcctgaaacagcattactgtagcaaatgtgaagggtctggttacctccctgtctgaaacccaagacgtttggaggaaaagaggtgctgaaatatctgcagttggtggtgacacctgagaacctgggtgatcctacctccctacatacaagggcagggatcatgccttttgcttcaaatagctttgaaccttctggcccccctccagccctgattctatctcagagaaaaaagaaaaccactttgctcttaggcccaaggccagggcatcaggttatttgtcactttgaaagtaacctaagatgaaccttatttttcctgaagtaaaacccaaattaaaatgacccctaggtgtactaaataaggagacttctcagcctcccatctgtaattacaagatgaacgcttaccaaataagagctccttgggcctgggaaaaaattcaaatgggcacctgaccttctagcgcctctggataagaaaacatacaagctggccgggcgcagtggctcacgcctgtaatcccagcactttgggaggccaaggtgggtggatcacgaggtcaagagatcgagaccatcctggccaatatggtgaaaccccgtctctactaaaaaaaaaaacacacacacacaaaaattagctgggtgtggtggcatgcacctgtaatcccagctacttgggaggctaaggcaggagaatcgcttgaacccggaggcaaagtttcagtgagccgagattgcgccactgcactccagcctggtgacagagcgaggctccgtctcaaaaaaaaaaaaagagaacatataagccaggcaacgtggctcctcggagctggaagcgactgcctctggggcaacttcctaccgtaaccttacagatttatcatagcaacaaggagactgaaggaggcattgccaggtcataacagaaagcatcccatctcctgggctttgcattctttgcacacctctgcttagtctccaccagcaactccaccactgccttcacagaataaaagacctgggagaagcaagaggccagtcagttgcagcttagcataggggtgctcagcagtgctatggctgcaatggaggttgaggcaagggcagggagcagggagactccagcacctgccatgaccgggctcagaggactcaaagcagatgtttgcagcaataatcttgctgtaatttgaccaattctcagacactcatttttcatattttagtcactctgaaataggggtgcatcttgtaatcagcagtgtgtcatgctttaaagttggcagcacttttgcctttcctggtgatttatgaaatgatggtgtgttttacaattgatggtattgtaggttcaacaaaatatggtacatcaggaccagctgttcacaatgttaaactaaaactctctaacgattccaaagagacatttctattatccaaaagcccattgcagcagtgggagctggagccacaaaaccagaagggatcgcagtgcagcaagagacagaaatgatcggccccactcaatttctcggaagttgcaacataccaaaataaaaagatatggcatatgaaccatttacacttggaaaatgccatattgctggctcctataagaggtcatcagctccagtggacatttcccatcttgaggactgggttgatggcagatggtgacaaaggtggtaaggtaagagagatggtaatttgacagtttccacaataaaacctaacatcaaaattgtactttacagttttcaaacattttcctggaacagcatggtggctcacacctgtaatcccagcactctgagaggctgaggcaggaggatcacttgaggccaggagttcaagaccacctgggaaacagagtaagaccctctctctaattaaaaaaaaaaaaattagaaaaaattttcctgagcattacacgatctcaggcctagctggtggtatcgtcccctttttaaagctgaggaaaatgaaccacaagcagctgggagatttatccaagctcgcacagttagtcgatggagagaagtgactagcctgccgagataaaggatcttgccttaagagccttccactattccacaaaagacaagagaaagacttagtcctgggcagacttttcttcaatcttttcaagtctccgaagtagactaattttcatgctatgtctttttaccagcattccagaaataaaagggtaaggagagttaaaagggtgaatgtatgttttaaatggccatgtgcaaaaatgtctgcacggatcctgataattacatttttagtatgagagataatttgtgccttggtggcacatttttctgattgttaaagtcatacaaatttagaaaataatgaggttcaaactgttgaaagtatttacacaatcaattagcccacagttaataagtgatttcaccgagcaatcagcactaaaaaagcattaaaaggctgtgacagaattcttcccccatggaagcagacagtgcaatttgaagaaaagagaaacattaaaaaatatagtatacaatttggaagggatgagctcaaataaagaaggaaggactatagactggaattgtcaaggcagccttctcagagaaggaaggatttgagatgggccttaaaggatgattaagatttagctcagctgagagggaggtgggtggcattcctgcatctagtaaacaggtgaagaaacaaatgagatgctatataagagcttggcatgtagcagggtgatcagtgagggtcattggggagaaatggaaagaacagcagcctctcaggggtgagcaagggcaaacctggtggaagggggcttgaaaatagagtaaagacagttccaaagggaggttacacaggatcttaaaaccaggctggagtatttgaattttaacctataaataatgagaagctattgaaagtttttgagcggaagaacaggtggtaagaggttttacatagataacttctgcaacatgcctaggaaggaccccattaaaatttttatataaaacaggggtcagggagggtcattgaaatagagaagtccttgtccaaggtggatcctgagatggaaacaaaccattgacttaaatgacaaaccaactgctcagccctcaaagacaaatgacagagattaggctgtctgtgggcatacaagtggaaatgcccaacagtagttgaactatggggtcttgcttcaggagaagggtccaaacacacatagataaagatagagacagacaggaaggtagatttaatagttttccacattaattagtgaaatttttttgttttgttttgtttttgagacagagtctcgctctgtcatccaggctggagtgcaatggcgtgatctcagctcactgcaacctctgcctcctaggttcaagcgattctcttgcctcagcctccagagtagctgggactacaggcacgtgccaccacacccagctaatttttgtatttttagtagagatggggtttcaccatgttgatcaggctggtctcaaactcctgacctcattatccacccgcctcggcctcccagcgcccgcctcagcctcccaaagtgctgggattataggtgtgagccaccgcgcccgtcctaattaatgaattttaacagctagttttatatatgtgtgtgtggatggatggaaagaaagaaggagggagggagggaggaaagaaggggaagggaaggagaagggaagggaagggaagggaaggagaagggaagggaaggggagggaatggaagggaaggggaggggaggggaggggagagagagagagagagagagaaatagagagaaagagaaagagagaaagagaaagaaagaaagaaagaaagaaagaaagaaagaaagaaagaaaagcaagcaagcttgacatttaattttgctcttttttctctctctagtcattcatcctcccaccccttccacagtctagcaccttatctcagtacctttcaacactgaatttttcaaataataacaataagccaccaaaaagacctcaatattgcctatctctgatatgcaagagtattgaagatagaaatacctgctgacactgtgatttgcacaattcttttatttatttatttatttatgtgacaatcatttattgagtgctttccatgtgctaaatactgtgcccagtgctggagatacagcaatcattcattcatttaatacatgtttgtagaatacatactgtgtaaaaagctctgtgcaaagagctgtgtaagtcatggctcctaacttcaaggtaaataaacccctactggtgatatcaatatacatgaagttatcttcttatagggagtacattcacaattccaggctcaaataaagtgttctattccacacacctgggaggcactaaggtctagggaggaaatgaaactcttataactgtcctgagcatgtgagattaacaagtgctcttgtaaaactaaatgccaactgcagagctgcctattggccagtggcctcctcacaggtatttacgtttatttatttgctagatttatcacatttgcaggctgtgccatttggcctcagggtcaaataaatcacttttaaatttttaacatcattcttaagcattgcgtgcccctatatgcccctgacagactttctaaagcctttacaggaacagaattaaatccatttcgcaaataaatacactggaaacagcagggtttaaatgtaccgataagggaaaaaataaattctaggaaaaacctggagataggattgatgtgttctgcagtactttttagatgtggaaaaattcctccccacaaaactggggtttctagctgaccttctagacagtaaaaaaaagaaaaaagaaaaaagacttggggtggcatgtggaattctgtctctcttcttcttggcacacattccttttcaaagatatgtgctccatgaggatttgtcataaggttcaaaaagacagccaaagatcataacaaagtacgtaatggaatggaatagaaatgcatttttaagaaagctggccacgtcatttggaaattcagccgaggtagattctcccatctcccaaagcctaaatctgtctctgggagaaagctaaacatgtagaaaggagaactgactctttgaatattattgtactcacataattaatgttatattaaattatcctttcatatgctcatcaaacatttattgagcactgtactaagaacagatttggtgccacggagtacaaaaaataagacagggtccctgctattaaggagcattcacgcaaattaaaaattaccatatgtatagttaataacaatgtattatatacttgaaaattactgacagtagattttagatgttctcaccacaattaaatgttgcatgtgtagtaacgcatgttaattagcttgatttagccattccataatgtatccatatttcaaaacattgtgttgtgtcatcaacatatacaattatacgtcaatttaaacacaaagaaataattttcatcaccatattacaaatcctacaaaatgttgttacaagagcctgagaaagatgctttatattaggaatgactgtttctttgtcatataatctcagtctagcattctctttttttttctgtgctctatggaaatgacaatatatatttattcgactgtaaagcaacttcatttttccagtatctctttgcttttctccactacctctttcaagtggtgctgacttatcatgactaaattggtttacgatggaaagatgttttgatatttgatctgaaagacgtgtgtatttttgttctgggtataatcttacaccattattttggattaaccgacagactccaaatcccagttgcattggataggtgaccttctgctatataatttctgccactacaatgaactaccaaagaccagaagccatgttttaaaaatctatgattccctaccccacaaaaacaagaatgacaaacaggaattcaataaatatttaataattcagacaagtagtttctagatcttgtcatctcatacaacaagtaaacctgtgttctaagccactgagatttaggcattatttgctactccagaataccttagcttaagccgaccaatacaccagacttcaatatgtaaatatgagtaaatggcaagtgaatgaatatatctgtagtgttttgtttgtttgttttttgagacagagtcttgctctgtcgcccaggctgcgatgcagtggcccaatcgtggctcactgcaactccacctccagggttcaagcaattctcctgtctcagcctcccaagtagctgggactacaggcgtgcaccaccacgcccagctaatttttttatttttagtagagacagagtttcaccatgttggccaggctggttttgaattcctgacctcagatgattcgcccgcctcagcctcccgtggtgctgggattacaggagtgagccaccgtgcatagctgtgtagtttaattaatctattttactggtatcttttcctaattctctgaaaagtctgacagagcgaactttacctctttctattcctccattccctttaaactctgctgtgcatttcaagtgaaatatcatttatccttgttttttattctctcccatgtactgtccctatagtcactgactaagatcctcgaagcctcgaaaaataaaaacactgggaaaaaggaaagatcttccaaagaaaaatgaaagtctctgttgttttgtggttgcaagaccactgccataagaactaataacaatagctgtcatttattgagtggctactttgt

SEQ ID NO: 432 - DNA, 20001 bp, Homo sapiens
tgtatatatgtgtatatatagataagtatacacataagtatatatgcattaatttttataaaatagagatgtaaagtttacttacatttcataatatggaaatatggttatgagaaatggaaaatgctagatggaaaacctcaaatacctttacaggttaaaaatatctttactaaattttcccatgaaaacattttgtgataaaatgacaagggactaaaatgaagatcattgatacaatagagttactttccttgttacaatgcaattgtcttataagtcattattcattttaaggaaaatcaaaaaaattagatcttactaaaaatgtagcatttgattttaagtagcaagatgcaattttgtgttccctttttctttgttacattaacataatatagtagatagagggtttattgtatagacatacacaaaaaaatagtattcttaggccaaattcacacatatctcctcactaagtagttcaattagataatttctggaaaaacatgtttttgacattaattgctatccaaaactatattttaaagcagtcttattggaggtgtccttaacatgatgtaactataaatttgatgcagaaaggttttacatgctgtggttaaatagctttagaagacatttttaagtcaccaccagcctttattcttagaaaacaatttattctaaatgatgatgcatatagaaaaccagtgtattcttttatttcttttaatactggtggcaaaataggacgtgtctggaaaaccataaggctacttgggatactgtcccattagcattgctgtttccatgacaaaccctattttcagatggtttgatttgcctattttttttttaaaccagctataaattggggtcaatttcccccctcacagtgtacttaatttagcttttggagtaaatatataagtagtatgaaagacttctgaagctcttctttctaaaaaagcagttttccacttaagctttgtggggacagagagtcatatttttaatttcagagccagccagtgtcaaacacgtgcaaaagagccgggccggattttttcagcttgtcctatggtagtcacttgtcagcctgagtttactggcctggtccttttgtctccactgtaagtactgaagccttctggtgtagttgtatcaccttaatgtccagcatttaactaggaaaggagactacaatgaagagttggtggccaattaagaaaaataatagactacatcataaatcatttcaggacttgagtggccgcagatcactgtccctgatagcatgtttcaaccttggtatacattttttttaagatgcatatttactgtgtgtgcttttgctttctaatccatctattgactattggccacaatttatataatgcacatgcaattaattgaaacctgtgtcatggcattggatatctctgattcatttcttattataatagtctgtgtaactggggcctgagagattagaagcaaaatgtagtcgtacgtatgtctagaggtggacgctggtgatattgtcattgaatactttgcagaatacactaatgtcaaaggcttgcaggattaatgtgtaggaaccaacataagacatggaatatatataagaattatctagttacatgactaaaaaggaattgcaatactatcttaaattgaaggcttttatttcaatgtccttacatttaaaatgggatcttacaagggaagtaccaaaaaagtaaagtttattttgatgactctcaagatatatatgtttgttttgaatgttggcagatgccaatagcccttaacatttgaaaaatggtacttgaacatcaattatgtctcagagttcccttaaactttttgggcttaaatatttttattcattttggtcatacctttgacaatggatatgttaaactttaacaattatagtgacaaaacagcttgcttagaacctggaaattaaaacacaatttctagagtaatttttctaagttgtatcatgttttgtggtgacaaatgtctctactccattacagaatcaagttgctattcaaatataatacttcctctggggatctttgtttataggttggtttgggaccctaataacaggtcaaacaaaagggtttctcaaagaaatttttctaataatatataagttcaaatacaatttataagtacatgtacacaatgaacatataataagtattctgtgggtcatcgtcagttttatgagtcaagcagatccttaaattgcttgaaagaataagatacaattttccaaaagagattaagtaaactatttcattggtattctaaagaggtgtatttttgaatgataaaatgtaaataacactgcattttcttgaggtattattaatacactagttgaatggcatatttgtgtgactagtaattctaaaagcaaagtattaaaatagcaatgatttgtacattttacacacacattttttaaaagatgaaattgacttacctgaaaacaatagtttttgttttaaaatttagatgtgtattttataaaaaagacctcaagaaatttcattcatagtatagactttcaaaacatgttcatagcaatacagtgattaacatgaaaaggaatcactgttgctgctttgatatagttctctgtggcctggattttctttctttcctttttaaaaaccaagtatcctctaatttgtggatatctccatgtttcagatctcagtacctgtttgaattaaatttgcaggggaataactgcgggatccccccatagacaaagtgtggcctttatttcctttcaagttggcagtgtgtccttgcttaaatgaagcactctgaggcagactgttctcttgctcttggaaatgcttgtctttacaattgcagtagcaaatacctggaagtcatacaggctagttagatacatattctaaatgtcatgtgctgcttgatcattgtaaggattttttttcttaaaaagtagatttggggactattcttgaccttatctttccaactcttggaaatattttaaaaagttaacttcaccaaatattctgtcaaaaactgtaggcccctcagatagaatgaccaactgtccaggtttgcccagggctgggagttttcttggcatgtgggaattttaagtagtaaaaccaggaaagtcctgggcaaactgggatgactggaaaccctattccatggattaaattgtgctctcacaaaaatagagtaaaagcttacatgttggtctctggtccagcattgaaagtactccacagtggctgtagccttcttaattaccagattaaaagtcaatgaacacagccctttgtaactggtcttcatagtaccaatcaacagaagctgagtggaccatgaagataaaatggaacaaactaccttgattatcttggccattccacctttagcctttgcctcccgaagaaatgggacataggtgtaggcttccaactagccactgaaccctgttcatgaaatcaggttaaatggctgcttttagaaaaggctctcaaaaagtattcccttggaataaatcattgttttgtaaaaaattgatgttaaattttaccagattgtaagtaactatcaggctgctgcatgtgtgtgtgtgtgtgtgtgtgtgtgtgtgtatgtatgtacatatatataattgtatatgtacatatatatttgtataataaagcaatacattaggatgagattataaactcaagcagagatttccccaaatggctgtacagcaacagtttatataattattatacttttttccaaggtaagtagggttaacacccatatctttcctcaaattaaaagttgtatctacaaaaaggaaaaagtaaactaagtcttaaaaattatactgtgattattgaaaattgtagaatacattttgtggaccgtgcaatccttcacaatggatttcacgatgggtttccctggaaatgtgaatgtagaccttcacgtttctacatgaaactcttccatcagaattggttcacttcttttttgagcttactgtcatccttcttgtaaatgcacatgcagtttcactgcctttattgttgaaaccacaatactattcttgctatctcttaattaaactcaatgtaaatgaattttaaaagacacataggtaatgtaattattgcaagaggtacctacacattagactctagagctaattctcaatatgggacaattttgttctctaggagacatttggcaatattgggacacatatttgactctcataactgagcactgaagggtgctgttttagtctgctttgcatagctataaagagatacctgagaccaggtaatttataaagaaaagaggtttatttggctcacgtttctgcaggctgcataagaagcatggtgccaacatctacttctagtccacacctcaggaagactttactcatggtggaaggcaaagggggtgcaggcctgtcacctggcaagaaagggagcaagagagagggaggtgccaaactcttttaaacagccagatctcctggtaactaacagagtgagcactggctcattaccagagaagggcaccaagacattcatgaaggatccacccccatgaccctaacaccacccaccaggccccacctctaacactggggatcacatttcaacataatatttgggggggaaaatcacccaaactatatcaggtgctatgggcctttaatgcgtagaggccaagggtgctgctaaacattctagaatgcacaggacagcccatgacaatgaattatcttatccaaagtgccaaagttgagagaccttgctttggaggagtgattaaaattgcaaatatactttttaaaatagtgaaatatattgaatttataaaatacaattgagaaaaatatggatttactgtgtatacaacatgggctttatttttatctttatttttttgagacagagtctctctctgtccctcgagctggagtgcaatggtgcgatcacaactcactgcaacctgcctcctgggctcaagtgatcctctcacctcagccttctaagtagctgggtctacaagcatgcaccaccacactcggctagttttttaaactttttgtagagatgaggtctcactgtattgcctaggctggtcttgaactcgtggtctcaagtgatcctcctgccttggcctcataatgctgatattataggattgagccaccatgcctggtgggctttacttttgacctgcaaattttcttttagattgatgaatagcctgataatattgcatggtgtccaaagtcttttggcctgttttgacaaaatactgtagacttggtggcttaaacaactgacaattttcacagtcctggaggctgagaagtccaagatcaagatgccaacagattcagttcctggtgagggcctgcttcctggcttgcagacagctcttgtggctttgtgttcccatggcctttcctcagtgcatgcaggtggagagagaaaaccattgtcttcctttccttttaaggacactaaccccatcatgagagttccaccctcatgacctcatctcagccttattaccttccaaaggctccatctccaagcactatcatattgagggttaggctttaacatgcatttgggggggacataaatattcaactcatagcaggcaataaaataaaacttttattattcaaatctagacagggacatacggtatcataatttcagtgggaaaaatctgtaaataacattaagcaagtttaaaaaaaatctctgaaaggcatttagtagtattatgctgttatacttcatattctacacttccattttcttttacacatttccctgcatcatcacaggtgttatggtatggggaaaaactctggcctaggagacagaaaacctgggttctagtcttgatttatttggttaagggaccttgagtgagtctgacccacaggacctaatgaatcaaatagagacaataatgaagtaatagatataaaagccccattataaatggtgaagctctgtaaaaatgtgagaattatcattcacgttaagctaattaaggaggaagttgaggatctgaaggcttctgctcagcattgactgcctcccctttagaaaacgaagttccagtcactgaagggccgcaggatgactggagacctttctgttgtcttcctagtcacctcttctctgatttcatcaccacacttgagttctcctgtgtacacctggaatattttctgtttaagttttttccagacctggtaaatttcatatgaattagtctgcagtacagctactatggcattggagagggggctaagtcctagttagaagaaagaaggcccctcttctgaaagggctggaatggagcaagaattattacaggagtgttctgaggtcagaggagagtggggcttaagagtatgtatgttccaggtccaaatgtggcaaattcacagacagaccttctgggttgagagtcctcacagagtgggacagtgcccaggagctgtgttgcttcatttgttcattgacaagttggggtagatgtgagcatcttgccgggagaggggaggctcatgtcctacaggtagacaagttggggtcattttgctttggaagggagaaaaagggaagggatataatgaaaaccaaagtcaactactctttcctggggctagcccaggtgggagtgagtagaggaattgaatggaaacatctctcaaatagagacataaccttggattttaaatatgacctttcctcctcctcctctaaaaaggaaacaaatttcaagataatagagaattggacagagaagtcgaatgtcatctcggaaagaatcttggacttgcaagaactggcttgaatcccaaccagctcttagcctcaaatccatttacctaaaatagtaataataatcatttttcactaattcaggtctgttgggggaatcaaagaaatgaagtacataatgacatttttagcactagagtcagctacacatcttagtcttcttcaccttgcatatttcttttctctcttcctcttctccctgttcttctccccccttcctcctttctgtctcttctttcctccacctccctctctcactcctcctgcttctatcactcacccttactgctgatgtgacttgaaaaggcataaagcaaactaatgccatatttttcctgcatctcttttcaggctaagcatgttttacaagacttatttacacaaaaaattaagataatgggcaaccttaaggttaaatgacacaaatgtactttattaatcaaccggtgatgttgctcttaaagcataagtgcatctctatgcattaatgtatgctttgggatatgctatagtcacacgctacatcgtgatgtttcagtcaatgacagaccacatatatgatggtgggcccataagattataatacagtatttttgctgttccttttctactttaagatatacaaatactcaccattgtgttatggtattcagtacagtacagtaacatgctatacaggcttgtagcctaggagcaataggctataccatatagcttaggtgtgtaaggaggctatgccatctaggttgaagtaagtacactctatggtgttctcactgtgttgaaattgctaatgatgtgtttcacagcacatatccccatcattaagagatgcatgactgtatagtagttccctccttatctgtggttttgctttctgaggtttcagttacccaaaatcaaccacagtcctaaaataggtaagtactatacaatacactaagatattttgtgagagaccacattcatataccttgatagtatattgtcataattgttctattttattattagtcattgttgttgatctctttgtgtgcctaatttataaattaaacttcattcatcatagatacatatagaaaagaacataatatgtatggagctcagtactataccatttcaagtatccactgggagccttggaatgtatcccctatggataaggcggaactactaattaaatttcaatttaatttctttacaacccctaacaaattgacctaattggtaggttttatacttgagtaacatggaaacagctctttgaggccactctaattcatgaccaggaagtgattcataatttcccttcagaaatatactcctctactggattgataacaaatcgaacaattataagaatcctttgtttgtccttgttgactatattgccaaagggagcttacttcacagcaattatgaaaatgttcctttgatacaactgatatggactgaacatattttgatgcatgaagttgagcaggattgagggcttatatcaaagagattgattagtaattgtattatttcctcatataagaatagctagccattttggtgccttggtcacctctgtgatctagtgtattagttttctattgctgctgcaacaaattactaaaaacttgaaaaatacacatttatcatcttacagttctataagtgagaagcctggcacctgtctcactgggctagaatcaaggtgttgcattgttatgtttctttctgggggctctaagggagaatctgttctgtactttttccagctttatttcctctattctggaggcttattccatagcttgtgacacagttttcctgtcttcaaagccagcaacattgggtcaagctctttctgtctgattctctccatttggaaatacttgcctgcttttaaagactcatgattagatcaatacaggataattccccatctcaaggttactagccttaatgacatctgcaaaatacctcttgccatgtaaggtaacgtattcataggttccaaggatgagggcatacacattgctgggggccattattctatctgccacatctatgtttagctgttggagctagaaaatttttcttttagaagtattccttccacattctcattctttacgattacttttttttttaagtggattcctgaatttcttcagttcccatttcattctttcaaagtatgtttctgtcagtggtcaattccccattgatttcccctctccttttaccccattttctgttaagaggtctgcagatcagtccttgtgctctacctgatttctttgtatttcagatgtcatctttcttcctcgtctttgcacatattctctggattgctaccctttttgttactctatatgtcttttcaatacacatttctctaaattcatattttgtgtctgtcccagaaatagatcagaaaaagatggagattgactgatgtcaacctttttctcccaagtgaacacatataaccccactgtttttttttaagctacagatgatataattgtatggctttcatcagaagcacatctgtcaagtgattacatttttgctctttagtgaggggctggatgggagcgagagttgatatagttaatctcatctccgattaatctagtatgtatctctagctgtgattatagattttaattcttcatgaagttaccatcatatttatagagacaatctttttctcattatctttaatttaaacattttgtcaaaaaagaaaagaaatctcaattgcctgggttgcattttatacaaattcagataatgaatacacctgccttagtttaaaatgttgtgttgacatttttggagaataaattttcctggcattacaaatgcatccttaaaaatgttctctaaaatgtaatttttaatccatactaaaaaccaactgcaagtttttttcttctatctacactgttacggctggaagtgtatattttcctccatatatataaatctatatatatatatatatatataaatctttctgaaaatatatgcctcttaaagcaattatttaagaagaagattccaaatgttcatagttctccccgaatatacattatttttaagaatgtgattttggagaaattacacagaaatatatcaaaatttctataaatcaataataagttagcatatgcagttatcttttaataccaccatcctttatattcttctaaaattttacatcattcatcttctttatagcttttttcccaaggaggcataattcaggaatagaccagaggtcacttgaatgtagtaatggctctataaataaagaatatgtattttaataatatacagcttcattagagacaaactgaattaatgtaggagttgtagggtgtgtttgtagacctcagataagactggttacgatggggatatttattcaatgctaactaaaataaaatcagatgatcttcaaaatatacggtatttatcagaggtgacaatgggttactaggaattcttaaaattgaatgtgcgtaaaaatcactcagagagcacgttaacaatgaggatttctggcctcattttcagaggtgctgattttgttggccagggaagaggttcgggaacctccattctggtgattctgatgctggatgttcttgagttctctttgaaacactggattaaaacacaacttcaagataaacccctagcgatttgtctcaccagcaaactccctcttataaacatgttgtggaacttcaccagtgaagtgaagctatgagaaccagctttacagaatcctcagtagggagcagatctgttctgtccacatggtctttgtccctaaaggtctaaatcagaaacagtcaagtggccaaggccactgagtggtttactcaggtctaaaattcttttaaaattattagctttttttttttaagggaggaggttgaattccacaactagagattaacttagaattatccctttagtaagaagactttcagagtagtatcagttaactgacccctaaacagtgaaggagaaggatacagattctctcttgcttagatagggctctgacaacagccacagagagggagatagtgcagcaggtggcagcttgatgtgcaggcagaggagggacttaaaaggctcctggtattccccagcgtgggcctctttgctttcagtggggctgccatttgcagaagaagctgtgcatagagacttctcaggcagctcagcttcccaacctttctgagtattttgtttgtttaggtttttaatacatctgacttcttaaaagtcccttccttcccagggaattcactaatcaaggtattactctatttatttccataaacaaatccttatgaaagaattcattcattaatcaagaaatgtgatcatttccactgttgtacccaagagcttcaaagcaccattgttgttcgcatcagttaatccaggtaactgggaaatgtgagtaagacaggactaaaatatatcccaactgattttacaagattaaaaaaaaaaatctaagatatctaaactcatgttgtcttaagcatgttaagaatgtaaagaatgttaattcttcataggaaagaatcacagcacagaggaaaagactgccaaatctttttagaataaaataattttattctagaacttactgtaccttggaaagtttcaagcagccccttcctttgtactgtgtaatatactggaaagatacacctcctccaggtatgtaggatgccatgttagagtctagctagggactctagctagggagtatggaaaacaatttttgattttttaaaattaaaatgtttatgtgaataaacattttgcatagtgtttatataaacattttaatgatgtgtaaattagtctatgaatgatggatgttgaatttcaaagataaatatttattgatgtaattaattacttatacatagtattaatacttaattcagagggcagttcatgactaataaaaaaaagagttggctattagatggtcatttaggagcaattccttccaaatagcaaattttgctaatttcaaggctaaggcacatgcatttttaaatgagattttcaaagaaagttaaaacagcacttgaattaagtagaggtgattgaagtgataatcaagtaaaacctttatcaagaaaataaaattgacccatcccccacacattccacctacccaactaattaaaaaaaatttttttttactgagatacaattcatacaccataaaatttaaaaataagattttgtagtttttagtattccaaaaagttgtacaatactcacaactacctaactccagaatattttatcacactaaaaagaaaccctgacccattaggaagcactcctcatttctccctcccccaccctctggcaactactgatctagtttttgtcagtgtggatgtgactattctggatatatcaaataaagagagtcatacatgtggcttttgtgcctgacttctttcacttatcagaatgttttccagacttgcacaggtttgagcatgtgtcagtacttcattcctttttatggctaaataatactccattgtataaatatagcacattgcttacctacttattcctacttattcattaatagatacttgggttgttgctattttgagctattatgaatagtgctgccatgagcattgtgtgcaagcttttgtgtgaatatattattttaattctcttgcatatacacttaggggtggtactgggtcgtatggtaactttatgtttaattttttgaggaactgctaaactgttttaacaaagtgtcttcaattattttgtattcccatcaacaatgtgtgagggttccagtttctccgcatccttgccaacgcttgttattgtctgtctttttgattatagctgttttaatgagcacgaaatggtatctcactgtggttttgctttgcagtttgcttcttgtcaatattctgaaactgattccatggtagaagggaggggagttcatgatggtttttatacctctgaataaactgaaaaaggggtgattctagaattagttagattcattgcttacctatatatttatataccactccattaaaaaagccttcatatggttcatcataatgcattgtataacataaatgtaaaaatatattagagtattagctgagtagaaaatatagataaggtaacttgtaatatgctatgggcatattataaggttttttatactagccagaggtgggctaaaattttgtctttgaacttcctaggagccaaactgaaatgataaattgaaaactccatagtgctcataagattaaaaacaagttagagtccattgctgactattgtggagtcattatctattctctgcatgagcccaccaatatcaacaggaccctgaatcttgacacattccttcccattgctgactattctggttgatagaagggttaaaatcagcctgtcacatccatctgttagtaccatgtctgctccttggaacctttctcaatagatatgttaccctactttctatcagcagcagtgcagttatttgaaagtataaggcacctgtaaaaccttgactgttccttctccaagctgaacactcactcttcttatgagaagcatcagatggctccccattttctaaagatttaggtccaaacttgctggcccctgttgggtcctttagccccatttcccctcagcccctcatgaaatccaggcacactggactcactgttcattttgcctggcaggtccttgtctcctccattccctgttcccttaccactgaggaaatttgaacaccactcttcaagggccaaattcagatgttatcttttcctggtaggttcttaatacccccaggcagaattaattttcttttctctgtgttcccatagcacttttaaagcagcaattgtatgaatacatcctagtgatttgttcatgtgtccatcttccccagtagaccgtgatcagtttcacaggagaaaactgtcttttttatatcctcagtgcccagcacaaagcaaatactcaacaaagggtagttgcatcaaattgacttaataaatcattcctgacttctcactctcctgtaaacatgtgggtttgtcactgtctctctttaaaagtgacccccagaaggaaaaatcttctttcagatgttagcccatcaatgtgctaaacacccatctgctctggaaattatatatttctattaatgtcacctcaggctgcatgggttttgttcatagacacattcactatagcatcccagaaaactttgctgaatattgtgattatttcccccctgggcaaaccactaacagactagattttcctttgcttctactttcttatctaaaagtaagtccttatatgtatccttgatacatttaatattgtttcccactaaaaaagataacttcatccttttgaactaaaacagtacatttcagttttgattctatcatctgttatatccactctctcttccagtttgatgtcacctgtgtatggaaagataatgtgaaatatgtgcatttgccttcttaataattattaagtgtttagtaaacaaagaaaaaatatgcagtacatctatttattgggaagtttttgttgtacttctagaatccaagattctaaaatatcaccatcaaaccttccaaagatgcatggagatattctttagatagctttggggaaaacatgttatcattaaatatatgtgtctctgtctgatatgtttctaaaccccacagagcctcttatgtgcccctgctatgcactcatgtagcatcctgtaccttcattatcataaaacttgttacagtttatgtaacagcttatataattgtctctcctcctttctagtctactaatttctgttttactcaataccccaaaagcttagtacattacctggttaaaattttatttgagtcaaatctactttagatcaataatgtaatatgtataaatactatattattttgtgtggttcaacactgaatcggtaactaaaaagagggttcctgatatttcaaagtagccagagacattatttcagggacagctgaggcagtcagcagattaaattatctatctgatagtaccatttcaagtttaccataaacaaattgccttagtccgctttgtgttgctataacagaatgcctgaggctgattaattcataaagaaaaggggtttattcagttcatggtctgtagcctgggaagttgaagaagcatggcacctgcatctgctcagcttctggtgagggcttttcatgctgtaggacaacatggcagaaagttaaagaggaaatggacacatagaaagaggcaaaaccctaggggcatcttggctttataacaacccactttctcaggaagtaatccattcctgttagaaataattcagtctcaaaaaaagtgagaactcaccccaagaacagcaccaagccattcatgagggatctgccccccctgacccaaacccctcccatcagccccacctcctgacatcactacattggacaccaaatttcaacatgagttttggtgggaaccaaccacatccaaaccatagtgctaatcaaataatgacttacatttagcaaaatttaaaatctcccaaaatatagactgtaatactttatcaataaacagtattaatttaatcattccaaggtttattagtatttgttgccctgaaacttctatagaactctaggctgcaatgctaaatcaactgggagatcttaggcactattcaagaggtttcatccctgaagcactgaaaagatcttattagaagccactcacaccatgaagaaggtcccacagcaggaagtctaaggagagtgttatggtgagatttcagtaaaatttggtttttaaaaattccactctgcaatacatccccatgatataaatattcctaattaccacagaatttcagttccttcatacaaaatgctgcattgcaatttagggctgcttaaaattatcttaacttgtcccatttggcaaactaagccagggtcttaggaaatgtggagcttatagtatgcagcaatgtgggcagctttgagagctccctccttccggatctgaaagagcctttttgttgaccctacactgaattcttatgtttgaatgtatcaccgggatgcaacagtcagcttctgggctaaatggcaagagaaacttctggaacaccaagacagaaaaatgtaaagtgaaaattatcaaaactaaagtttttctgatatggtttgctgtttaatgtacattcagttaagcagctccaaagaaaagtaggttttctgttagcaaatgctgaagacacaaaaataccattcctgtctgctttctttcttgttggttagctattggatgccatgaaaaataaaatatgtctctatttcctgagcccacccaatattttaaatatcttgacatctatatttatgttctgtcgaaaaggtaataatacgaaggatttattataagtcctgagctttcttcttcgaatcacagcagcaattattaaggattcacatgcacatggcattgagtctgtgctatgacgtagtcttgtttgccagaaattgacagttgaaaagtgaccccattaggcaagaaagatttttcctccttctcctaccaccataacaaataaagtacaagaagtaagaaaatgaataaacattacactaataaaacgccacagagactggaaaactgtgaagaaaatgtggaagagggaggggaaaagataaagaggaagcggaccattaatataaatagattttaaaaatgattgcatgtggcaaatgagatcacactgtgagtcaaacatgcctttgtatctacaacactgccagaattctcttttaatgaggaccaaggcatctcctggggaataacttaccttaggccagagtcaaatccctccagcttggtggaagatcagtgctcaactttcaggagtgggatgtacaccaatagtacccgtggatctacccttaaagccaactaagaaggcagcctgagaatgaacactgaaagggctgttttcataaaaaatctgtaagagatttttcttttttcttttactttttattttaatgaaaatctttggcatgctgtgccactacattgataaaatgcaccatgaaaagtgccctacttcattggagaattcattatgacttcgtggagcagaaagagttggctcattggcagcaatttgagtggatttggttcgctggaggtatcatgttactgcgtcatcagtgcaggtggggctgactggctttgacagtaaaaggaggtggcccagtgccaacaggggcagcagaggggctgcaggagtgccttcatagatgccgcacagatgctgcacactgccagagcaaatctcagggaaggaaagatggggcgtcatacagtgattgtgaagattatgctcttgagcacatgtgaaacacctttcggagctcctgaatttagtaggcaagggtgaattttgagaatagactgaaagagttaaccatagttaagcctgcctggggtgtaggttatgaatagagtaacatgtaatttattgtacaaacagagatgcctttgaaaatgaaggatttgctactaataattacaccaagacaacagatataaactatgactgccctggacaaactggaatgcattgtcacactatgagggactgtcaccttcgattgttagttttgccatgcttgctcttttattctaaccatgtactgttttaaaatcagaaaaatataagacactataatttaccagaagaaataaaaatcgagtacgagggcaaagatagcagcataatgtttacattgttagggtgaccctagtccccccaaccatcatccccctcctgaccccacatcacagtttagaaaattacatctgcaaattattcaacatccactggcgaccccagagcagcctaccttccttagcaaggccatgctgtcccagcagttctgatgtgccctcactttagttatttgattttctgctttttctctctgagatagtagccttccaaggttcaaagggacatttgaatgttaaaagcctggaggtaaagtttacaaacacaatgcttcctcatcacagctggccacatcagtcctgtcaaaatgctaatggtagaatgtttctttataaatagagtacccatgagatcaagatcttaatttactttgttcctaattcacaaagggaagttgccttcttttttaaaactaagttgaggttctgtctttagtaaattcttacatgtagctggaaatttccattgcaaagtgtacttgttttgttttaagctctttccaagtgactttataacttttttaacgttttggcgtcggcactcttcctctgtccacagagctggtaaagacagaattatgaactcttctggcgttgtcccagcccacttcttggagcctttatgagagaagaagtttggcaactcacctcccagtgcccacaggggtgcaaatgaagctggagctgaagccatctatgagagcagctggactgccagtccaatgactataactctgatagctccacacaagttgagaagcagcttttcagctgtgacaggcaaggcccagcaggggaagtagctcactgtctggtttgatttaagatcactgccaaaaaattttcttcattaacttcacagttatctaagctctatgaaggcaggggtttttgtgttttgcttataggagtatgctcagggcctagaacagtgcctgggttatagtaggagctcaaaaatatttgtcgaataaaagcatatttcttcaccttcaaaatgtcaagatgggatattaataaaacctgtatccaggactgatagtcagctgatttccattctgatatatcatttcagtgtcacaggattgttgtggtgattgtatgaattaaaacatgaattaaagcacttacaataaaacctgacacatatcaagtggttaataaatgtcagctgccatcaatttcaaggcacagaggttgacaccgaggaagattggggaacactgtaggatcccagcagggggcactcctgagttcaagaagcaataactggttcctgctgggtcctacttgactatggggaaggacagttgccaatgatgctgtagtccttgcttcatgggcccaggcttacacctggccagaggtcatacattaacttgtcatcaataaatggcatttatgccatctgcacatggatactgttctcttagtgaggagatggcaaagttctgaaagaatggatcacagggcagataagttttatcagagcgtgggacagtgcccaagaagggatagcccaatactgccagggtggggcactttggaggagagtggctaagagtgagtggcacggggagcagggtgtaagcagaataggtaggggggctctgccactaaaatatctattgactacccaggaataaaatgtgttacaaagatgagaagctcaacagtattctcagaaggcttttcaacttaatttccctgttccttttcctaattagaaccttgatcaatttaggatacagtatatggtactctttggttaggtttatgtgtatgtaagaatcaggtcaattgtagaaggttaaactggattagaatgtatactatttgtgcatttggtaacaataattcttatacttcccatttgtataatgcattgtatatattatatacagataataatctatattatatagaggttatattatatatagatttctatatataatctactttgttactatatataatctatatacattacatataaaatctattttgttacaataactctgtgaggtttataggggatgtagtatgaactctatttaacatgtgtagaaaataaggcatgaagaattaagaggcaaggatagtggtaaaagtccctggggatgggaaatggcat

SEQ ID NO: 433 - DNA, 20001 bp, Homo sapiens
caaacctgccattctctgatccattatacacatctcccctgggtttattctcacaacctttgttctgaaattccatttgaaggctttttccatcctaaaaccagtgggggacaggcgggaattgtaaaacactcagaagataataaattgccctttttcctgtgctttttctcagaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccacactaagtcattattttgtatcatttttaaagtaaatttattcttaggtcagattcactcagcatattttgactaagtaaccactgtacttagtaaaccgaagagcttctgagaattatagtgtaccttatagatatttttaacatttatatttgtataaagctaaagaaagccttacatatcctttaaactgactatagaagaaaatgatacagaattttgcctgcataaagtacacaggactattcttgcctacaatatgctttttcacaagcaaaatgttagactaatataaggcatctttggccattttatagtgtacatcatctctatttctgaggcctcattgttagctgtaacgcaagtagcatttgtgcaataaaatgaactatttgggatgggagggtacattttttagaactttgctttgggttgccttgataattaatagcatatagtccatttatgcagctaagtagggattgcttcttagtacagtcaggaagaatttagcccagaaaacaattatttcaatggccactgacccaaacttccaggctgaagagcaatggcgtgatcatggctcactgcacctccacctcccaggctcaagtgattctcctgcctcagcctcccaagtagatggtactacaagcacacgccactgcacccagctaatttttgtattttttgtagagatgggggtttcaccatgttgcccaggctggtcttaaattcctggcctcaagtgtctgccccccttggcctcccaaagtgctggaattacaggcatgagccaccatgtccagccttgacccaaacttttattgtcagttagctattggggcttctggagtttgggtctcccctgacaggagggggctccccagttcacacttggccactgcccatcaattcctgttgatatgatcaacaagatagacaattgcaaatgttgctgaggatgtggagaagtgtgaacctgtgtaagtggctgatgggaatgtaaaatggcacagccactatggagaacaatttggtagtatttccaaagttaagcatagagtttaacccatatgacccagcaattccactcctagatatatacccaagagaaatgaaaacacagatccacaaagatttgcacacacaggttcatagcagcattaatcagattagtcccaaagtggacaacccaaatgtccatgaacttgtgaaagagataagcaaaatgtgacaaattcacataataaaatattattcagaagtaaaaagaacaagcagcagatatatgatacaacacgatgagccttgaaaacgtttagccatatgaaagaaaccagatgcaaaatggaaccatgggcttaggggaggagaacggcacaatggtgtaaaagttgcagagaggaacaaaaaggctacctgcctcgctcccaggccaagtaacacaggaggaaagaaaatatccacatatgcgagggctaaaggaaagaggtgttctcaagctgaagcaggaggtgggactcaactctggaggtgggcctcacacactgtaccaaattgaggactagctaaaacagggatgggggtgaaagcaccttttcgtaagacatgcccaccattgtcccgttctcctcccttaagcccttgtcttgctcatgtcagcaagcttattgccatctattcttcctagttacagacatctgtggagctctgagttttttgcctaatcattattttagaacctggttcactctctctcccttctacactagttctgtcattattattactgatttcagtacctctgaggtgatagattttattttccaatggcagccacaacactacctcccattctatatgttcccctgcaatgttgccttgacatccctattaagagttggaatctagtcaccccgcttttctagtctccccactcctttgaacttgtgtgggccctaagattgcttctactagtagaatagaactaaaatgaccctggaccagtgtggggtgcagcccttaactggcctggcagcttctgcttttggttccttggggcactcactcttgggaaacttccctttggaactcagcattcatgatgcgggaagttgaagccacatgaaaagagcatatggtggttctctcagctcccagccaacaaccagtctcgactgtcagccatgtgagtgaggcatcttggacctccggccagttgagtgttcagaagactgcagctcgagctggcatctggatgcaaccacatgagagacgctctgcccagccaagcccagccaactcacagtactatgagagatactaataacttgttgttgttgttgttgttgttgtttttattattaaactttaagttttagcatacacgtgcacaacgtgcaggttagttacatatgtatacctgggccatgttggtgtgctgcacccagtaactcgtcatttaacattaggtatatctccaaatgctatccctcccccctccctaagtttttaggagtttgctttgcaacgatagatagttgaaacatctggatgatgcatccagtattctggcttctcactgcctttacctcctctctcccatggccttgtcttctaaatctacctttacatagaaacattcagtcacgtgctatactatatcatgccattactaataactcataaactcaatttcaacttctcccttctttgactaccacatgctatctttttactttaatcagtctagtgctctcagttcaacagctcctcaactgccccaggacctccaatacattgatctattcatccctcatttcctttcttagcctcactttgatccgtactcagcttagatttcaaggcccaaggttattattactccagtgccaaaactctaaagagctgtgcttctctcaccctcaactgagctcttcagggcaaaacataaaccctgaatatatccaaattgccactcaactccataactgcatctgagcagcagaatgtgataggtaacacacccatgcacacacagccctgctgcccctcactttaccgcctcactccatggctcccttacagctgcccagcagtcctcctacatttccctggtccaaacaggcctcactctccaagatgatgatttaatctcagacctctaataacttctcacctctctctacactcacctgattgccttatttactgagaatacaggggcaatcataaagctctatgtgcttcactcttaaatctatccatctccctgctcctgtgtccatacactctgttttcccttctgatataagagacgttttccctctttctacctctgaccaattcttgcataaaaagatcttgaaggagaaggaagtccttttctcctactcaaagacattgctctggagttgttcctgttctctcctgctcctcagttttcacctcctactggatcattctaacagcaaacaaaaatgtatacttcccacttaaaaacaaattaaaacttgcttgaacccacttccatctccaccttcctttttttttttttgtgatagagtcttactcttttgcccaggctggagtgcagtagcacgatctcagctcactgcaacctctacctccctgattcaagcaattctcctgcctcagcctcctgagaaggtgggattgcaggcatgttgccaccacacccggctaatttttttcgtattttaagtagagatggggttttgccatgttggccaggccgggctcgaactcctgacctcaagtgatccatccatcttggcttcccaaagtgctgcgattataggtgtgagccaccacacccggccttatgctcctctttatagcaattgcttaatctctactaatggtttctacttcccctcgcaatcctcgaacaaagtctgatcaagccactttcaatctaccagacttattgtttctaagcttactgatgaataccatggcagtaaacccaatggtcgattctcctttgtcttcttacttgacttccctgtgtaatttgagccaggttgcttttcccttgaaacgatttttcactggtctcttaggactccactgtttgctaccctctttctcccattagctattccttctcactctttgttgattcctgctcatcttcctaacccttaacgtgttgagtgctccagtgctgaatcttcagtgtctcaacttcatttatatctattcacaaggtgatactcagttggctttaaacaccacacagctgctgatgaatccaaaatttacatctccatcttgtacctcgcttctaaatttcagactttttaatatatccacttgtctatcaaatatctccacttggctttctaataggttttgggaacctatcatgttataaaacattgttatccaccagttttctcctcccagttaaaagaatttcttccttccagttgctcaggaggaaatcttggaatccatacttgagttctttcttccgcaatacataatcaatcagtcaaaaaaactggcttggtgtcatggctcatgcctgtaatcccagcactttgggaggcctgggcaggagggtcacttgagcccaggaatttgagaccagcccaggcaacatggcaagacgccatctctactaaaaaaaaaaaaaaaaaaaaaaacacttagctgggcatagtgatgcatacttgtattttcaggagactgaggtttgagcatagcttgagcccaggaggttgaggctgcagcgagcttttattagcgaaaaagcactctagcctgggtgacagagaaagaccctgtctcaaaaaaaaaaaaaaaaaaaaattctatcagcttcacttaaaaatatatccagaatctgactgcattttaccatttttaatgttatgccatcaggtttcactggattatttcaatagtctctcctggtttctctgctactgctcttgcttctcattagtctattaataatgaatcaggtgaactttctagagtagatcgtagcatcccattcctctacccagtacttcaactctctgtatttttcatcctgcctaacaacaaaaaaactataaattattgtttgcatatgcatgtgtgtgtttgtacgcatactgttgttattcaccctgttttacatttagcccatttctagctaatttttgtatatggtactatctgtggttagaggtgttttttgtttttgttgtggtagttgtggcaataatttcttttttacatagtcaaattattccagcaatttgttgaaaaaaatatcctctctccatcgaattacattggcaactctgttctctggtcctcacagatcagttcctcatgatgactgatttttcaggaaatgtgggctttgaacagacttcactcagaaagcctgtgctagagttccagcatagggacctcattcctttatcagggctcagatccttcatcctcttgtaacaggctctggacctacaatggaaatctgctgacatgagattaagagaaggtatctggaatgaaggcacttctccgactccacccattccgctgacagggctccaacaactccagggtcttttaatcaagagattgctaagtcaaagacaatgcctcctcagccaaatgtgaaacacaaaggtttcataatcaaaatgaaattccttcttagcacacaactggagaaagctctaaaggagataagaatcaataataagatttataaaatttggcagcataagctgaggatgatgatatttcccttaatctttatgtttccagatggcactggtgtggcagcagaaatcacatcatggatgagacgctaagaattggcacaagatctgcaccttagatccaaagactatgtgatccaggccctcaaatacatcttttctaatcctcataataattctatgaggttggcaccattgccccattacaaatggggagaggttatgtgcaaagtccaagctcacatcaccacaatgggatagcctgaggatgcaatcccaacaccatttcctgagtcatgctgtgctaggccaaaatttggattcctaaagtcccttaatggtgatcaaatggtccaagttgcaagttaaggagagtaggtcggtaaagacaataaatcactgtactccccagacttctccaactaatcccagttattcttcatgcatttaacataaagctcttcgccggacaacctggcctcttactctttccctaaacaaagtttttttctgtagtctctatatttttgctcaaatgtccctctctgcctataatgaccaccctattttctaagtacctttaatgactactttcactcttctgagctcccttctgaaatctttttttcttccattgctatgttaccactacgatctacctgtcagcacaagtgttgcatgtacttgctccgatgttgtgttactaaaaataattactaccagtttttctgcatcaactatgtgccaggcactgtgtgaagtgcttggttaacatttgtttcattctcacaatagcctcctgaaataggtatttttatcttctctttattgatgaatataacgagatgcagggaaatgaattaatttagaaatcaaagctagtaagtgggtgagttggcttttaaaccaatgtgtgacttcaaagttggagttgttgatttttcccccctttgagttttaagcctgtttgaacatatctggggcacttggagatggtgcaccagaaatacattggcagaaaaaatttttcccaagagaaaagagaagcaaaacacataaaagtgactcaaggatggaggcccaagacagagaggagaggcaactttgacttccaccatgtgtctgtttctattgtctggcagcccagcctatgggagttgcctgaggtttagggagaagcaactatgataatctgtgaattgctagatttggcatccatggtgtggggcatggtggtccaacattttcccagcaagcttctaatgtgctggggtctatggtggcttttgtgagctgcactgacttcagtgcggactccacaggtcagggaaccttgacaccccctgtgcttcggcaactcgtttgtggtgggttgtgacaagtgatattagtaacagccggatggaaaaaggaaggaaaatgtaaggtcaatgcaaatttttatcaagtacctacgatgtgcgggcaattttgcaaggtgctagtgtcatgcagcctgtggcatatttgagcagacttatgggagtatatagaaaagctaggagtgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaagctaggagtgacaaaggtcttcatacacttgtctttttgtaattcatctgcccagagtgggcaaattttggtaattcatgcacaggcactatactgtacatgctaaccctgactttactcactgctctgtttctcacccaagtttgttatgaatgatttaaagatgctgaagatacctggatataaagaagggggacgaagaagctagaaaaatgctgttgcaatattattttggccctacatttcccccagcattctgttgcccagaaattgatttgcatcactgtttgtcttgccttctcagttcctttggcaataacgattatattatccatctacttttcttttaaaaattcaaagtataaaaataagtgtatttaataatttgttgaacaaatgcatacataaatgaataaagactgtcatgaataagtacttttaaactccaacaagcagcataaatgaatgaaacttctcatttttctctccatgtctccacttctgtaggtttctacaagcagagggtgtaatcaaaattgaccagtacactcattcttcctgggaacagaacatgtaggatgctctaaaaataccttctttgattcattaaactgagtttctcaaggatgtaacgaaaaggaacacaatttgttctagaaagagattttcctatatgtcctaagaaggagaaaacaaccaggagacaaaaaggaactgagatattgaccaaaatagatcattaggaaagagcgggtgattttgagtcaggtttttttaaaaaaagcaacagaaaacagaagttagaaagaaggtaggaagatactcatgtcttgatatgctatcattttaataacttaatattgattttaaagtaaaaaccaaccttatttttccattgtatgggccaaaatcatgtgagtttgtgtcacacattgagggcaatgacagtgctagttaaataaagagctcgttgatgtgcctgagtaacactgtgaactcagcattttgataacgatgtaagggctagaaaattaggcttttagatgtccccaggtcagaggtgagcctgggttgttaaatgaggccgtaagattcctctgccgccacatgtgatttgactaagatgacaatgataagtgtcccttcagaggtatggagccttctgagaccaggtcactcattatttcaaggtgacctcaagtccaagggcacattttaacttcatgtacaacaaacagcatcacgctgctccttgatgtttactggttcattaaagggtaggatgtagggtgtgaggaagtgagggtggtacattttattcacaccagtaaaagaagaaatgctcaagttatattgtataatttctatgaaaaaaagtaacagaaatcagcacaccatttttagaaggctcaccacgtgtgaatatctttccaaaaagtgatttgtcaaaataattgacgtaactatagtgtttctcacattttctcctaagtcacatgcctaaaagctcagcagaaaaattaatggaagaaaatgtaacccatttaagataagctgaaatataagcaaagtcaaaagataacaaattgatccccccaaaattgatatataaaaagtaaaaagtaagttttggctgaacgcggtagctcacgcctgtaatcccagcactttgggaggccgaggcgggcagatcacctgaagtcgagagttcgagaccagcctgaccaatgtgaagaaaccccatctctactaaaaatacaaaattagctgggcgtggtggtgaatgcctgtaatcctagctactcgggaggctgagggaagagaatcccttgaacccaggaggcggaggttgtggtgagtcaagatcacgccattgcactccagcctacgcaacaggagcaaaaactctgtctcaaaaaatagtaattgtgagtttctaaaaatcaataaaatcacacacacacacacacacacacacacaaaggaaaaaagagcaaaagatggaacacaaatctaaacataaagtggtccttaaacatatgaaaggtagtcattgtcatgcataataagagatagaatttaataatacatgaaaatgccactttttaccaatttagattcagaaaatctcaaagtttaaaaatacaccttgtttgcaactctaaaggaaaataagtcttacattgcagatagtaatgtatattggtgcaatccttgtagaagacaattggtaatacctttcaaaattataaatacatatccttttctaatggttctgctcttgggaatttaccttgaagatacacatctgcaaaaggatattaccatagtctcagtcattacaattttgcttgtaatagcaaattagtgaacaacacatatatgtcagttatgattattttgcaaccataaaaaatgaagataaagatggatttgtcaaaatttgatatttattcatgataaaaaaaactctcagaaaattaggaatagaaggatatgtcctcaacctgatgaaggccatccacaaaaaacctacatataaaactatatttaatggtaaaagattaaattattttcctaagatcaggaaaaaagctaagatagttgccttaccagacctattcaatactatactggaggttccattcggtgcaacaagacaagataaaaaaataaaaggcatccatattggaaaggaagaggtataactgtctttgtttccatacatgatcatctatgtaaacaatctgatgaaataaataaaaatgatctacaaagttgcccatgggatgtaatgaacaattgatagccttttcaacaaatggtgctagaataactggatatctctatgtaaaaacaaacaaaaacaacaacaaaacccaaccacctctatttatagcttgcaccatatatacaaaattactagagctgagcctaaatataaaacctaaaactataaaacctctaaaagaaaacagaagaaaatctttgtgacattgggttaatcatagccttcttgagatatcaaaggcacaaaccataaaagaaaatactgataacaaagacttaatcaaaatttaaaacatttgctcttccaaagatagtgttaagaagataaaaggtcaagtcagactgagtaaaatatttgcaaaaaaaaaaaaaaatctgatcaaggtcttatattcaaaactattaaagaacccttaaaactcaatattaaacaacccaatccttaaaagatttcaaaatttaaactaaaattaaaatggacaagtaagcatacaaatagattgcaaataatagaaaaacacatatcatgcaaacaaataccacaagaaagctgatgtattattctaatatcagacaaaatagactttaaagcaaaagaaaatgttactggagacaaagagaaacattttctaataagattgtcaatctgccacgaaaatataataattataaatttatatgcaactaataacaaagcaccaaatacatgaagcaaaaatggacagaaatgaaaacaattcaacaataattgtaagagatctcaatatcgcattttgaacaatgtatggaaaaactagacaagacagcaacaaggtaacagaagccgtgaagaataaaccaagtatatctaacagatatctatagtacacttcacccagtaacaacacaatacacaattttctcgagttcacatggaccattgtccagggtaggtcatatgctagactataaaatgcttcataaatttaaaggatagaaataatataaaatatgttctccaaccacaatggaatacaattaaaaatcaatagcagcaaaaaattagggaaactcataaatatgaagaaattaaacagcatattcctaaataaccaatggatcaaagaagaaatcaaaagggaaatcagaaaataatttgagatgaatgaaaatgaagacacaacatactcaaatttatgagatgcagctaaagcaattcttcaaggaaaattcctagttgtaaattcctatattaagtaagaagaaagatctcaaattagtaacaatattttaggttaataaaataaaaaaaaaaaaaagaaaagccactgccaaagaaacacacacacacacacacacacacacacaagactctggaaaaagaagagcacactaaatctatagctagcaaaaggacagaaataataaaaaattacagcagcaattaatgaaacagagaatagaaaaacaatagagaaaatcgatgaaaccaaaagctgtttttttaaaagatcaacataactgacaaagcattagttagaccgaccaagaaaaaaaaaaaaaaaagactcagattattagaaccagaaatgaaagaggggacattactaccaatgctacagaaataaaaggaattacaaagaatatgatgataattgtatatcaacaatttagataacttagatgagatggacaaattcctagaaagacacaaactactgaaacttactcaggaagaaatagacaatctgaatagacctgaaacaagtaaagagattagtaattattttaaaaattagctaaactggatttcatcaaaattaaagacttttgtgcttgaagatgcattaaaatcaaagcacaaaactggttatatttctacacaaagaataatctgtaatagacaatctgaaaataaaatcaaacaaatatttgcaatcacatcaaaacaataaaatagttaataataaatttaacaaaataaatgcaaaagttatacattgaaaactacaaaatgttgttgaaagatattaaagaagctgtgaataaacagaatagcatctcatatttatggattagaaaacttaacagtgtttagatagcagtactcctcagattgacgtacagtgcaatccctatcagaatcctggtgtcttctttgtagatactgacaagctgatcctaaaattcatatgcaagggtcccaggataaccaaaacagtcttggaaaagaggaacaaagtaggagggctcacatctcctgatttcaaaatttactacaaggcaatggtaatccagaaagtgtcgtgttgagatgaggataaaaatgtatagattaatggaatagagttaaaagtccacaaatgaactaatacacctatggtcaactgattcaatgagggttacaaaaccattcggtggcagcggaggtgagggtaggaggggaagaatcgtttttcaactcatggagctgagacagttgaatagctacacgcaaaagaatgaagttggaaactttcctacgtgcaaaagaatcaaagtggaacctttccttacctttccttacatatccaaaaattaactcaaagtactaaaactataaaattatcagcagaaaacttaagggtaaattgatacacctttggatttagcaaaggattccaagacataaactttttcaaagcacagaaatgaaagaaaaaagtagataaattgtatttcataaaaattaaaaacttttgtgctcaaagatgccattaagaaaggggaaagacaacccaattgtactgaatgaagttcaatttatctattagctaatttttacatataatgtaaggtaaggctcaacttcattcttacaagtcaataataaaaagacaaataacccaacttaaaaatgggcaaaagatctgaatatacatttcttcaaagaagatgtataaatggccaacatatgaagagatagttgatgttattagtcatcagagaaatgtaaatcaaaaccacaagaaaataacacttcacagtcactagaatgactacaataataaagtcagataattataagtgtttctaagtatatatcagaatcctcaaacattgctgacagaaaagtaaaatgcttcagccgctttcaaagaagtctgacagttggtcaaacaattaaatatacagttaccataagacccagtaattccactatgggtacataactagaagaaattaaaacatatttccacaaaaaatgtgtacatagacatttatagcacatttatttataaggcacaaaaggtgaaacaacccaaatattcatcaacctacgaatgaataaacaaaatgggacataatcatgccacggaacactattcagccattaaaagtaaccaagtactgatacatgctattacttaccacatcccacatagacctagaaaatattatgctaagggaaggaaaccagccaccaaagactacatattatcattccatttgtatggaagtccagaatagagaaaccgacagaaacagaaaatagattagtggttgctgaaggcaggtgatggtagtggggatgggaaactgtttaaaaatgaacaaatattttgacaattcaccaaagaaaaaatgttgttgggaaagaaacatatgaaaagatgctcaacataatttgtaatattatataggttaaaataaaaagaccaactttattgttagcaaagatttagagcaactagaactcccagacatcgttggtggggatgccagatggtacagccactttgtaaaacagttctgcagattctagtaaagttaaacttacatgtatctaggacccagattttcactcttaggaattttacccaagagaaatgcaaaatatcgacgcaaaacctacagtaaatatttagagcagctgtattagcttcctattactactgtgacaaattaccacaaccttcgtggtttaaagcaagacaaatgtattatcttacaattctgaggttacaagttcaaaataactcttaggctaaatcaaagtatgttgggttttgtctattctggaggctctaggggagaattcactttcttgctgattctgacttcattcctggattgtagcctccttcattttcaaagccagccatgtagcatcttcaaatctgtctgtctctcagacacacacacacacacacacacacacacacacacacacacacacacggctctgcttctcctacctccctgcttcccttataagaacctttgtgattatactgggccaacctggataaaccaagataatttctttatctcaaaatttttaatttaatcatacccacaacatcccttttgacattaacatattcacagtttctggagattatgattcagatgcattgtgtgtagaagacaaaggggtagagccaggcgtggtggctcacacctgtaatcccagcactttgggaggccgaggcaggaggaagcacctgaggttgggagttcgagaccagcctgaccaacatgatgaaatccagtctctacgaaaatacaaaaattagccgggcctggtggtgggcacctgtaatcctggctacttgggaagctgaggcaggagaattgcttaagcccgggaagcggaggttgcagtgtgctgaaatcgcgccattgcattaaagcctgaccaacagaaacaaaaacagaaacaaaacaaaacaaaaaactctcaaaaacaaaaaacaacaaaaatgggatggagcaggtattattctgactactacagtagctttacttaaaattgctaaaactggaaaaaatgaagatggcctgttacctgatgaatggataaacaaattatgatacattccacacagtggacacaaaatctgagacacctcaacaccactcccttacataatcttctcacaccaacatgcctgacacatgtgagaagtgaatggtaaggctggtgtgcatcttagagtcactgacctcctgacaaagattctctctttgaccaaactctagacaggctcctctgagctctttttcattcattccatgtccttggatgtgttctcaagagtccgactttagcaagaattctgctaagttagtttaggcaggaccctcgatatgtcacctttgatatgtgattgagttcctcatcctccaccatccctcaggtgacatccgattcgcctggcctgccttcaataagaatcctattagttggatttagccagaatctcctccaactctgatgtttcctcttagtaattttccttctgctgctaaaaattggctataaattcccaattgttcttgttgtttttgaagttgagcccaatttctcctgattactgcaaaactccatttagtacaccttataccaatggtgatggtcctgaataaagtgtgccttaccattttaaccagtgtcaggaatattcttctttaacactgctcatgttatagacagaatactatcatctgaagagatcaggtgacttgcccaagtgcacatatctgagatctcctgcttcttggtttggtactttccctaccatactccacattaatccttactgagttcctactcctaagaaaatcataatgtgagtgaaaattaatagcataaagcactatacggtggtctttctttcccttaaagcatgagtttgagagggctttatggtacagtcattaacaactcagacttggggacaaacaggtacagtagcaggtcctggctctgctacttcctaattaagtaattccctgtgccctagttctgccttcataaaataaagctaataatatctaatattcagggcagttgtcagaattaaataggaatttcctggtaaaattcttagcatgctaagtgctcagtatctggtggctattatcattcttgtcactatcattatcgctggtctttattgaaaatcagagcggagctaacagacccatgtaggccctttagcatccactcttctgaaaaagacaatttgtagaatggcacacaagccttttgctgaagttcaaaatcagcccaaaggatgctttgtttaaaaatataataataattgctttgtaaaatacatgtttgtagttgactggattcaactgaattctaccgattatttcagaaaacaatcagttgcatgaattttacatcttaaaataagctagtctgtctccagataggtaaggtggatagagtcttcagaacaagtaaatttcatccttactttcctcagttaggttatatcacatttaatgtttagtgagaagcaaagatgagcgtgatcacaaagtgttataaaaatacatataaattcaaacaatgtatattttggaagagagatagggtttgtatacaatgcaaaataattgattttacctaaaatttcaacctttgtaaattttgtcacctgtgcagttggaatagaggtgattacattgcctgcaaaccctgcctttggggtttgcacagaatcgtataataatatctcatatgtacagagcgtttactgtctgctggtgttgtgctgagcactttatgcaaattaactttatgtgcatgaacttgtgcacattaatttttaaaatcttcacagcacacctgtgaattaggccccttatagtcattatttgaacaattaggaaatcaagacacagaaaagttaagtaatgagcccgaggtgacgtgcggaatctagactcactcttgggcctccttagcagggacaggctgtgggtgaagccagtggggtcatggctgagggtgcaggtccaggtaaggaaggagcaggctgggcaatttgacagcaattgaaagaccttagagaaacttgtcaaagtaagatcaggagggcggggagacatagcagccaaggaaaataaggtggggaaatctgtgaacccttctttaacttagtaaagagagtgggggcggtggggggaagcttatttgaccttggagagaaaggcctagtaaagggaggcagaacacaagtttagggaattaccattggaaggatgcacctcctttgctggagaaaaatcagggatcttaattaggctgctgctgctgaggtattagtggaggaatctctttagctcaaggagggccgttgccagaggacaaatgggggagcatcccttgcatttaaatattatataaattgcacatgagtctcaatcattcttacaaaattctccctccatatccctcagtctctccagtaacaagtgaaataggaggcaggggtttgcttacctgtgtacttcccttgattgtgatcagcttaagtggattctacactcattcattctacaaatatttatattgaaatgtttacatcccccctcactgacacacacagaaaccttaacaatttaaaataaataatctctaaaaatcatgtttcagcctggtgcagtggcttacacctttgggaagctgaggcaggtggatcacctgagctcagga
